United States Patent 11,098,302 (IDENTIFICATION OF POLYNUCLEOTIDES ASSOCIATED WITH A SAMPLE) - sequence listing, part 53

SEQ ID NO: 180946 - DNA, 587 bp, Homo sapiens
  misc_feature: GYAE6OF02G1MCB.34.38.D05.1.454.CMB.1.raw
  modified_base (207)..(207): a, c, t, g, unknown or other
  misc_feature (207)..(207): n is a, c, g, or t
  modified_base (302)..(302): a, c, t, g, unknown or other
  misc_feature (302)..(302): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgagggaaagngccacctctcctgcaggtcagtcagcgttcaacaccgacttctcgctggtaccagcagagacctggccaggcctccaggctcctcatcgtttggngccgtccaccgagggcccacgtggccattccccgaagacctaggttccaggtcggaccgtagggtcgggtactggggaccaggtacttccactcctaccgacctatccgacgcagtacttaggacgtaccgtagaacgttagttttcgactagttaattattactgtacagtacaattagtacgacgacgaccgtacgtggttcggcgttccggaccgaacggacgtaggtacggaaactaccgaaacgacgtagtcggacgtacgccacgtcgtcgtgttaccg

SEQ ID NO: 180947 - DNA, 739 bp, Homo sapiens
  misc_feature: GYAE6OF02HWN2Q.34.38.D05.1.454.CMB.1.raw
  modified_base (206)..(206): a, c, t, g, unknown or other
  misc_feature (206)..(206): n is a, c, g, or t
  modified_base (321)..(321): a, c, t, g, unknown or other
  misc_feature (321)..(321): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacacctgtctctgtctccgaggggaaanacgccacctctcctgcagggtcagtcacgtcgttacctaaccaccgtcttcgttccgccttcggtaccaggtcacgtacgaccgtcggccacggtcctccgacggtccttccctntactttcgttttagggtcgtccgtacctaccgacggggccctacggtcggactaccgtccgaacgtacgtacggttcgacggttcggacgtagggtcgggtcgtacgggacgtacgtaccttacaccgttcgtacccacgtactacgacgacctaaggtaccgttggaccgttacgttaaggttaacgttacgttttacggacgttaaggttacttttaacgttaaccgttcgttaacgtacgtaacttaaacgttacggtacgaacgtaccgtacgtacggttcgggtcgggtttaccggttaaccgggaaccggtaacgggtaaccgggtaagggtaacggtaaacgtaacgtaaacggtacggttggtaacggtacgtaccggtaccgtaaccgtaccgttacgttacgttaccg

SEQ ID NO: 180948 - DNA, 732 bp, Homo sapiens
  misc_feature: GYAE6OF02JM5PV.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacacctgtctctgtctaccgagggaaancgccacctctcctgcaggtcagtcagcgttcaacaccgacttctcgcctggtaccagcagacgaccgtgccaggcctacccgaggcctcctacgacgttcgtttcggcgccgttaccaccgtacgggccctaacgtcggacctacgtccccgaaggtaccgacggtttaccgaacggtttcggaccgttaaggggttccgggttaccgttacgggggaaccctaaggttaacccgtttccgaaacccgtttccgttaacccgaaccgtacgttaccgacgaccgtaacggtaacgttcggacgtaccgtagtaacgttacgtttacgacgtagtacgttacgttacttacgttaacacgtacggtttcgtaccttacgactaccgtacgttaccggtaacgtttccggaaccgttaacgggtactaaaccgggtagtaaaccgttaaccggaaacggttaacgtacgggtaccgtaccgtacggtacctaacgttcctaccggtacgtttccgtaccgttaacccg

SEQ ID NO: 180949 - DNA, 718 bp, Homo sapiens
  misc_feature: GYAE6OF02I41MO.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctctgctactctggctccagatcgccccggagaaattgtgtgacgcacgtcgccagacaccctgtctctgtctccgagggaaagcgccaccctcgtctgcgagggtcagtcacgtcgttaccaacgaccgtacttcctcgccgtacggtaccagtcagacgtaccgtggaccgtaggcctccccgaaggcccttacctaccgtacttcgtttcgggtgcccgtaccgaaccgacggaccctacgtaccggactacgccccgaaggaccgtgggttaccaggttaccggactagggttcggggtacgtacgggactaggtaaccttccgaacttcctaccgaccataccacgtactacgtacgtacgacgtacctaggtaaagttacgttcgaacctaggtttaacttacgtttaccgtagttacgtaggtaacctaacggtagtccgtaaggtaacgacccgttaagtcgggttaacgggtccggttaaaccgggacgtaaacgggacggtacgggtaaaggtaaacgtaacccggaaacgtaaggtacgggtacgtcggtaccgtacccgtaaacgtcttaccggtttggttaaccc

SEQ ID NO: 180950 - DNA, 676 bp, Homo sapiens
  misc_feature: GYAE6OF02HRV9F.34.38.D05.1.454.CMB.1.raw
  modified_base (309)..(309): a, c, t, g, unknown or other
  misc_feature (309)..(309): n is a, c, g, or t
tcagtacacgtgatcacgaccggtgctcgatttagtatctgatagttgggtttggggaggaggaagagctgctcagttaggaccagagggaaccatggaaacccagcgcagcttctcttcctcctgctactctggctcccagactcgcccccggagaaacttgtgttgacgcagtcgccagacaccctgtctctgtctccgaaggggaaagcgccaccctctcctgcgagggtcagtcagcgttaccaacaccgtacttctcgcctggtaccagcagacactcggccaggcctcccgaggtccttcccnctacttcgttttggcgaccgtccaccgacggccacgtggcctacctcccgagaccgtaggttcacggttggactaacgggtcgggttacgtagggaactaacggttcttaccaccttacgtaccaaccacgtacgaacgaccgtagtaacctcggtacgtacgtacggtaaagttcgttttacgacgtaagttaaacgtttaacttaacgttctacgtacgtaccaaagttacgtacgaccgaacgtacctaaggttcgtacgggttacgtccggtaccgaaccgggaacggtaacgggtaacggtaaactaaccggaaacgtaactacgggtgtacgtcgaccgtaacctacgtacgttaggttcc

SEQ ID NO: 180951 - DNA, 724 bp, Homo sapiens
  misc_feature: GYAE6OF02I8TEY.34.38.D05.1.454.CMB.1.raw
  modified_base (108)..(108): a, c, t, g, unknown or other
  misc_feature (108)..(108): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagtacacgtgatcacgaccggtgctcgatttagtatctgatagttgggtttggggagagaagagctgtcgtccagttaggacccagagggaaccactggaaccccngcgcagcttctccttcctcctgctacgtctcggctcccgagacgtcgaccccggtagaaattgtacgttagacgtcacgtccgccacgtcctacccttgtcctcgtagtctacccgagggaaacncgtcccaaccctcgtcctgccagggtcagtcacgtcgttactacaccggtacttctacgccgtgtaccgngaccgagacaccgtggccaggtccctccgtaggcctcctctatccgtttggtcgaccgtcccaccggacggtccaacgttcggaccactacccgagaccgtaggttccacgtggtacgtggttcgggtactcgggtaactacggtacctttccaccgtcctaccgaccgtactccgacgaccgtaagtaacgttccgtacgaccttaggtaacgttacgttttacggactacggttattaaacgttacgttaacgtactacgtaccgttaataaccggttacgtacgcgttaccgtacgtacggtacgggtaccgttaccggaaccgtaacggaccgtaaggtaaccggtactaacccgtaaaggaaccgttaggtaccgttacgtcctaccggtaaccttacgttacccttgttaacccc

SEQ ID NO: 180952 - DNA, 564 bp, Homo sapiens
  misc_feature: GYAE6OF02JCZL4.34.38.D05.1.454.CMB.1.raw
  modified_base (207)..(207): a, c, t, g, unknown or other
  misc_feature (207)..(207): n is a, c, g, or t
  modified_base (244)..(244): a, c, t, g, unknown or other
  misc_feature (244)..(244): n is a, c, g, or t
  modified_base (306)..(306): a, c, t, g, unknown or other
  misc_feature (306)..(306): n is a, c, g, or t
  modified_base (342)..(342): a, c, t, g, unknown or other
  misc_feature (342)..(342): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgtcagtcgcagacaccctgtctctgtctccaggggaaagngccaccctctcctgcagggtcagtcagcgttctaacnccgacttctcgcctggtaccagcagacgacctggccaggcctcccaggctcctcatcttggngccgtccaccgagggccacgtggcactcccgagacnggttcagtcggctaggtcggtcgtagggacaggtaccttcacttcctaccacctatccagactagaccttgacgcctagtaagttatttcgactattattattactgtacagtactaatgtcgagacgcgtacgtgtcggacgttacgaccgtaagggacgtaaggacgaaactaccgaaacggacgtggacggtctcggacctaccacttcgttgttaccg

SEQ ID NO: 180953 - DNA, 829 bp, Homo sapiens
  misc_feature: GYAE6OF02H64K7.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaggggaaagacgccaccctctcctgcgagggtcagtcagtcgttactaacaccgtactttcgtacgccgttcggtaccacgcacggagaccctggaccaggccttacccgacggccttacccgtacacgttttcgttttcgggttacgcccgtacccgaaccggacgggcccctaacgttcgggacctaaccgttaccccgaaggaaccgttaacgggtttcaacggtcggacgtacgggttcggggttacgttacgggggaaccaaggtacccttttacaaccggtttccttacccgaaaccgttaacttcgaacgacgtaacgttaaccgtttacggacgtaccgtaaggtaaacgttactttttacggaccgttaaggttaactttaacgtttaaccgtaggttaccgaacgtaacgtaaacgtttacgtaaccggaacggtaacccgtaccgtaaccgtttcggggtaccggggttaccggtttaacccgggaaccggaaaccggggtaacccgtaaaggggtaacggtaaaacggttaaacccgtaaaacgggtaaaccggtttacggtaccgggttaccgtaccggtaccgtaacccggttacgttaccgttacgtttaccccg

SEQ ID NO: 180954 - DNA, 671 bp, Homo sapiens
  misc_feature: GYAE6OF02GG8OY.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagagcccaccctctcctgcgagggtcagtcagcgttctaacaccgtacttcttcgcctggtaccagcagacgacctcggccacggcctcccgaggcctcccgtctacttcgtttggtgccgttccgaaccgacggggcccacgtcgggaccactccccagaccgtcggttcaggtcggcgtaggttcggggtcgtaggggactacgtaccttccacgtcctaccaaccattccgaacgcgtaacgtacgttcggaccgtacccgtaggtaaacttagttttcgaccgtaaggttattaacgtttactacggtacacggtaactaattacgtaccgacgaccgtacgtacgttgggtacgggtcggttaccgggaccgaaacgggtaccgaagggttaacggaaacgttaacggaaaccggtacgttacggcggtacctacgacccgactacgttcgttcgttaccg

SEQ ID NO: 180955 - DNA, 796 bp, Homo sapiens
  misc_feature: GYAE6OF02HIA10.34.38.D05.1.454.CMB.1.raw
  modified_base (155)..(155): a, c, t, g, unknown or other
  misc_feature (155)..(155): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccgganaaattgtgttgacgcagtcgccagaccaccctgtctctgtctccgaggggaaacgacgcccaccctctcctgccgtaggggtcagtcacgccgttacctaaaccacccgtactttcctcgccttaggtaccagcagacgaccctggaccacggcctccccgcgggtacctcccctactactttccgttttcgggtcgtacccgtcccgtaacccggaacggggtccccaacggtcgggtaccctaccgtaccccgaacggtaaccgtacgggttccgaacgggtttcggaccggttagggttacggggttccggtagggggaaacccgtaaggtacgtttcccgaacctttcccgtaccaaccctacgttacccgaacggccgtaaacgtccggttacgacgttacggttacgtagggtaaactactttcgacgttaccttttaacgtttttacttaacgttcgttactacgggtacctaaggtttaaccgttaaaggttaacgggtcgggttacccggttaggggttacccgtccgggaaccggaaacgggtaccgaaggggttaacgaaacgttaacggaaaccggtaatcgggtacggtacgttaccgacaaccgttctaccgtttcgtacttacccg

SEQ ID NO: 180956 - DNA, 635 bp, Homo sapiens
  misc_feature: GYAE6OF02I10GE.34.38.D05.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (345)..(345): a, c, t, g, unknown or other
  misc_feature (345)..(345): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaggggaaagagccaccctctcctgcagggtcagtcagtcgttctaacaccgacttcttcgcctggtaccngcagagacctggccaggctcccaggctcctnatctttggngcgtccaccgagggcccacgtcggcactcccagacnggttcagtgcaggtggtctgggacacgtacttcgaccttacctcacccatcgacgtcgaacgtactttcgacgtcccgttaagtaacgttacgttttgacgtaagtttattaacgtttacttagtaccagtactaagttacgtaccggaagtaccgacgtaacgttggttacgggtccgtaccgggtacgaacggggtacccgtaagggtaacggtaaaacgtaccgaaaacggtaacgttacggtacggaccgttacggaccctaacgtacgttaccgtcgttaacccg

SEQ ID NO: 180957 - DNA, 616 bp, Homo sapiens
  misc_feature: GYAE6OF02GCK2M.34.38.D05.1.454.CMB.1.raw
  modified_base (313)..(313): a, c, t, g, unknown or other
  misc_feature (313)..(313): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
tcagtacacgtgatcacgaccggtgctcgatttagtatctgatagttgggtttggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattccaccccctcagagacaacgccaagaacacactatatctgacaaatgaacagtctagagacgaccgaggacacggctgttctattactgtgacgaaggnggtggactaacaatcgtagttggttttgacttcgtcggtggggaccgaagggacaagtcggtaccaccgttctcttacacgtccctaccaccgaacgggtcccacgttcccgtcccttccccgcggcccgtcccgtcgtccctccgacggaccgtccgtacccgtccgacgacgccacgacggcccggcccgtggcctcgccgtggtaccgaaggtacccttaccgtccacgtccgtacgtcgttacgtcggacggtcgggtaccgtcggaccgtaacgggccgacgtacggtagntcgatnc

SEQ ID NO: 180958 - DNA, 652 bp, Homo sapiens
  misc_feature: GYAE6OF02F2GD9.34.38.D05.1.454.CMB.1.raw
  modified_base (269)..(269): a, c, t, g, unknown or other
  misc_feature (269)..(269): n is a, c, g, or t
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
  modified_base (644)..(644): a, c, t, g, unknown or other
  misc_feature (644)..(644): n is a, c, g, or t
  modified_base (649)..(649): a, c, t, g, unknown or other
  misc_feature (649)..(649): n is a, c, g, or t
  modified_base (652)..(652): a, c, t, g, unknown or other
  misc_feature (652)..(652): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccgagggaagggctggtgtgggtttcacgtattacgagtgatgggactgacacaatctacgcggactccgtgaaggccattccaccccctcagacgaccaacgccaagaaccacactatatctgacaaatgaacagtcngagagcgagacacggntgtctatactgtnacgagnggtgctacatcagttggtttanatcgtcgtgggaccaaggactaagtggtaccaccgtcttcgttacgacgtaccctaccgaaccgtaacgggcccctaggttccccggtcccgtttacccccgtcggccccgtacccgttcgtacccgttacccgacgggacgtacccgtacccgtcccggaaggtaccgaccgtaccgaccgggtcccgtacccggtcgggccgttccggacccgttacgggtaccgaaacgggtccctttaaccgttcccgtactaccgtacgttccgtacgtcggacggtcgggtctacgggaccgtacgggcctacgaagtacgngcacngtn

SEQ ID NO: 180959 - DNA, 580 bp, Homo sapiens
  misc_feature: GYAE6OF02G1OTW.34.38.D05.1.454.CMB.1.raw
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (383)..(383): a, c, t, g, unknown or other
  misc_feature (383)..(383): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagacgccacctctcctgcagggtcagtcagcgttctaacaccgacttctcgcctggtaccagcagagacctggccaggcctcccaggctcctcatctttggtcncgtccaccgagggccacgtggcactcccgagacagttcagtgcagtggtctgacngactcntcncacntcancanacttgacgctgaagtatttcgcgtagtatactttaactgtactagtacaattacgtacgagtacgtaccgtacgttcggttaggggtccgtttaccgggaccgtaacgggtacgtaacggggtaacgtaaacgtaacgtaaaacggaaccgttaggtacggtactacggtaccgtaccgtacgttccgtgttacccg

SEQ ID NO: 180960 - DNA, 626 bp, Homo sapiens
  misc_feature: GYAE6OF02G2L7B.34.38.D05.1.454.CMB.1.raw
  modified_base (211)..(211): a, c, t, g, unknown or other
  misc_feature (211)..(211): n is a, c, g, or t
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (325)..(325): a, c, t, g, unknown or other
  misc_feature (325)..(325): n is a, c, g, or t
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (456)..(456): a, c, t, g, unknown or other
  misc_feature (456)..(456): n is a, c, g, or t
  modified_base (466)..(466): a, c, t, g, unknown or other
  misc_feature (466)..(466): n is a, c, g, or t
  modified_base (476)..(476): a, c, t, g, unknown or other
  misc_feature (476)..(476): n is a, c, g, or t
  modified_base (601)..(601): a, c, t, g, unknown or other
  misc_feature (601)..(601): n is a, c, g, or t
  modified_base (613)..(613): a, c, t, g, unknown or other
  misc_feature (613)..(613): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgtgacgcagtcgccagacctaccctgtctctgtcctccgaaggggaaacncgcccacctcnccgtgcaggtcagtcagtcgttacaaccnccgtacttctcgctaggtaccagcaggacaccgtgcccgaggtctcccgaggcctaccgtcattcgtttggacnccgttccaccgagggccctaacggcgtcaactcccgagaacgtggttacaggttcgactgggtcggtcgtagggaactcgtaactccgtacnctcaacntacgncgtactacgcgacgctagattagtttnacagtttaanctttaaccgnactcgaacaacttgacggacctcgactcggtgggtcggtaccggtaccggtacccgaaacggtccgtaagggtaacggtaaactaaccgaacgtaagggttccaagggttctacggaaccccgtntaaaccgggttnttaccgttaccgg

SEQ ID NO: 180961 - DNA, 926 bp, Homo sapiens
  misc_feature: GYAE6OF02HKKLC.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgcccccggagaaattgtgttgacgcagtcgccagaccaccctgtctctgtctccgaggggaagacgccaccctctcctgcgagggtcagtcacgtcgttactaaccaccgtacttcttccgccgtaggtaccagcagacgtacctggaccgacggcctacccgaggtcctcccgtctacttcggtttcggtcgtccggtacccgaccggacgggtaccctacggtacggacctaaccgttcccccgaagtaccgtacgggtttaccgaacggtcgggtacgtagggttcggggttacggtacgggggtaacctaacggttaaccgtttaacccgtacccgttacccgttaccccgtaaaacccgttacgtaacccggtaaccggaccgttaaaccgggttaacccggttttacggaacccggtttacccggttaagggttaaaacgtttaccgtttttaagggtaacccgtttaaaggttttaaacgttttaaaccgtttaccggtttaacggttaaccgttaaacgtaaaccggttaaacgtttaaccgttaaccgggaaacgggtacccttaaccggttaacgggtttccgggggttaacggggttcccgggttaacccgggtaacccggggaaaccggggtaaccgggttaaaggggtaaaccggtaaaacgttaaccgggtaaaacccggttaacgggttaccgggtaaccggggttacttaacccgggaacccgttaacccggttaacggtttacccgttacccgggtttaaccc

SEQ ID NO: 180962 - DNA, 767 bp, Homo sapiens
  misc_feature: GYAE6OF02HRJ5L.34.38.D05.1.454.CMB.1.raw
  modified_base (197)..(197): a, c, t, g, unknown or other
  misc_feature (197)..(197): n is a, c, g, or t
tcagtacacgtgatcacgaccggtgctcgatttagtatctgatagttgggtttggggagagaagagctgctcagttaggacccagagggaaccatggaaacccagcgcagcttctcttcctctgctactctggctcccagatcgccccggagaaattgtgttgacgcagtcgccagacaccctgcttttttttttcngtctccgagggaaacgacgcccaccctctcctgcgagggtcagtcgacgtcgttacctaaccgtaccgtacctttcgttccgtccgtacggtaccgagtcaagacgaccgtcggccaggcctcccgacggtcctacccgtcacgtttccgtttggtcgtaccgtccctaccgacggcctacgtcggactactacccgaagtacgtacggttcgaggtcggacgtacgggtcgggttcgtagggacctaaggtaccttacgtaccgttccgtactaaccctacttaccgagccgtaaacgtaccgttaggacccggtccgttaaggaaacggtttagtttggaaccgtaaagttttaacttacgttaaccgttgtaaccgtagtaaccgttaagttaccgtaaggaaccgtaaccgttcggaacgtttcggggtaccgggttacgtaacccggggacaaaagggggtacccgtaaggggttaaacgaaaccggttaaccgtaaaaccgggtacggttaccgggacgttcggtaaccggacctaaaccggtatttccgggtccttaacccgg

SEQ ID NO: 180963 - DNA, 759 bp, Homo sapiens
  misc_feature: GYAE6OF02IDLJU.34.38.D05.1.454.CMB.1.raw
tcagtacacgtgatcacgaccggtgctcgatttagtatctgatagttgggtttggggagagaagagctgctcagttaggaccagagggaaccatggaaacccagcgcagcttctcttcctcctgctactctggcctacccagactccgaccccggaagaaattgtgttgacgcagtccgaccagaccacctgtctctgtcctacggaaggggaacgacgcccaccctctcctgcgtagggtcagtacagtttttcgacctaaccgaccgtacctttctccgaccgttcggtaccacgtcaggtacgaccgtggacccacgggcctccccgaggtccttcccgtctagttccgttttagggccgtaccggttcccaaccggaccggggccctaaccgggttcggaccctaaccgtccccgaaggcgtacgggttacaaggttcggacgtagggttcgggtacgtcgggaactaaggtccttacgtccttccgtaccgaacctgtaccgagtacctaagtacgttgaaccggtccgttaaggtaagttcgtttacgacgttaagttaacttattaacgttcgtactacgataagtactacgaacgtacgtcgtacgttcggtcggggtcccgttaccgggaaccggttaacgggaaccggtaagggtaacggtaaaacgtaacccggtaaacggtaaccggttaggtacccggttacgtaaccgaaccgttaccgttaacgttccgttaccggtttaaccc

SEQ ID NO: 180964 - DNA, 572 bp, Homo sapiens
  misc_feature: GYAE6OF02F4BR2.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagacgacctggccaggcctcccgaggcctcctcattctttggtcgccgtcccaccgagggccacgtcggcactcccagaccgtaggttccagtcgggctaggttcgggtctgggacacggtacttccactcgtccaaccgtatcacgacgtacgtacgttcgacgtccgtagaagttatttgactagttaattattacgtgtcagtcaagtatcgacgacgctacgtgtcgggtacgtcggaccgaacgggacaaggtaggaaagtacgaaacgtagtgtaggcgtgaccacgtactcgtgtcg

SEQ ID NO: 180965 - DNA, 807 bp, Homo sapiens
  misc_feature: GYAE6OF02HZ5HN.34.38.D05.1.454.CMB.1.raw
  modified_base (142)..(142): a, c, t, g, unknown or other
  misc_feature (142)..(142): n is a, c, g, or t
  modified_base (207)..(207): a, c, t, g, unknown or other
  misc_feature (207)..(207): n is a, c, g, or t
tcagtacacgtgatcacgaccggtgctcgatttagtatctgatagttgggtttggggagagaagagctgctcagttaggaccagagggaaccatggaaaccccagcgcagcttctcttcctcctgctactctggctcccagntgccccggagaaattgtgttgacgcagtcgccagtacaccctgtctctgtctaccaggggaaacngcccaccctctcctgcacggggttcaacgttcagtccggttactaaaccaccgttactttcgtccgcccgttaggttacccaacggtccaaggaaccgtaaccttcggggccccaaggggtcccttaccccccgaaggggtccttccccttacgaaccgttttccgtttttacgggaccggtccccgttacccgttaacccgtaaccgggggccctaaaccggttcgggaccctaaacgtttccccccaaagggtacccctaagggtttttccgaaacggttcggggtcccaaggttcgggggttccttaacgggggaacctacggtaaccgtttcaaccgttcccgttaccaaccctaagtcccgtaagaccgtaacgtaaccgtttcgaacggtccttaggaaacgttaagttttcgaaccgtaaggttacgtttacttaaccgttcgtcgtaactaacctaagttaacgttacggatacccggtacgaaccgttgggtccgggcgtttaccggaaccgtaacggaccggttaaggtacggaaagttaccgaagtaaccgtaggtcgtacgacggtaccacccgtatcctggttaccc

SEQ ID NO: 180966 - DNA, 670 bp, Homo sapiens
  misc_feature: GYAE6OF02IJF3U.34.38.D05.1.454.CMB.1.raw
  modified_base (212)..(212): a, c, t, g, unknown or other
  misc_feature (212)..(212): n is a, c, g, or t
  modified_base (276)..(276): a, c, t, g, unknown or other
  misc_feature (276)..(276): n is a, c, g, or t
tcagtacacgtgatcacgaccggtgctcgatttagtatctgatagttgggtttggggagagaagagctgctcagttaggacccagagggaaccatggaaaccccagcgcagcttctctttcctcctgctactctggctcccagatcgccccggagaattgtgttgacgcagtcgccagaccaccctgtcttctgttcctccgaggggaaaanacgcccaccctctcctgcagggtcagtcagcttactaacaccgtacttccgtcgcctggtaccngcagagtacctggccagggcctcccgaggtcctccttcaacttcgtttggcgtcctcccgaccggtacggccagtcgcactccgacgtactaggttcaggtcggcgtaggtcggggtctagggaactacggtacttccgaccgtctacccaccgtatacgacgtacgtacgtacttacggactaccgttagtaagttatttacggtactaagttaaatttaagttaccttagtacgtaataccttaataacgttaccgaacgtacgctaacggtcggtttacggggtcggttaccggaacccgggttaacggaaccgtaacggtaacggtaacgtaacgtaaaaccggtcggtaaggtccggacgttacgaccgtactacgttcctggtaaccc

SEQ ID NO: 180967 - DNA, 832 bp, Homo sapiens
  misc_feature: GYAE6OF02IAEHH.34.38.D05.1.454.CMB.1.raw
  modified_base (140)..(140): a, c, t, g, unknown or other
  misc_feature (140)..(140): n is a, c, g, or t
  modified_base (230)..(230): a, c, t, g, unknown or other
  misc_feature (230)..(230): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctgctccanatcgccccggagaaattgtgttgacgcagtcgcagaccacctgtctctgtctccgaagggaaagcgccaccctctctgcgagggtcagtnacgtcttactaaccaccgtacttctccgcctggtaccagcagtacgaccgtggcccaacgcccgtacccagacccttcctacacgtttcgttttcggtcgcccgttacccaaccgaccgggacccacgttacggccaaccgtccctaacggacgtaacggtttcgaacggtcggacgtaggggttcgggtccgtaggggtaacaacggttaccgtttaccacccgtttaccgtaacccttaaccctacgttaccgtaaacggcccgttaacggttaaccttacgggtaccggttaccccgttaaagggtaaacctttacggtttttaccgaacgttaaggtttaaacgttttacgttttaacccgttagtttaaaccgtaaacggtaaaccggttaaacgtttacggtaaacccgggtaaccgtaaccgttaaccgtttaacgggtttccggggttacggggttaaccccgttttccggggggaaacgttaaacccgggaacggttaaacggggttaaaccggtaaacgttaacccggaaaacggttacgttacgggttacgtaccgtaccggaccttaaccgtacgttaccgttcttaccg

SEQ ID NO: 180968 - DNA, 805 bp, Homo sapiens
  misc_feature: GYAE6OF02H0VGT.34.38.D05.1.454.CMB.1.raw
  modified_base (249)..(249): a, c, t, g, unknown or other
  misc_feature (249)..(249): n is a, c, g, or t
tcagtacacgtgatcacgaccggtgctcgatttagtatctgatagttgggtttggggagagaagagctgctcagttaggacccagagggaaccatggaaaccccagcgcagcttctcttcctccttgctactcctggcctcccagactcggcccccggagaaagttcgtagttgaccgcacgtccgaccagacctaccctgtcctctcgtcctccgaaggggaaacgcgacccaccctcctcctcgcgngggtacacgtcacgtcgttacaaccaccgtacttcttcgcctggacctacgcagactaccgtgaccacgtcctcccgacggtccctaccgttctaacgttcgttttcggtccgaccgtacccgaccgccgggtaccaccgttacggacctaccgtacccgtagaccgtacggtttcgacggttcggacgtagggtcggtcgtacgggactagtaccgtctactccgtacactacgtcgaacgcctagtacgtacgtaccgttcccgttaaacgtaagtttcgttttacggaaccgtttaggttaactttaacgtttacgtaacggtaacgtaacgtaaccgttaaagttaccgtaccgtaacggtaaccggttaccgtacgggtttaccggggttaccgggttacccgggtaacccgggttaaccgggtaaccgggtaaacccggttaaagggtaacccggttaaaacggtaaacccggtaaacgtaaccggttcgggtacgttaaccgtccggtaacccgtaacccgttagttaccccgttacggttttaccccg

SEQ ID NO: 180969 - DNA, 690 bp, Homo sapiens
  misc_feature: GYAE6OF02HPOY8.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagaccacctgtctctgtctccgaaggggaaagagccaccctctcctgcgagggtcagtcagtcgttactaaacaccgacttctccgcctggtaccagcagacgacctggccaggcctcccgaggtcctccctctattccgtttggtacgtccgtacccgaccgacgggcccaacgttggaccactccaagacgtaggttcaggtggctagggtcggtcgtagggaacaggtacttaccacttacctccaaacgtataccgaagtccgaacgtacgttaggacgtacccgttagaaacggtttatttacgacgtaagttaactttaacttacgtacgtacgaaacctaacttaaagttacgtacggaacgtaccggtactaacggttggtaccggggttacgttaccgggaaccgtaaacggggaccgtaaaggggtaaggaaaaccgtaccggtaaaaggtaccgttaggacggtaccgtacgtaccgaaccctagttccgttacgttaaccg

SEQ ID NO: 180970 - DNA, 653 bp, Homo sapiens
  misc_feature: GYAE6OF02HW52J.34.38.D05.1.454.CMB.1.raw
  modified_base (203)..(203): a, c, t, g, unknown or other
  misc_feature (203)..(203): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (645)..(645): a, c, t, g, unknown or other
  misc_feature (645)..(645): n is a, c, g, or t
  modified_base (649)..(649): a, c, t, g, unknown or other
  misc_feature (649)..(649): n is a, c, g, or t
  modified_base (652)..(653): a, c, t, g, unknown or other
  misc_feature (652)..(653): n is a, c, g, or t
tcagtacacgtgatcacgaccggtgctcgatttagtatctgatagttgggtttggggggtcccgtgagactctcctgtgcagcctctggattcaccttcagtagtcactggatgcacgtgggtccgtcaagttccgaggggaagggctggtgtgggtttcacgtattacgagtgatgggactgacacatctacgcgactccgngaacggcgatccaccccctcagacgaacaacgtaccaagacacaactatactctgacaagtagaacagtctgagacgcggagacacggtntcgtctattacngtgacaaggtacggtcggacttacgaacttccgtagtttggtttanagttcgtcggtacgggaccgaaaggactaagtcggtcacggtccttacgttacgccgtacccactaccggaacgggtacccacgtttacccggtcccgtttaccccgtccggcctccccgtacgaccgtcccacgggaccgaccctacccgtcggtacgaccggaccacggcccgacgggtcccgacgggtccgccggtacccgtacgtacccgaacggtacccgttaccgttaacccgagtaccgtaccgtcggtacgtcggaccgggcgggactcggacgacggagcctagncgtncgnn

SEQ ID NO: 180971 - DNA, 766 bp, Homo sapiens
  misc_feature: GYAE6OF02GOXU9.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgaggggaaagacgccaccctctcctgcgaggccagtcagagtagttaatagcatctacttagcctggtaccagcaacgaacctggccacgccctacccacgacctcctactaattaacgtggtacgctaactacctaaccggacggggtcccccttagggacctacgttaccccgaaggacctagggttaccaacggtcgggtactacgggttcggggtccgtacggggaactacgtaccgtttaccaccgttcctacctaaccgactacccgtaccgacggtaccgtagggtaccgtaccgtacggtaaacgttacgttttacggacgtaggtttacgttaactttacgtacggttaacgtaaccgtttaggtttacggtacccttaccgtaacccgtaaccggttaccgggtacggttaacccgggttaccgggaaccggtaaacgggtaaccggtaacgggttacgggtaaaccgtaacggtaaaacccggtaacggttacgggtacggtacccgttacggacccgtaccgttacttaccggtttacgtacctttaccgttacccg

SEQ ID NO: 180972 - DNA, 693 bp, Homo sapiens
  misc_feature: GYAE6OF02JHNKW.34.38.D05.1.454.CMB.1.raw
  modified_base (205)..(205): a, c, t, g, unknown or other
  misc_feature (205)..(205): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatgccccggagaaattgtgtgacgcagtcgccagacaccctgtctctgtctccgaggggaaaancgccaccctctcctgcagggtcagtcagcgttctaacaccgacttctcgtacctggtaccagcagacgacctgccaggcctccaggcctcctctaacttcgttcggtcgtccgtacccaacgtacgggaccacttacgggactaccgtacccgaacggtaaccgtacggtaccgtaaggtacgggttaccgaaggggttccgggttacggtacgggaactaacgtaccgttctaactccgtacccgaacctacgtacaacggtaccgtaacgtaccgtttaggaacgtaccgtaggtaaaggtttactttacggaaccgtaggttaaacttaacgtttacctggttacaacgtaaccgaattaggaccgtaagaccgtactaacgttggtacggtcgttaccggaaccgaacggtacgaagggtaacgtaaactaaccggaaaacttacggtagtacggtacgtcgaccgaactagtacgtcttaacg

SEQ ID NO: 180973 - DNA, 660 bp, Homo sapiens
  misc_feature: GYAE6OF02H052X.34.38.D05.1.454.CMB.1.raw
  modified_base (208)..(208): a, c, t, g, unknown or other
  misc_feature (208)..(208): n is a, c, g, or t
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
  modified_base (633)..(633): a, c, t, g, unknown or other
  misc_feature (633)..(633): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtcctccgagggaaanagccaccctctctgnagggtcagtcagtcttacctaacacgtacttcgttaccgccgttgtaccagctaagacgacctggccaggcctaccgagtactcctanatctaagtgactaacactcccaacgacgggtacctacgtaggttaccaccccgtacggcctaaggggtttaccagggttacggactacggggttcggggtaccgtaggggaacctagtaaactttcccgaacgtcctaccaaccgtatacgacgacgtaacgcctagaccgtagtacgtagaacgtttgtttacgacgttaagttttacttacgttacgtccaagtcgtaaagttaactaacgttaaccgtcggtacccgttacggggtaccttaccggacgaacgggactagggtagtaacgtacgaaacgtagtgtacgngtacgactaaccagtcttcgtcgttac

SEQ ID NO: 180974 - DNA, 767 bp, Homo sapiens
  misc_feature: GYAE6OF02JY109.34.38.D05.1.454.CMB.1.raw
  modified_base (175)..(175): a, c, t, g, unknown or other
  misc_feature (175)..(175): n is a, c, g, or t
  modified_base (188)..(188): a, c, t, g, unknown or other
  misc_feature (188)..(188): n is a, c, g, or t
  modified_base (212)..(212): a, c, t, g, unknown or other
  misc_feature (212)..(212): n is a, c, g, or t
  modified_base (443)..(443): a, c, t, g, unknown or other
  misc_feature (443)..(443): n is a, c, g, or t
tcagtacacgtgatcacgaccggtgctcgatttagtatctgatagttggggtttgggggagagaagagctgctcagttaggacccagagggaccatggaaacccagcgcagcttctcttcctcctgctactctggcctccagatcgccccggagtaattgtgttgacgcacgtcnccagaccaccgtntctctgtcgtaccggaaggggaanacgtaccctacccgtcttccgtcggacgacgggttcaacggttcacggtccgttaacgtaaccaccgttacgtttccgttacgaccgttacggtacgacgcgtaaacggaccgttaccgacgggcccgacgggtccctaccggaacgtcctacctcgtacttacggtttcggcgcctaccggaccgacgggcctagtcggactacgttacccgaaggaccgttagggtacncggtcgtacgtagggtcggtacgagggtacctagtacccttccgcttacccacgaacgtacctaggtacgtacgtacgtacgttacggacgtacggttaagtaacgttacgtttacgtacggttactttaacgttatttcgtaacgtaggacttactaaacgtacggtacgacggtaacctacgtggttacgggttacggtaccgggttaacggtaacggaaccgggttaaccggaaggtttaaccggaaaccgttaacggtaaaccggtaacgttcgggtaccgtacggtacgaccgttacgtacgttacgttacgttacccg

SEQ ID NO: 180975 - DNA, 515 bp, Homo sapiens
  misc_feature: GYAE6OF02JGVEU.34.38.D05.1.454.CMB.1.raw
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (472)..(472): a, c, t, g, unknown or other
  misc_feature (472)..(472): n is a, c, g, or t
  modified_base (474)..(515): a, c, t, g, unknown or other
  misc_feature (474)..(515): n is a, c, g, or t
tcagtacacgtgatcacgaccggtgctcgatttagtatctgatagttgggtttggggggaagaggaagactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctcgtggggccaagggacaatggtcaccgtctcttcagcctccaaccaagggcccatcggtccttcccccgtggcnccctgctccagganccaccgtccgagacgccaacacggtccgggacccctggggcctacggcccgttagggttccaaaacgggccttaccgtttcccaattccgaaccggtcgtaacctgggaaccgggtcccgggggtcttggggaacccgtaagggccgtacgaagtaccggngnnnnnnnnnnnnnnnnnnnnnnnnnnnnnnnnnnnnnnnnnn

SEQ ID NO: 180976 - DNA, 561 bp, Homo sapiens
  misc_feature: GYAE6OF02IY48N.34.38.D05.1.454.CMB.1.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (272)..(272): a, c, t, g, unknown or other
  misc_feature (272)..(272): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccaggggaaanagcccaccctntcctgcagggtcagtcagcgttctaacaccgtacttctcgcctggtaccagcagngaccctggccaggcctcccgaggctcctcattctttggtgccgtccaccgagggccactggccatcccgagactaggttcagtgcaggtgggtctagggacagtacttcactcacaccatcagacagactagagcctagaagtatttgacagttatattacgtgtacagactaatagtacgagacgactacgtggtcggtcgttcgggacgaacgggacgaaggtaaggaacgtaaccgaaacgtaacgtaggtacggtacgtacgaccaacctagtccgtagttaccg

SEQ ID NO: 180977 - DNA, 829 bp, Homo sapiens
  misc_feature: GYAE6OF02HN5AW.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaattgtgttgacgcagtcgccagacaccctgtctctgtctccgagggaagacgcccaccctctcctgcgacgggtcagtcagtcgttactaaccgccgtacttctcgcctcggtaccagcagacgaccgtcggaccacggcctcccgacggtccctccctactacgtttccgttttgggtaccggtcccggttaccccaacccggtaccggggtcccctaaccggttcgggaccctaacctccccgaacggtaccgttacgggttcgaacggttcggacgtagggttcggggttcggtacggggtaacacggtttaccttaccgtaccttcccgtaccgtaaccgtacttaccgacgtaccgtaacggttacgtttacggacgttccgtaaggtaacgtttcttttacggacttaagttacttttaacgtttacgttacgtaccgtaagtaaccttaaagttaccgtaacggtaaccggtaccgtaccttaccgggttcgggttaaccgggggttaccggtttacccgggaaacccgggttaaccggggtaacccgggttaaagggggttaaccggtaaaaaccgttaccgggtaaaaacccgttacgggtttcggtaaaccgggttccgtaccggaaccccgttaaacggttcgttaccgttaccggtttaccc

SEQ ID NO: 180978 - DNA, 895 bp, Homo sapiens
  misc_feature: GYAE6OF02JW7NE.34.38.D05.1.454.CMB.1.raw
  modified_base (209)..(209): a, c, t, g, unknown or other
  misc_feature (209)..(209): n is a, c, g, or t
  modified_base (340)..(340): a, c, t, g, unknown or other
  misc_feature (340)..(340): n is a, c, g, or t
  modified_base (354)..(354): a, c, t, g, unknown or other
  misc_feature (354)..(354): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgcccccggagaaattgtgttgacgcagtcgccagacaccctgtctctgtctccgaaggggaaancgccaccctctcctagccgagggtccagtcacgcgttaccaaccgacccgactttcgttccgccgttacggtaccaacgccaaaggaaacccgttcgggcccaacggtcccctaccccgaagtcccttccnctaacgtttaacgnggttacgacctaagtacccttaccggaccggggtccccctaggtacctaacctccccgtaaggaaccttagggttccaacggtcggctaacggggtcgggttccgtagggggaaccccaaggttacccgttttaccgccctttacccttaacccggacccctttaaagttcccgaaccccgaacgggttaacccgtacggggaaccggtaccccgttagggtaaagtttaccgtttttacgggaccgttacggtttacgttaacggtttacctttacgggttaaccgtaacggtttacggttacggtttaccctaacccgttaaccggtaaaaccgttccgggttacccgggttaacccgggtttcccggggtaaaccgggtaaaaccggggttaacccggaaacgggtttaaccgggtaaaaccgtaacccgggttaaaaccgtaccgggttaccggggttacgttaacggtacccgtaaccggtacccgttaacgtcccgtttagttacccgttaccgttaccgtccccgttaaccccg

SEQ ID NO: 180979 - DNA, 701 bp, Homo sapiens
  misc_feature: GYAE6OF02JR7PE.34.38.D05.1.454.CMB.1.raw
  modified_base (127)..(127): a, c, t, g, unknown or other
  misc_feature (127)..(127): n is a, c, g, or t
  modified_base (220)..(220): a, c, t, g, unknown or other
  misc_feature (220)..(220): n is a, c, g, or t
  modified_base (268)..(268): a, c, t, g, unknown or other
  misc_feature (268)..(268): n is a, c, g, or t
  modified_base (446)..(446): a, c, t, g, unknown or other
  misc_feature (446)..(446): n is a, c, g, or t
  modified_base (675)..(675): a, c, t, g, unknown or other
  misc_feature (675)..(675): n is a, c, g, or t
tcagtacacgtgatcacgaccggtgctcgatttagtatctgatagttgggtttggggagagaagagctgctcagttaggacccagagggaaccataggaaaccccagcgcagcttctcttcctcctnctactctgcctccagatcgccccggagaaattgtgttagacgcagtcgccagacaccctgtctctgtctaccgagggaagacgccaccctccnccgtgcgtacgggtcagtcacgcgttactaaccaccgtacttccgtcnccgtacggtaccagtcagtaacgccctgggaccacggccctccccgaggcccctccctagtacgttcgtttcggacgccgtaccaccgacgggccaatcggactaacccccgaggacctaggttccagggtcgacctagggtggtacgtggacacggttactccgactctacgtaacnctacgagccgtacgtactgaccgttaccggaagtaacgttagttttaccgacgtaacgtttaactttaagttccgttcggaccgtaaaggtccctaaagtaccgttacggacgtccgacttaacggtcgggttacggtcggttaaccgaacccgggtaagggtacccgtagggtacgaaaaccgttaccgtaaacggtaaccgttggttaacgaccggtacccggttanaccgtaacgttttcgtacggtttccc

SEQ ID NO: 180980 - DNA, 707 bp, Homo sapiens
  misc_feature: GYAE6OF02I8OBB.34.38.D05.1.454.CMB.1.raw
  modified_base (212)..(212): a, c, t, g, unknown or other
  misc_feature (212)..(212): n is a, c, g, or t
  modified_base (394)..(394): a, c, t, g, unknown or other
  misc_feature (394)..(394): n is a, c, g, or t
  modified_base (413)..(413): a, c, t, g, unknown or other
  misc_feature (413)..(413): n is a, c, g, or t
  modified_base (445)..(445): a, c, t, g, unknown or other
  misc_feature (445)..(445): n is a, c, g, or t
  modified_base (633)..(633): a, c, t, g, unknown or other
  misc_feature (633)..(633): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgcctactcctgggcctccgaagatcgcccccggagaaattgtgttgacgtcagtcgccagcaccctgtctctgtctccgagggaaanacgccacctctcctgccaggtcagttcagcgtttcgaaccaccgtcttctaccgctcggtaccagcacgagccgtagcctaacggcttccccgagggtccctcctcgtattcgtttcggtggcccttaaccgacccaggggcccaaccgttcggctaacctcccgatagacggtttcaaggnggcctaaggtcgggttacnggggacctagaccctttcactcctgaaacccngtcaggccctaagcctttagaccgacttacgaaagttcttacgtccgataacgtttaacgttctcgggtacttaacggctaaacttaccgtacgttaaccgagacccgtacgtttacgggttcggaaccggtttacccggaacccggaacgggacccggttaagggtaacgggaaacccggtttaaanaaaccccggggtaataaccgggttggtaacccgtcggaacctaacccggggactttaccggttcttaaccccgg

SEQ ID NO: 180981 - DNA, 745 bp, Homo sapiens
  misc_feature: GYAE6OF02F8ZO0.34.38.D05.1.454.CMB.1.raw
  modified_base (224)..(224): a, c, t, g, unknown or other
  misc_feature (224)..(224): n is a, c, g, or t
  modified_base (328)..(328): a, c, t, g, unknown or other
  misc_feature (328)..(328): n is a, c, g, or t
  modified_base (743)..(743): a, c, t, g, unknown or other
  misc_feature (743)..(743): n is a, c, g, or t
tcagtacacgtgatcacgaccggtgctcgatttagtatctgatagttgggtttgggggtccctgagactctcctgtgcagcctctggattcaccttcagtagtcactggatgcactgggtccgtcaagttccgagggaaggggctggtgtgggttcacgtattacgagtgatgggactgacacaatctacgcgactccgtgaaggccattccaccccctcaganacaacgccaagaacacactatatctgacaaatgaacagtctaggacgacgaccgaaggaccacggtctgtactattacgtgtcgactaaggacggtgacctaanaatctagtttggttttagattccgtacggtcggggaccaaagggtactaagtcggtacctaccggttctcgttacgacgtccctacccgaaccggtaaccgggcccctaacggttccccggtttacccgttacccccgtcgggtaccccgtccccgtcggtacccgtacccgacgggtacccgtacccgtaccccggtacccgaacggacgaccgaaccggacccggcccgggtaccccggtcgggtcccgttccggtacccggttaccgggtaccggttaaacccggtaccgtttacccgttaacccgtaaccgttaccgtaccggttaaccgttacgttaccgggacgggttccgggtaccggtacgggaaccggtaaccgggacgtaacccggtaacgtacggcgctacgancg

SEQ ID NO: 180982 - DNA, 675 bp, Homo sapiens
  misc_feature: GYAE6OF02HLDN0.34.38.D05.1.454.CMB.1.raw
  modified_base (207)..(207): a, c, t, g, unknown or other
  misc_feature (207)..(207): n is a, c, g, or t
  modified_base (304)..(304): a, c, t, g, unknown or other
  misc_feature (304)..(304): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (332)..(333): a, c, t, g, unknown or other
  misc_feature (332)..(333): n is a, c, g, or t
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (393)..(393): a, c, t, g, unknown or other
  misc_feature (393)..(393): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgccagacaccctgtctctgtctccgagggaaagngccacctctctagcagggtcagttcagtcgttacctaacaccgtacgtttcttccgccttaggtaccagcagagcctggccaggctccaggctccgnatctttggcncnccacgaggccactgcnncccagacnggttcaggtgacgnggtggtccgtagggacacgtcttcgactcacgtaaccntcagcagtcttagcgtacctagaagttagttttcgacgaaggttaattaacgtttacctaggttacgaacgtacggttaacttaacggttaccgaaacggtacccgtccgttaacggtttcggggttaccgggttacccgggtttaccggtaaccccggaaagggggacccgttaaacggggttaaccgggtaaaaccttaacgggtaaaaacccggtaacgttacgggtaaccgggtcttacgggaaaccctaccgtaaacgttccgttacgtttaccccg

SEQ ID NO: 180983 - DNA, 687 bp, Homo sapiens
  misc_feature: GYAE6OF02HOWDC.34.38.D05.1.454.CMB.1.raw
  modified_base (332)..(332): a, c, t, g, unknown or other
  misc_feature (332)..(332): n is a, c, g, or t
  modified_base (438)..(438): a, c, t, g, unknown or other
  misc_feature (438)..(438): n is a, c, g, or t
  modified_base (517)..(517): a, c, t, g, unknown or other
  misc_feature (517)..(517): n is a, c, g, or t
  modified_base (547)..(547): a, c, t, g, unknown or other
  misc_feature (547)..(547): n is a, c, g, or t
  modified_base (623)..(623): a, c, t, g, unknown or other
  misc_feature (623)..(623): n is a, c, g, or t
tcagtacacgtgatcacgaccggtgctcgatttagtatctgatagttgggtttggggagagaagagctgctcagttaggacccagagggaaccatgaaaccccagcgcagcttctcttcctcctgctactctggctcccagatcgaccccggagtaaattgtgttgacgcacgtcgaccagaccacccgtgtcctctagtcctaccgaaggggaaacgcgcccacccttctccgtagcgtaggtctacgtcacgtcgttacctaaccaccgtacttcgtccggaccttaggtaccagcgaacgtaacgccgtcgaccgacggtcctacccgngtccctcctacgtacttcgttcggtccgccgtacccgacggaccggacacgtggactactccgaagccgtagtcgcggtcggacgtgggttacggcgtacggaacngtaccttgtacctaccgtacgtaccagtacgaacgtaccggtaaacttcgttacggacgtacggttaagtaaacgtttnttaacgcgttaagttcttaaacgtcgttanagtaactactaagtacgtccggaagtccgtacgtggttaccggttcgggtagttaccgggaagtaacccggggtanaacggttaacgaaacgtacggtaagtacggttggaactcgaccgtatactcgttagtacctacg

SEQ ID NO: 180984 - DNA, 710 bp, Homo sapiens
  misc_feature: GYAE6OF02F98MN.34.38.D05.1.454.CMB.1.raw
  modified_base (205)..(205): a, c, t, g, unknown or other
  misc_feature (205)..(205): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgccccggagaaattgtgttgacgcagtcgccagacaccctgtctctgtctccgagggaagngccaccctctcctgcagggtcagtcagtcgttactaactaccgacttctcgcctaggtaccagcagacgtaccgtggccaggcctacccgaggtcctcctctattccgtttggtcgtaccggtaccaccgacggggccctacgtcgggaccaccgtccccgaagtaccgtaggtttaccgacggtgggtccgtagggtcggggttacgtagggtacacggtaccttctaaccgttcctacgaccctagtccagaccacgtacgttgaacgtccgttagtaacgttactttcgacgttaagttaattacgtttaacgtcgttaaccgagtaccgtaaagttacgttacgaaccgtaccgtaccgtacggtttaggtaccgggttccggttaaccggtaaccggaacggggtaccggtaaagggtaacgggaaaacgttaaccggaaaacggtacgttagggtacggtccgtaacggtccgtaacctcggtttaccgtcggtttacc

SEQ ID NO: 180985 - DNA, 651 bp, Homo sapiens
  misc_feature: GYAE6OF02GIF0A.34.38.D05.1.454.CMB.1.raw
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacaccctgtctctgtctccgagggaagagccaccctctcctgcgagggtcagtcagtcgttactaacaccgtacttctcgcctggtaccagccagacgaccgtggccaggccctccgaggtcctcctctacgttccgtttgggtcgccgtaccaccgacgggcccacgtcggacactcccgagacgtacggttcgaggtcgacgtaggtcggtacgagggacagtacttcactctacaccgtatccgacgtacgtacgacgttgacgtaccgtagaacgttacgtttcgacgttagttaattactttacttcgtactacgtactaagtacgtacgacgtacgcgtacgttgggtacgggtcggttaccgggaccggtaacgggaccggtaacgggtaacggtaaacgtaaccggaaacgtacgttacgggtacggtacgtccggtaccgtaacctacgttacgtcgtttaccg

SEQ ID NO: 180986 - DNA, 741 bp, Homo sapiens
  misc_feature: GYAE6OF02JH450.34.38.D05.1.454.CMB.1.raw
  modified_base (208)..(208): a, c, t, g, unknown or other
  misc_feature (208)..(208): n is a, c, g, or t
  modified_base (380)..(380): a, c, t, g, unknown or other
  misc_feature (380)..(380): n is a, c, g, or t
  modified_base (416)..(416): a, c, t, g, unknown or other
  misc_feature (416)..(416): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcccgccccggagaattgtgttgacgcagtcgccagacaccctgtctctgtcctaccgagggaaancgccaccctctccgtgcgacgggtcacgtcagtcgttactaacaccgtcttcgtcgcctaggtaccagcaggacgaccgtcgaccgacggtcctacccgaggcctccctacgtactccgtagtcggtctaccgactcccgaaccggacgggtcccctagttacgggttaccnccccggaggtaccgtacggttcgaaggtcggtacgnggttccgggttacgacggggaactacggtacgttaccgtaccgttacccgtctaaaccgtactaccgacggtacctcggttccgcgtactacggttactaggtaaacgtttgtttacgtcgtttattttaaccgttcgttacgttcgtaacgtaccgttaagttaaacgttaacggtacgttacccggacccgtttaccaacgttacccggttaaacccgtcggggtaaccgaccgggtactaaccgggtcccgtagggtaaacgttaaacggttaaccggtagttacggttacgtaccgttacgtacctacggttaccgttacg

SEQ ID NO: 180987 - DNA, 723 bp, Homo sapiens
  misc_feature: GYAE6OF02INFBJ.34.38.D05.1.454.CMB.1.raw
  modified_base (280)..(280): a, c, t, g, unknown or other
  misc_feature (280)..(280): n is a, c, g, or t
  modified_base (471)..(471): a, c, t, g, unknown or other
  misc_feature (471)..(471): n is a, c, g, or t
  modified_base (583)..(583): a, c, t, g, unknown or other
  misc_feature (583)..(583): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgcccccggagaaattgtgttgacgcagtccgccagaccaccctgtctctgctccgaagggaacacgcccacccgtctcctgcagggtcacgtcacgtcgttacaacaccgtacttcgttcgacctggtaacccngacgtacggacgaacccgttggacccgaaggtccctccccgaggtcctaccccgttactacgttccgtttcggtcggacctaccccgaccgtaccgggaccctacggttcggacctacctccccgaagtaccgtaacggtctaggtcggcgtacgggtggtcgtcgggactaacggtctcgacgtctaccncctatcgacgtacgagtccgttagccgtacgtgtaaacgttgttacgtacgtacgttaagtttacgttacgtacgtacgtacgacttaacgttcgtaacgacgtaaaccggntaccggtacgtacggggtaccggttaccggaccggaaaccggtacgaaacgggttacggaaacgttaccggaaaggttaacccgtaacggttgggtacctaccgacgtaaacccgtcgtttacccgttaggttaaccccg

SEQ ID NO: 180988 - DNA, 708 bp, Homo sapiens
  misc_feature: GYAE6OF02JNP14.34.38.D05.1.454.CMB.1.raw
  modified_base (211)..(211): a, c, t, g, unknown or other
  misc_feature (211)..(211): n is a, c, g, or t
  modified_base (226)..(226): a, c, t, g, unknown or other
  misc_feature (226)..(226): n is a, c, g, or t
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgatgcagtcgaccagaccaccctgtctctgtcctaccgaagggaaancgcccacctcgtccngacagggtccagtcacggtcttacctaccaccgtcttctcgccgtgtaccancgagtacgcctggcccaggcctccgagtcctccnattcgttggactcccgacaccggtagggtcacgtcggctacctaccccgaggaccgttaggtccgaaggttcgggacgtagggtttaccgggtcggacgggtaacaccggtttaccttccgtacgtaccccacgtaccgtacgtacaaccggaccgttaacggtaccgtacggaccgtaccgttaaggtaacgtttcgtttaacgtaccgttaagtttaaccgtttacgttacgtacgtaccgtacgtacctaacggttataccggtagaccggttactacggttcggtaccgggtcggttacgaaccggtaccgggtaacgtaacgggaacgtaaccgaaacgacggttaacgtcggttacggattacccggtacgtacctacggttaccttacg

SEQ ID NO: 180989 - DNA, 677 bp, Homo sapiens
  misc_feature: GYAE6OF02F92DA.34.38.D05.1.454.CMB.1.raw
tcagtacacgtgatcacgaccggtgctcgatttagtatctgatagttggggtttggggagagaagagctgctcagttaggacccagagggaaccatggaaaccccagcgcagcttctcttcctcctgctactctggcctcccagatcgcccccggagaaattgtgttgacgcagtcgccagacaccctgtctctgtctccgagggaagcgcccaccctctcctgccgagggtccagtcagtccgttctaacaccgtacttctcgcctaggtaccagacagacgacctcggccaggcctcccgaggtcctcctctattcgttggtcgtccgtcccaccgcgggccacgtcggactacctcccgaagaccgtagggttccaggtcggacgtacggttggggtccgtaggggacacgtaccttacgaccttcaccgacagtcagacagtactacggctaccgtagaagttacgtttcgacgtagttattacgtttacgtacgtacgaacgtactaacgtacgtacgacggacccgtacgtaccggttacgggttaccgggtaccggttaccgggaacccggtaacgggtaccggtaaacgggtacggtaaacgttaaccgaaaaccggtacgttaggtaccggtacgtacgaccgtaacctcgtttacgtccgtttaacc

SEQ ID NO: 180990 - DNA, 695 bp, Homo sapiens
  misc_feature: GYAE6OF02F0E50.34.38.D05.1.454.CMB.1.raw
  modified_base (212)..(212): a, c, t, g, unknown or other
  misc_feature (212)..(212): n is a, c, g, or t
  modified_base (274)..(274): a, c, t, g, unknown or other
  misc_feature (274)..(274): n is a, c, g, or t
  modified_base (343)..(343): a, c, t, g, unknown or other
  misc_feature (343)..(343): n is a, c, g, or t
  modified_base (435)..(435): a, c, t, g, unknown or other
  misc_feature (435)..(435): n is a, c, g, or t
  modified_base (580)..(580): a, c, t, g, unknown or other
  misc_feature (580)..(580): n is a, c, g, or t
  modified_base (616)..(616): a, c, t, g, unknown or other
  misc_feature (616)..(616): n is a, c, g, or t
tcagtacacgtgatcacgaccggtgctcgatttagtatctgatagttgggtttggggagagaagagctgctcagttaggacccagagggaccatgaaccccagcgcagcttctcttcctcctgcctactctggcctccagactcgcccccggagtaaagttgtgttgacgcagtcgcaagccaccctgtctctcgtctccgaggggaaagcnccctacctcgtcctcgacgagggtcagtcagtccgttactaaccaccgtactttccgttacncccgtacggtaccaggactagacgtaccgtcgggaccacgggccttccccgaacggtcctcccgttacncgtttacggttcggcgtaccgtaccctaccggacggtcccaaccgttgaccctactcccgtagaacgtaacgggttcaacggtcggtaccgnggggttacggtccgtaagggcctaacgccgttactcttacccggccaaacgtctaacgtagacgtaacgtacgttcggaacgtacgttaacggtaacgttacgtttacgtcgtaaagttacttacgttactacgtaccgtagtanaacgttaacgagtaacgtacgactagtcgttacggngttacggacgaaggtacgtacggtaaggtaactaacgaacgtactaggttccgagtactaccgacctacacgttactcg

SEQ ID NO: 180991 - DNA, 791 bp, Homo sapiens
  misc_feature: GYAE6OF02H17G6.34.38.D05.1.454.CMB.1.raw
  modified_base (183)..(183): a, c, t, g, unknown or other
  misc_feature (183)..(183): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggcctcccagatcgccccggagaaattgtgttgacgcagtcgccagaccncctgtctctgtctccgagggaaagcgccacctctcctgcgagggtcagtcagcgttactaacaccgtcttcttcgcctaggtaccagcaagacgaccgtcggaccaggcctcccgaggtcccttcctaccgtatttcgttttgggtcgtacccgttacccgaacccggccgggtccccccgtagggacctaccgtacccgaaggtaccgtacgggtttaccaggtcggtcggtagggttcgggtaccgtagggggaactacggtaccctttccacgttaccctacctaacgaaccgttacccgaacctaacgggtaccgtacgggtaccggtactaacggttaaacgtttagtttaccggacgttaacgggtttatttaaacgtttacgtaacggttaacgaaccgtttacggttacgtaccgttacaacccgtaacgtaccggttacgggttaacccgggtaccggtaaccggtaaacgggtaaacccgtaaggggtaaacctaaacgttaacccgaaacgggtaacgttaaggtacgggtaccctacggtaccctaacgttcgttacgttaccggttacctttaccgtccgttaccccttacccgg

SEQ ID NO: 180992 - DNA, 760 bp, Homo sapiens
  misc_feature: GYAE6OF02JZDIU.34.38.D05.1.454.CMB.1.raw
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
tcagtacacgtgatcacgaccggtgctcgatttagtatctgatagttgggtttggggggtccctgagactctcctgtgcagcctctggattcaccttcagtagtcactggatgcactgggtcctacaacgttccagggaaggggctggtggtggtttacacgtattacgagtgagtgggtatgacacaattcacgcggtactccgtagacgggcgtatccacccctcagacacacgccaagtacacacgtatatctagnaaactgtaacngtctaggagacggtaccagggtaccacggtcctaggttccttagttacctgtagacaaggtacggtcgtactaccaagtaccgtaagttttccgtttaggtattcctggacggggtaccgaaagggaaccctaaggtcgttcgaccggtactttccacgactccccgtaaccgaccggtaaaccgggtcctaaagggttccccgtttacccgtttccccgaccgggtaccgtccccgtacggtccgttacgacccgggtaaccgtcccgtaaacccgtccgggtaacaccgaaccgtaaccgccgggtacccgtcccggaccgggtttaccggccggtacccgtaccgggtagaaacccggtttacccttaaacgttaacccgccgtttaacgtaccgtttaccggggacttaccgggaaccgggttcgggaaccgttccgggaacccggaagggtttaacccccgggacgtaacgtgacgacgagcacg

SEQ ID NO: 180993 - DNA, 349 bp, Homo sapiens
  misc_feature: GYAE6OF02HWVNA.34.38.D05.1.454.CMB.1.raw
  modified_base (277)..(277): a, c, t, g, unknown or other
  misc_feature (277)..(277): n is a, c, g, or t
  modified_base (302)..(303): a, c, t, g, unknown or other
  misc_feature (302)..(303): n is a, c, g, or t
  modified_base (305)..(349): a, c, t, g, unknown or other
  misc_feature (305)..(349): n is a, c, g, or t
tcagtacacgtgatcacgaccggtgctcgatttagtatctgataggttgggtctgggacagacttcactctcaccatcagcagacttgagcctgaagtattttgcagtaatattacctgtcagcaatatcgagacgcactggtgggtcgttcggaccgaaagggaccgaaagggtggaaaatccgaaaaacgactggtcggactgaccaccattctcgttcttcacgttccttcccgctaatcgtataactcgtacgtcgtacgtggaggtccgggntacgggacgaacggccgtaacatgnngnnnnnnnnnnnnnnnnnnnnnnnnnnnnnnnnnnnnnnnnnnnnn

SEQ ID NO: 180994 - DNA, 740 bp, Homo sapiens
  misc_feature: GYAE6OF02JSFLI.34.38.D05.1.454.CMB.1.raw
  modified_base (118)..(118): a, c, t, g, unknown or other
  misc_feature (118)..(118): n is a, c, g, or t
  modified_base (148)..(148): a, c, t, g, unknown or other
  misc_feature (148)..(148): n is a, c, g, or t
  modified_base (334)..(334): a, c, t, g, unknown or other
  misc_feature (334)..(334): n is a, c, g, or t
  modified_base (465)..(465): a, c, t, g, unknown or other
  misc_feature (465)..(465): n is a, c, g, or t
  modified_base (498)..(498): a, c, t, g, unknown or other
  misc_feature (498)..(498): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
tcagtacacgtgatcacgaccggtgctcgatttagtatctgatagttgggtttggggagagaagagctgctcagttaggacccagagggaaccatcggaaaccccagcgcagctttcnccttcctcctgcctactctggcctcccagntcgccccggagaattgtgttcgaacgtcgagtcgaccagacctaccctgtccttctagttccgaccgtaaagggggaaactcgaccctccctctcccgtgccgtaacgggtcaacgtccgagtccgttacctaaaccgcccctagttcccgttcggccctttacggtaaccacggacctaggaacnccccggtttaaggccccgaacgccgttccccgaagggtcccctccttacgaactttcggtttcggtaacgtccgtccccgaaacggtccggcctcggtaaggtccactaccggaagttccgacgggtttcngtacggtctacgggttcgaagggtggaaacccnggttacctacnccgttcacaaccgttnccgtacgctaacgtacgttgaccgtccgttagtacgttattcgtacgtaagttacttaacgttacgtacgtacgagtaacgtaactaacgtccgagtacctacgtacgtcgtggtaccgtcgtaaccgtagggtaacgtacggtacgtaaccgaacggttaaccgtacggttggacgtacggtttaccacggtaccgtacttcgtaccggtttac

SEQ ID NO: 180995 - DNA, 840 bp, Homo sapiens
  misc_feature: GYAE6OF02GKYGE.34.38.D05.1.454.CMB.1.raw
  modified_base (206)..(206): a, c, t, g, unknown or other
  misc_feature (206)..(206): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatgcccccggagaaattgtgttgacgcagtcgacagacacctgtctctgtctccgagggaaagngcccaccctctcctgcgtacgggtcacgtcagtcgttacctaacaccgtacttccgttcgcctggtaaccagcaaggtacgaccgtgggccaacggtccctacccgacgggtcccttaccctcctagtttcgtttcgggtcgtccggttcccgaacccggacggggtccctaacggtcggacctaaccgtaccccgaaggaccgttacgggttccgaagggttcgggtacgtacggggttcggggtacggtacggggaacctaacggttaccttaccgaaccgtttccctacccgtaaaccgtaacttacgacgtaaccgtaacggttaacgttacggtaaccggtaccgttaaggtaaacggtttaacgtttttaccggaacgtttaaacggtttaacttaacgtttaacggtttaccgttaacgtaaaccgtaacgttaaacgttacgtaccggtaaccggtaccgtaaccggttacgggttacgggttacgggtaccggtttaccgggaaccgggaaccgggtaacggtaacgggtaacggtaaaccggtaaacgtaaaccgggtaacgttcgggtaacggtaccggttacggaacccgttaaccgtacgttacccggttactttacccgg

SEQ ID NO: 180996 - DNA, 785 bp, Homo sapiens
  misc_feature: GYAE6OF02JJZHX.34.38.D05.1.454.CMB.1.raw
  modified_base (321)..(321): a, c, t, g, unknown or other
  misc_feature (321)..(321): n is a, c, g, or t
tcagtacacgtgatcacgaccggtgctcgatttagtatctgatagttgggtttggggagagaagagctgctcagttaggacccagagggaaccatgggaaaccccagcgcagcttctcttcctcctgctactctggctcccagatgtccacggagaaattgtgttgacgcagtcgccagacaccctgtctctgtctccgaagggaaacgacgcccaccctctcctgctagggtcagtcagtcgttactaacgaccgtcttaccgtccgtccttcggtaccagcagacgaccgttggaccagcctaccgaggtccctacctntaccttgtttcggtcgccgttaccgaccggacgggtccacgtacggctaccgtccgaaggtacctaggtcctaggcggtacgtacggttgggtacctacgggactaccggtaccttacgaccgtacttaccgaccgtattacgacgtaccgaacgttaaccgttagaaccggtccgttaaacggtaaagtttaccgttttgtaaaccgggttacgttttaaatttaccgtttaacggttacgttaacgtaccggttaaacgtttaaaccttaacggtttacgggaacgtaacccggttaccgtaacgggtttccggggttaccgggtaaccgtttaaccggggtacccgaaccggggttaacggtaaccgggttaacggaaaacgttacccggtaaaacgggtaccgttacgggttaaccggtacgttaaccgtaacccgtaccgtacgtttacgttaacccgg

SEQ ID NO: 180997 - DNA, 777 bp, Homo sapiens
  misc_feature: GYAE6OF02G64Z9.34.38.D05.1.454.CMB.1.raw
  modified_base (232)..(232): a, c, t, g, unknown or other
  misc_feature (232)..(232): n is a, c, g, or t
tcagtacacgtgatcacgaccggtgctcgatttagtatctgatagttgggtttggggagagaagagctgctcagttaggacccagaggaaccatggaaacccagcgcagcttctcttcctcctgcgtactctggctcccagactcgcccccggagaaattcgtcgttgacgcgagtccgccgagaccacccgtgtcctctgtcctaccgagggaaagacgccaccgtcctcngtcgtaggtcacgtcgagtccgttacaaccgtaccgtacgttccttcgaccgtcggtaaccacgacgaacgaccgtaaccgtcggaccgacggtcctcccgaggtcctaccttcgtacgttcgtttacggtccggtacccgttacccgaaccggtcgggacccctacggtacggcctacgtacccgaggtaccgtaggttcgacggtcggactaggttgggtcgtacggacgacgttacctcgaccgttcgtacctacctacgtcgacgtccgtaacgtccgttaggaccgtaccgttaaggtaaacgtttacgtttacgacgttaacggttaactttaacgtttcgtacggttcgtaacgtacgtaaacgttacggtacgtaaccggtaccgtaacgtacgggttacgggttaccgggtacccgttacgggaaccggtaaccgggtaaccgtaacggggtaagtaaacccgtaaccggtaaacgttacggtacccggttacggaccttccgaaccgtaacccgtcggtttacgtaccgttaccg

SEQ ID NO: 180998 - DNA, 749 bp, Homo sapiens
  misc_feature: GYAE6OF02IFW5M.34.38.D05.1.454.CMB.1.raw
  modified_base (170)..(170): a, c, t, g, unknown or other
  misc_feature (170)..(170): n is a, c, g, or t
  modified_base (601)..(601): a, c, t, g, unknown or other
  misc_feature (601)..(601): n is a, c, g, or t
tcagtacacgtgatcacgaccggtgctcgatttagtatctgatagttgggtttggggagagaagagctgctcagttaggaccagagggaaccatggaaaccccagcgcagcttctcttcctcctgctactctggctacccagatcgccccggaagtaattgtgttgacgnacgtcgacagaccacctgtctctgtctccgagggaagcgaccaccctctctcgacgtcggtcagtcaggtccgttactaaccgaccgttacttccttccggcccttagggtacccacgcgaacggacgtacccgtggaccgacggcccgttccccgagtcccttcctacctacgttccgtttcggtaccgtcctacccggaccggacggccacgttcgggacctacaccccgaaggtaccgtcggttacgacggtcgggacttacggggtacgggttacgtacgggaactacgttaccgtcacctttcgacccgtaacacgttcgacggactaacggtcctaggacgtacgttagtaacgttcgtttagtactaagttacgttttatccgtagtactacgtaactagtaccggtaggtaacgcgttaccgnggtttccgggacgggtttcggtaaccgaccgggggtaacgaacggttaccggggttaaagtaaacccggaaacggttaaaccggtggttaccggttaacgttaccgggtaccgtacccgttagtacccggttcggttacccgtttccc

SEQ ID NO: 180999 - DNA, 716 bp, Homo sapiens
  misc_feature: GYAE6OF02GGDTR.34.38.D05.1.454.CMB.1.raw
  modified_base (276)..(276): a, c, t, g, unknown or other
  misc_feature (276)..(276): n is a, c, g, or t
  modified_base (315)..(315): a, c, t, g, unknown or other
  misc_feature (315)..(315): n is a, c, g, or t
  modified_base (570)..(570): a, c, t, g, unknown or other
  misc_feature (570)..(570): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggactcccagatcgccccggagaaattgtgttgacgcagtcgccagacaccctgtctctgtctaccgagggaaagcgccaccctctcctgcgagggtcagtcagtccgttacaaccgaccgtacttcctcgcgtacggtaccngcagacgcgtgccaggcctcccgaggtccttacctaccngtttcgttcggcgtacccgtacccgaccgtcgggtaccacgttggcctaccgtacccgagtaccgtacgggttcacggtcggacgttagggtacgggttaccggtagggtaacctacggttacctttaccgtcctttacctaacccgtaacctacgttaccgacggtaccgtacgtttaccgttacggaaccgttaccgttaacgtaaggttacgttttacgacgttaagtttaattaacgttacgttacgttanaacgttacgtaactacggtacgacggtaccgtgtaccgttgggtccggtaccggttaccggaccgtaaggcgttaagggtacgtaaacgtaaccggtaaacgtacggtacgtacggacgtcgtacctacgtacgttctagtttacc

SEQ ID NO: 181000 - DNA, 892 bp, Homo sapiens
  misc_feature: GYAE6OF02G2QHQ.34.38.D05.1.454.CMB.1.raw
  modified_base (246)..(246): a, c, t, g, unknown or other
  misc_feature (246)..(246): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctcccagatcgccccggagaaattgtgttgacgcagtcgccagacaccctgtctctgtctccgagggaagagcccaccctctcctgcgagggtcagtcagcgttctaaccnccgtacttcgtcgcctggtaccagcagacgacctggaccaggccctcccgaggtcctcccgtactacttccggtttaggtcgtacccgtacccgaaccggacggggtcccacgttagggacctaccgttaccccgaaggtaccgtacggttaccgaaggtcggacgtacggtttcggggggtactacgggggtacctaacggtacctttaccgtaaacccgttaccgtaccgtaaacccgtacttaccgtaacggaccctaaaccggttaccgttttaacggaaccggtacccgttaaacgggtaaacggtttaggtttttaaccggaccgttaaacggtttaactttaaaccgttttaaccggtttaccgttaaccgtaacgtttaaccgtaaaacgtttaacccggttacggtaaaccggttaaccccgggtacgtttaaacggggttacgggtttacccgggggttaacccggtttacccggggaaacccgggttaaaccgggggtaacccgggttaaaggggtttaaccgggtaaaacgttaaacccggtaaaaccgggttaacggttacgggtaaccgggttaacccgtacgggtaacccgttaacccggttaacgtttaccggttaaccgttttaccccg

SEQ ID NO: 181001 - DNA, 803 bp, Homo sapiens
  misc_feature: GYAE6OF02GLBQQ.34.38.D05.1.454.CMB.1.raw
  modified_base (412)..(412): a, c, t, g, unknown or other
  misc_feature (412)..(412): n is a, c, g, or t
tcagtacacgtgatcacgaccggtgctcgatttagtatctgatagttgggtttggggagagaagagctgctcagttaggacccagagggaaccatggaaaccccagcgcagcttctcttcctcctgctactctggctccagatcgccccggagtaattgtgttgacgcgagtcgccagaccaccctgtctctcgtctaccgagggaaacgacgccacctctccgtagcgaggtcagtcacgtacgttactaaccgaccgtacttccgttaccgccgttacggttaaccgagtccgaagtacgtaccgtcggccgacggtccctacccgaggtcctcctactactttcgtttaggtcgaccgtcccaacggaccggtccacgtcggacctacgtacccgagtacgtcgggtancggtacggcgtagggtcggtcgtacgggtaactacgtccgttacaccgttaccgtacaacccgtacgaccgtaacgtacctaaacggttaccgtttcgggaacccgttacccgttaaagggtaaacttttccgggtttaacgaaccgtttaacggtttaacgtttaaactttaccggtcgtaaccgtacggtaaaccttaaagttaccgtaacggtaccgaaccggttaccggtacgtttacgggggaccgggttacccgttaaccggggaaaccgggtaaccgggtaacgggttacgggaaaccgttaaacggtaacccggtaaacggttaacgtttcgggcggtaaccctcggaaacccgtacgttacgtaccggttttactaccccgg

SEQ ID NO: 181002 - DNA, 181 bp, Homo sapiens
  misc_feature: GYAE6OF01CER2T.38.26.C04.1.454.CMB.1.raw
  modified_base (173)..(181): a, c, t, g, unknown or other
  misc_feature (173)..(181): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnnnnnnn

SEQ ID NO: 181003 - DNA, 172 bp, Homo sapiens
  misc_feature: GYAE6OF01EH6UH.38.26.C04.1.454.CMB.1.raw
  modified_base (171)..(172): a, c, t, g, unknown or other
  misc_feature (171)..(172): n is a, c, g, or t
tcagtcgatcacgtcacgaccggtgctcgatttagtctagcgactttgggtttggggaagaggaagactgacggtccccaggagttcaggtgctgggcacagcggccctgggctgcctggtcaaggactacttccacgtgatcgactgagcgggctggcaaggcgcatagnn

SEQ ID NO: 181004 - DNA, 186 bp, Homo sapiens
  misc_feature: GYAE6OF01AJART.38.26.C04.1.454.CMB.1.raw
  modified_base (171)..(186): a, c, t, g, unknown or other
  misc_feature (171)..(186): n is a, c, g, or t
tcagtcgatcacgtcacgaccggtgctcgatttagtctagcgactttgggttgggggaagaggaagactgacggtccccaggagttcaggtgctgggcacagcggccctgggctgcctggtcaaggactacttccacgtgatcgactgagcgggctggcaaggcgcatagnnnnnnnnnnnnnnnn

SEQ ID NO: 181005 - DNA, 174 bp, Homo sapiens
  misc_feature: GYAE6OF01C4W8E.38.26.C04.1.454.CMB.1.raw
  modified_base (173)..(174): a, c, t, g, unknown or other
  misc_feature (173)..(174): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnn

SEQ ID NO: 181006 - DNA, 173 bp, Homo sapiens
  misc_feature: GYAE6OF01AP54M.38.26.C04.1.454.CMB.1.raw
  modified_base (173)..(173): a, c, t, g, unknown or other
  misc_feature (173)..(173): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagn

SEQ ID NO: 181007 - DNA, 174 bp, Homo sapiens; identical to SEQ ID NO: 181005
  misc_feature: GYAE6OF01B9R7B.38.26.C04.1.454.CMB.1.raw
  modified_base (173)..(174): a, c, t, g, unknown or other
  misc_feature (173)..(174): n is a, c, g, or t

SEQ ID NO: 181008 - DNA, 210 bp, Homo sapiens
  misc_feature: GYAE6OF01AVOGX.38.26.C04.1.454.CMB.1.raw
  modified_base (174)..(210): a, c, t, g, unknown or other
  misc_feature (174)..(210): n is a, c, g, or t
tcagtcgatcacgtcacgaccggtgctcgatttagtctagcgactttgggtttgggggaagaggaagactgactgtcccccaggagttcaggtgctgggcacagcggccctgggctgcctggtcaaggactacttccacgtgatcgactgagcgggctggcaaggtcgcatagnnnnnnnnnnnnnnnnnnnnnnnnnnnnnnnnnnnnn

SEQ ID NO: 181009 - DNA, 505 bp, Homo sapiens
  misc_feature: GYAE6OF01EI3VR.38.26.C04.1.454.CMB.1.raw
  modified_base (478)..(478): a, c, t, g, unknown or other
  misc_feature (478)..(478): n is a, c, g, or t
  modified_base (501)..(501): a, c, t, g, unknown or other
  misc_feature (501)..(501): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggagcctgaagattttgcagtgtattactgtcagcagtatggtaactcaccattcactttcggccctggaccaaagtgatatcaaagaactgtggctgcaccatctgtcttcntcttcccgcctatctgaacgtgntacg

SEQ ID NO: 181010 - DNA, 173 bp, Homo sapiens; identical to SEQ ID NO: 181006
  misc_feature: GYAE6OF01ACMF0.38.26.C04.1.454.CMB.1.raw
  modified_base (173)..(173): a, c, t, g, unknown or other
  misc_feature (173)..(173): n is a, c, g, or t

SEQ ID NO: 181011 - DNA, 175 bp, Homo sapiens
  misc_feature: GYAE6OF01C5P0J.38.26.C04.1.454.CMB.1.raw
  modified_base (173)..(175): a, c, t, g, unknown or other
  misc_feature (173)..(175): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnn

SEQ ID NO: 181012 - DNA, 189 bp, Homo sapiens
  misc_feature: GYAE6OF01CPAO0.38.26.C04.1.454.CMB.1.raw
  modified_base (174)..(189): a, c, t, g, unknown or other
  misc_feature (174)..(189): n is a, c, g, or t
tcagtcgatcacgtcacgaccggtgctcgatttagtctagcgactttgggtttggggggaagaggaagactgacggtcccccaggagttcaggtgctgggcacagcggccctgggctgcctggtcaaggactacttccacgtgatcgactgagcgggctggcaaggcgcatagnnnnnnnnnnnnnnnn

SEQ ID NO: 181013 - DNA, 173 bp, Homo sapiens; identical to SEQ ID NO: 181006
  misc_feature: GYAE6OF01DMPD0.38.26.C04.1.454.CMB.1.raw
  modified_base (173)..(173): a, c, t, g, unknown or other
  misc_feature (173)..(173): n is a, c, g, or t

SEQ ID NO: 181014 - DNA, 501 bp, Homo sapiens
  misc_feature: GYAE6OF01BW200.38.26.C04.1.454.CMB.1.raw
  modified_base (498)..(498): a, c, t, g, unknown or other
  misc_feature (498)..(498): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctaggccacggctcccacggctcctcatctacggtgcatccacgcagggccactggcatcccagacaggttcagtggcagtgggtctgggaaagacttcactctctccatcagacagactggagcctgaagtattttgcagtgttatactgtcagcagttatggtaactcacctattcacttcggcctaggacaagtgatatacaaacgatgtgntcg

SEQ ID NO: 181015 - DNA, 176 bp, Homo sapiens
  misc_feature: GYAE6OF01B4H9Z.38.26.C04.1.454.CMB.1.raw
  modified_base (173)..(176): a, c, t, g, unknown or other
  misc_feature (173)..(176): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnn

SEQ ID NO: 181016 - DNA, 524 bp, Homo sapiens
  misc_feature: GYAE6OF01BROZ6.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactgggagcctgaagtattttgctagtgtattactgtcagcagtatggtaactcaccattctactttcggcccttgggaacctaaggtgatatacaaacgtaactgtgctgccaccatcgtgtcttctatccttccccgctactcctagacgtgacgtaccg

SEQ ID NO: 181017 - DNA, 175 bp, Homo sapiens; identical to SEQ ID NO: 181011
  misc_feature: GYAE6OF01BG82P.38.26.C04.1.454.CMB.1.raw
  modified_base (173)..(175): a, c, t, g, unknown or other
  misc_feature (173)..(175): n is a, c, g, or t

SEQ ID NO: 181018 - DNA, 558 bp, Homo sapiens
  misc_feature: GYAE6OF01D16U6.38.26.C04.1.454.CMB.1.raw
  modified_base (216)..(216): a, c, t, g, unknown or other
  misc_feature (216)..(216): n is a, c, g, or t
  modified_base (317)..(317): a, c, t, g, unknown or other
  misc_feature (317)..(317): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtctttgtctccgaaggggaaancgccaccctctcctgcagggccagtcagagtcttagcagcagctacttagcctggtaccagcaagaacctggccaggctccaggcctcctcatctacggtncatccagcagggccagtggcatccagacaggtcaggtgcaggtggtctagggaaatcttacactctctcatcagcagactggacgcctagtaagtatttgactagtgtattacgtgtacagtactaagttatacggtaactaccgtacctatttaccgtacgttttccggacccgttagggaaaccctaaaggttacggtaacttaacgtaaccgaaaacgtacgtcggtacggcgtacgg

SEQ ID NO: 181019 - DNA, 500 bp, Homo sapiens
  misc_feature: GYAE6OF01COOU5.38.26.C04.1.454.CMB.1.raw
  modified_base (337)..(337): a, c, t, g, unknown or other
  misc_feature (337)..(337): n is a, c, g, or t
  modified_base (341)..(341): a, c, t, g, unknown or other
  misc_feature (341)..(341): n is a, c, g, or t
  modified_base (364)..(364): a, c, t, g, unknown or other
  misc_feature (364)..(364): n is a, c, g, or t
  modified_base (373)..(373): a, c, t, g, unknown or other
  misc_feature (373)..(373): n is a, c, g, or t
  modified_base (455)..(455): a, c, t, g, unknown or other
  misc_feature (455)..(455): n is a, c, g, or t
  modified_base (476)..(476): a, c, t, g, unknown or other
  misc_feature (476)..(476): n is a, c, g, or t
  modified_base (497)..(497): a, c, t, g, unknown or other
  misc_feature (497)..(497): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccatggcatcccagacaggttcagtgcagtgggtctgggaaancttnactctctcatcagcagactggancctgaagtntttgcagtgtattactgtcagcagtatggtaactcactattctactttcgcctagggacctaagtgactatcaaacgactgngctgcacctatcgtgtcttcnttcctccgctatcagaactgntcg

SEQ ID NO: 181020 - DNA, 504 bp, Homo sapiens
  misc_feature: GYAE6OF01CYFTH.38.26.C04.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaangccaccctntcctgccagggccagtcagagtctagcagcagctacttagcctggaccagcagaacctggcaggctcccgaggctccnatctacggtncatccagcagggccatggcatcccagcaggttcagtgctagtgggtctaggggaaacncttcactctctccatcagcagacgtaggacgccgtagaagtattttgctagtgttattactgtctagcagtatggtactcactatctacttcggccgtaggactaaggtgtaatactacaaacgaatgtgctacg

SEQ ID NO: 181021 - DNA, 497 bp, Homo sapiens
  misc_feature: GYAE6OF01AVRF9.38.26.C04.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtcttagcagcagctacttagcctggtaccagcagaaacctggccaggctcccaggctcctcatctacggtncatccagcagggccatcggcatcccagacaggttcagtggcaggtgggtctggggaaancttcactctctcatcagcagactggagcctgaagtattttgctagtgtattactgtcagtctagtatgtactcacattcacttcggcctgggaccaagtgatagtacaaacgaatgtgtctag

SEQ ID NO: 181022 - DNA, 584 bp, Homo sapiens
  misc_feature: GYAE6OF01CVBC8.38.26.C04.1.454.CMB.1.raw
  modified_base (185)..(185): a, c, t, g, unknown or other
  misc_feature (185)..(185): n is a, c, g, or t
tcagtcgatcacgtcacgaccggtgctcgatttagtctagcgactttgggtttgggggaagacaatgggtttgatttagattacatgggtgacttttctgttttaatttccaatctacagataccaccggagaaattgtgttgacgcagtctccaggcaccctgtctttgtctccagggggaaanagccaccctctcctgcagggccagtcagagtcttagcagcagctactagcctggtaccagcagaacctggccaggctccaggctcctcatctacggtgcatccagcagggccacgtgggcactcccagacaggttcagtggctaggtcgggtctagggaaacgtccttcacctctcctccatcagcagactggacgcctaggaacgtattttagctaagtacgttattacgtgtacagtctaagttatggtaactcacctagttctacgtttccggcccttagggaacctaaaggtcgtaacgtactacgaaacgtacttagtggtactggaccacctatccttcgtccttacacttcccttaccccgacttactcgttagtaaccgtgtacgtaccgg

SEQ ID NO: 181023 - DNA, 509 bp, Homo sapiens
  misc_feature: GYAE6OF01BY963.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccactggcatcccagacaggttcagtggcagtgggtctgggaaagacttcactctctccatcagcagactggagcctgaagattttgcagtgtattactgtcagcagtatggtactcaccattcactttcggcctgggaccaagtggatatacaaacgtaacgtgtagctgcaccatcgtgtctcatcctcccgcctactctagacgtgataccg

SEQ ID NO: 181024 - DNA, 595 bp, Homo sapiens
  misc_feature: GYAE6OF01EJ1FT.38.26.C04.1.454.CMB.1.raw
  modified_base (216)..(216): a, c, t, g, unknown or other
  misc_feature (216)..(216): n is a, c, g, or t
  modified_base (320)..(320): a, c, t, g, unknown or other
  misc_feature (320)..(320): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtcttagcagcagctacttagcctggtaccagcagaaacctggccaggcctcccgaggcctcctcatcgtacggtncatccagcgacgggccacgtggccactcccgaagaccgtagggtttccaggttcggctagggttcgggtacgtaggggaaactccttcacttcgtcctcactcagcagtacgtggacgtccgtagtaagttagtttgctagtagttacttacgtagtacagtacgtagttattacggtaactccgtaactacttaccgtaccgtttccggacccgttagggaacctaaagggtacgtaattacgtaaccgaaaccgtaagtcggtggtccgtacg

SEQ ID NO: 181025 - DNA, 503 bp, Homo sapiens
  misc_feature: GYAE6OF01CNBJU.38.26.C04.1.454.CMB.1.raw
  modified_base (497)..(497): a, c, t, g, unknown or other
  misc_feature (497)..(497): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccactggcatcccagacaggtcagtggcagtgggtctgggaaagcttcactctctccatcagcagactggagcctgaagtattttgctagtgtattactgtcagcagtatggtactcacatctacttcgcctgggacaagtgatatacaacgactgtgctgcacatcgtgtcttctctccttcccgacctatctagacgtgtntaccgg

SEQ ID NO: 181026 - DNA, 508 bp, Homo sapiens
  misc_feature: GYAE6OF01E1VX9.38.26.C04.1.454.CMB.1.raw
  modified_base (481)..(481): a, c, t, g, unknown or other
  misc_feature (481)..(481): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggagcctgaagattttgcagtgtattactgtcagcagtatggtaactcaccattcactttcggccctgggaccaaagtgatatacaaacgaactgtggctgcaccatctgtcttcnctcttcccgcctatctgacgtgatccg

SEQ ID NO: 181027 - DNA, 543 bp, Homo sapiens
  misc_feature: GYAE6OF01DD7R3.38.26.C04.1.454.CMB.1.raw
  modified_base (216)..(216): a, c, t, g, unknown or other
  misc_feature (216)..(216): n is a, c, g, or t
  modified_base (463)..(463): a, c, t, g, unknown or other
  misc_feature (463)..(463): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtcctcaggcaccctgtctttgtctccgaggggaaancgcccaccctctcctgcaggccagtccagagtcttagcagcagctacttagcctggtaccagcaagaaaccgtggccagggcctcccgaggcctcctcatctacggtgcatccagcagggccactgcatcccagacaggttcagtggactaggtgggtctaagggaaacgacttcgacttctccgtaccatcgagctaaggacgttaggacgcctagtaagtattttgctagtgtattaactgtacngctagtatagtactactactacttctacgtttcgccgtaggaacctaaggtcgtataacgtacaaacgatggtgtctacg

SEQ ID NO: 181028 - DNA, 513 bp, Homo sapiens
  misc_feature: GYAE6OF01BQ4T2.38.26.C04.1.454.CMB.1.raw
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
  modified_base (370)..(370): a, c, t, g, unknown or other
  misc_feature (370)..(370): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtcttagcagcagctacttagcctggtaccagcagaacctggccaggctccaggctctcatctacggtncatccagcagggccatggcatcccagacaggttcaggtggcaggtgggtcagggaaancttcactctctccatcagcagacgtggacgccgtagaagtagttttgctagtgtattacgtgtcagtctagtataggtactcgtactattactacgttccggccgtaggaccaaggtcgatacgtacaacgatcgtggcgtcg

SEQ ID NO: 181029 - DNA, 512 bp, Homo sapiens
  misc_feature: GYAE6OF01ERSMJ.38.26.C04.1.454.CMB.1.raw
  modified_base (462)..(462): a, c, t, g, unknown or other
  misc_feature (462)..(462): n is a, c, g, or t
  modified_base (483)..(483): a, c, t, g, unknown or other
  misc_feature (483)..(483): n is a, c, g, or t
  modified_base (508)..(508): a, c, t, g, unknown or other
  misc_feature (508)..(508): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagcttcactctctccatcagcagactggacgcctagaagtatttgctagtgttattactgtcagcagtatggtaactcacctattctacttcgccctgggaccaagtgatatacaaacgactgngctgcaccatcgtgtcttacnctccttcccgctactctagacgtgngtcg

SEQ ID NO: 181030 - DNA, 501 bp, Homo sapiens
  misc_feature: GYAE6OF01BZ2RB.38.26.C04.1.454.CMB.1.raw
  modified_base (214)..(214): a, c, t, g, unknown or other
  misc_feature (214)..(214): n is a, c, g, or t
  modified_base (313)..(313): a, c, t, g, unknown or other
  misc_feature (313)..(313): n is a, c, g, or t
  modified_base (371)..(371): a, c, t, g, unknown or other
  misc_feature (371)..(371): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctccaggggaaangccaccctctcctgcagggccagtcagagtctagcagcagctacttagcctggtaccagcagaaacctggccaggctcccaggctcctcatctacggtncatccagcagggccactggcatcccagacaggttcagtggcagtgggtctgggaaacncttcactctctccatcagcagactggagcctgaagtattttgctagtgtattacgtgtcagtcagttatggtactcacctattcactttcggccgtaggacctaagtgatacgtacaacgatgtgctacg

SEQ ID NO: 181031 - DNA, 508 bp, Homo sapiens
  misc_feature: GYAE6OF01ESZOH.38.26.C04.1.454.CMB.1.raw
  modified_base (483)..(483): a, c, t, g, unknown or other
  misc_feature (483)..(483): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcgactctctccatcagcagactggagcctgaagattttgcagtgtattactgtcagcagtatggtaactcaccattcactttcggccctgggaccaaagtggatatacaaacgaactgtggctgcaccatctgtcttcntctcccgcctactctgaactgatcg

SEQ ID NO: 181032 - DNA, 567 bp, Homo sapiens
  misc_feature: GYAE6OF01CANLF.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaangccacctctcctgcagggccagtcagagtcttagcagcagctacttagcctggtaccagcagaaacctggccaggctcccgaggcctcctcatcgtacggtgcatccagcgacggccacgtggcactcccagacaggttcaggtcgcgtaggtgggtcgtagggaaagtcttacgactctctcctatcagcagacgtggacgccgtagtaagtattttgacgtagttagttattactgtacagtctagttatacggtactccgtactacgttctaccgttaccggcccgttagggtaacctaaggttacgtaaacgttactaaccgtaaacgtagttacggtcgtcgtaccg

SEQ ID NO: 181033 - DNA, 518 bp, Homo sapiens
  misc_feature: GYAE6OF01AUMU6.38.26.C04.1.454.CMB.1.raw
  modified_base (215)..(215): a, c, t, g, unknown or other
  misc_feature (215)..(215): n is a, c, g, or t
  modified_base (373)..(373): a, c, t, g, unknown or other
  misc_feature (373)..(373): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaancttcactctctccatcagcagactggacgcctaggaagtattttgcgtagtgttattactagtcagtctagttatggtaactcgactattcactttccggcccgtagggacctaaagtgaatacgtacaaacgaactgtggctcg

SEQ ID NO: 181034 - DNA, 172 bp, Homo sapiens
  misc_feature: GYAE6OF01DJAZW.38.26.C04.1.454.CMB.1.raw
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatag

SEQ ID NO: 181035 - DNA, 659 bp, Homo sapiens
  misc_feature: GYAE6OF01EUY0D.38.26.C04.1.454.CMB.1.raw
  modified_base (422)..(422): a, c, t, g, unknown or other
  misc_feature (422)..(422): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggcctcctcatctacggtgcatccagcagggccactggcatccccagcccaggttcagtggcagtgggtcgtagggaagacttcactctctccatcagcagactggacgcctaggaagtagttttgactagtagtattacgtgtacagactagtagnttacggtaacctacctaccgtactttaccgtaccgtttaccgggtcccgtaacgggtaaccgtaaacggtaaggtaacttaacgtaaccgtaaaaccgtaaccggtacggtacggtacgtacgtaccgtaaccctaccgtttaccgttacgtttaccgttacccttaccctttaccccgttacccccgtacccgttaccttaccggtttaaccggttaaaccggttacggtaaccgg

SEQ ID NO: 181036 - DNA, 531 bp, Homo sapiens
  misc_feature: GYAE6OF01CQDAD.38.26.C04.1.454.CMB.1.raw
  modified_base (283)..(283): a, c, t, g, unknown or other
  misc_feature (283)..(283): n is a, c, g, or t
  modified_base (388)..(388): a, c, t, g, unknown or other
  misc_feature (388)..(388): n is a, c, g, or t
  modified_base (463)..(463): a, c, t, g, unknown or other
  misc_feature (463)..(463): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtncgacaggcccctggacaagggcttgagtggatgggaggatcctcccgatcctttggacaaacacactacgcacacaagttccaggacagactcacgattacccgnggacgaatccacgagacacagtctacatggagatgagtagcctgagatctgacgacacggcgtgtatttctgtgngagaggaggggccgaggggctcgggtggtaacggttaggtgtcgttttagattagtcgtggggtaccg

SEQ ID NO: 181037 - DNA, 512 bp, Homo sapiens
  misc_feature: GYAE6OF01EKFFL.38.26.C04.1.454.CMB.1.raw
  modified_base (484)..(484): a, c, t, g, unknown or other
  misc_feature (484)..(484): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggacgcctgaagtattttgctagtgtattactgtcagcagtatggtaactcacctattctacttcgccctgggaccaagtggatatacaacgaactgtgctgcaccatcgtcgtcttcnctcctcccgctactctagacgtgctacg

SEQ ID NO: 181038 - DNA, 586 bp, Homo sapiens
  misc_feature: GYAE6OF01EBVRY.38.26.C04.1.454.CMB.1.raw
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcactctacggtgcatccagcacgggccactggcactcccagaccaggttcaggtggctaggtgggtctaggggaaanacttcactctctccatcagcagactggacgcctagaagtntttgactagtgttattactgtacagctaagtagtaggtaacctctaaccgtattcctaccgttttccgggcccgttacgggaacctaaaggttacggtaactacgtaaccaaacgtactaggtcgacgtgaccacctagtccgttcgttacttctactcccttcccgacctacttactagtaacgtgtacgtaccgg

SEQ ID NO: 181039 - DNA, 518 bp, Homo sapiens
  misc_feature: GYAE6OF01AL6PF.38.26.C04.1.454.CMB.1.raw
  modified_base (215)..(215): a, c, t, g, unknown or other
  misc_feature (215)..(215): n is a, c, g, or t
  modified_base (409)..(409): a, c, t, g, unknown or other
  misc_feature (409)..(409): n is a, c, g, or t
  modified_base (515)..(515): a, c, t, g, unknown or other
  misc_feature (515)..(515): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaaacctggccaggcctccaggctcctcatctacggtgctatccagccagggccacgtggcactcccagacaggttcaggtggcagtgggtctagggaaatcttcactctctccatcagcacgactggacnctagaagtatttgctagtgtattacgtgtcgtagtactagtatcggtaactcactattccacgtttccggcctaggaacctaaggtgatactacaacgtatgtggntcg

SEQ ID NO: 181040 - DNA, 530 bp, Homo sapiens
  misc_feature: GYAE6OF01BE5QN.38.26.C04.1.454.CMB.1.raw
  modified_base (213)..(213): a, c, t, g, unknown or other
  misc_feature (213)..(213): n is a, c, g, or t
  modified_base (316)..(316): a, c, t, g, unknown or other
  misc_feature (316)..(316): n is a, c, g, or t
  modified_base (404)..(404): a, c, t, g, unknown or other
  misc_feature (404)..(404): n is a, c, g, or t
  modified_base (526)..(526): a, c, t, g, unknown or other
  misc_feature (526)..(526): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctcaggggaanagccaccctctcctgcagggccagtcagagtcttagcagcagctacttagcctggtaccagcagaaacctggccaggcctcccaggcctcctcatctacggtncatccagcagggccacgtggcatcccagacaggttcagtggcagtgggtctagggaaatcttcactctctccatcagcagactggacncctagaagtagtttgctagttgttattactgtacagtctagttatggtaacctctaactattctaccgtttcggcccgttagggaacctaaaggtgtaattacgtacaaacgtagtgtcggntacg

SEQ ID NO: 181041 - DNA, 603 bp, Homo sapiens
  misc_feature: GYAE6OF01BSGKN.38.26.C04.1.454.CMB.1.raw
  modified_base (223)..(223): a, c, t, g, unknown or other
  misc_feature (223)..(223): n is a, c, g, or t
  modified_base (255)..(255): a, c, t, g, unknown or other
  misc_feature (255)..(255): n is a, c, g, or t
  modified_base (312)..(312): a, c, t, g, unknown or other
  misc_feature (312)..(312): n is a, c, g, or t
  modified_base (395)..(395): a, c, t, g, unknown or other
  misc_feature (395)..(395): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctcaggcacctgtctttgtctccgagggaaagcgccaccctntcctgcagggccagtcagagtctagcagcagntactagcctggtaccagcagaacctggccaggcctccaggcctcctcatctacggtnacatccagcagggcccagtcggacatcccagacaggttcagtcggactagggtggtacgtaggggaaatcgttacacgtctcncctatcagcagaccgtggacgccgtaggtaagtacttttggacgtagttacggttatttaccgtagttaccgaagtacgtaagttagttacggttaacctacgtaaccttacgtttactacccggttttaccggcccggttaacgggaacctaaagggtcggtaacttaacgttaaccgaaacgtaacgtacggtcggtacgtaccgg

SEQ ID NO: 181042 - DNA, 592 bp, Homo sapiens
  misc_feature: GYAE6OF01CMXST.38.26.C04.1.454.CMB.1.raw
  modified_base (348)..(348): a, c, t, g, unknown or other
  misc_feature (348)..(348): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccgttcagccacctatactttcagctgggtgcgacaggccccgtggacgaagggcttgagtggatgggaggatcctccgatcttggctaacncactacgcacacaagtccaggacagactacacgacttaccgcggaacgaactcccgacgacgacaacagtacctacagtcggagagtagagtagcctagagatcgtagaaccgacgaaccgggtccgttagttactttcgtggtacgcggtaggacgggagggggacccggagggggtcgttcggggtacgggttaacggttgggttacgtcgttttagagtttaggtcggtggggtaacccgg

SEQ ID NO: 181043 - DNA, 177 bp, Homo sapiens
  misc_feature: GYAE6OF01AM206.38.26.C04.1.454.CMB.1.raw
  modified_base (173)..(177): a, c, t, g, unknown or other
  misc_feature (173)..(177): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnnn

SEQ ID NO: 181044 - DNA, 564 bp, Homo sapiens
  misc_feature: GYAE6OF01EEMQU.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtcttagcagcagctacttagcctggtaccagcagaacctggccaggctcccaggctcctcatctacggtgcatccagcacgggccacgtggcactcccagacaggtttcagtggacgtaggtgggtcgtagggaaactacgttacactctcctccatcagcagacgtggacgcctgaagtagtttgctagttgtattacgtgtacgagtcagttagttaggtaactccgtacctattcctacgtttcccggcccgttaggggaacctaaaggttacggtattaacgtaacgtaaacgtaacgttcggtcggtcgtaccgg

SEQ ID NO: 181045 - DNA, 728 bp, Homo sapiens
  misc_feature: GYAE6OF01CN5KG.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctcgaggggaaagacgcccaccctctcctgcgacgggccagtcagtagtctagcagcagctacttcgctaggtaccagacacgaacctcggaccaggcctcccgaggtcctcctacacttccgtacggtcgacctacgtccgacggccgaacggggcccacgtcggacctaacgtcccgaagaccgtaacggttcgagggtcggccgtagggttcggggttaccgtaagggggtaaactaccgtttaccgaccttccttaccgtacccgtacgttaccgacgaccgtaaacgggtaccgttgggaaccgtccgttaacgggtaaagtttacgttttacggaccggttaaggtttacgtttaacgtttaacgtggttacgaacggttacgtaaaggttacgttaacggtaacccttaccgtaccttacgtttaccgtacccggttttacccggacccgttaacgggaaacctaaagggttcggtaacttaccggtaaaccgtaacgtaagttcggtacggtactacg

SEQ ID NO: 181046 - DNA, 581 bp, Homo sapiens
  misc_feature: GYAE6OF01D72LY.38.26.C04.1.454.CMB.1.raw
  modified_base (322)..(322): a, c, t, g, unknown or other
  misc_feature (322)..(322): n is a, c, g, or t
  modified_base (470)..(470): a, c, t, g, unknown or other
  misc_feature (470)..(470): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagcccaccctctcctgcagggccagtcagagtctagcagcagctacttagcctggtaccagcaagaaacctggccaggcctcccgaggcctcctcatcgtacggtncatccaagcgaggccagtcggctactcccgagaccgtagggttccaggtcggctagggtgggtacgtagggaaaacgccttcgactcgtctccatcgagcgagacgtggacgcctagtaagtagtttgacgtagttagttattacgtntacgagtactaagttatacggtaactaccgtactacttccgtaccgtttccggcccgtagggaacctaaaggtcgtaatacgtaccgaaacggtactcggtacgcgtaccg

SEQ ID NO: 181047 - DNA, 586 bp, Homo sapiens
  misc_feature: GYAE6OF01DQ3O3.38.26.C04.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtctagcagcagctacttagcctggtaccagcagaaacctgccaggctcccgaggctcctcatctacggtgcatccagcacgggccacgtggccactccccaagaccgtaggtttcaaggtcggacgaggtgggtcgtaggggaaaagtaccgttcacttctcctaccatcacgcagtacgtggacgcccgtagaagtattttcggctagttgttatttaactgtacagtacgtagttattacggttactcaaccctatttccgtaccgtttccggcccgttagggaaccctaaaggtacggtacttaacgtaccgaaaacggtacttacggtggtcctacgg

SEQ ID NO: 181048 - DNA, 526 bp, Homo sapiens
  misc_feature: GYAE6OF01BQXJY.38.26.C04.1.454.CMB.1.raw
  modified_base (339)..(339): a, c, t, g, unknown or other
  misc_feature (339)..(339): n is a, c, g, or t
  modified_base (493)..(493): a, c, t, g, unknown or other
  misc_feature (493)..(493): n is a, c, g, or t
  modified_base (519)..(519): a, c, t, g, unknown or other
  misc_feature (519)..(519): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccagggggaaagagcccaccctctcctgcagggccagtcagagtcttagcagcagctacttagcctggtaccagcagaacctggccaggctccaggctcctcatctacggtgcatccagcagggccactggcatcccagacaggttcagtggcagtgggtctgggaancttcactctctccatcagcagactggacgcctagaagtattttgctagtgtattacgtgtcagctagtatacggtaactctacctattctactttcggcctggacaagtggatacgtacaacgtacgtgtacgctgcactatcgtcgtcttacncttccttcccgactctactagacgtntcgtacg

SEQ ID NO: 181049 - DNA, 636 bp, Homo sapiens
  misc_feature: GYAE6OF01ER83H.38.26.C04.1.454.CMB.1.raw
  modified_base (216)..(216): a, c, t, g, unknown or other
  misc_feature (216)..(216): n is a, c, g, or t
  modified_base (226)..(226): a, c, t, g, unknown or other
  misc_feature (226)..(226): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (376)..(376): a, c, t, g, unknown or other
  misc_feature (376)..(376): n is a, c, g, or t
tcagtcgatcacgtcacgaccggtgctcgatttagtctagcgactttgggtttggggcagagctctggagaagagctgctcagttaggaccccagagggaaccatggaaaccccagcgcagcttctcttcctcctgctactctggctcccagataccaccggagaaattgtgttgacgcagtctccaggcaccctgtctttgtctccaggggaaanagccaccctntcctgcagggccagtcagagtcttagcagcagctacttagcctggtaccagcagaaacctgccaggctcccaggctctnatcacggtgcatccagcaggccactggcancccagacaggttcagtggcgagtgggtactgggaaagtacnttcactctctccatcagcagacgtggagacctagtaagtacttttacggtacgtaacggttacgttaacgtttaccgttacggttaccgtaacggtacgttaagggtttaacgttaacgggttaaaccgttaccgtaacccgtaaacgtttaccgttacccgttttacccgggttacccccggttaccggggtaacccgtaaaacggttaacggtaacgttaacgttaaccgtaaaaccggtaaaccggtacggttacgg

SEQ ID NO: 181050 - DNA, 743 bp, Homo sapiens
  misc_feature: GYAE6OF01B3IZU.38.26.C04.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtcttgtctccaggggaaanagccaccctctcctgccagggccagtcagagtcttagcagcagctacttagcctggtaccagcacgaaacctggccaggcctccgaggcctcctcatcgtacggtgctactccaagccgagggtccacgtggccatccccgagactggttcagtcggcaggtcgggtacagggaaacgaccttcaccgtctcctaccatcgagacctaacgaaccgtgggaccgtacccgtaggtaaaacgttcgttttagccgttaggttacgttaacgtttaacgtcggtacgtaacggtaccgtaaggttaacgttaacgggtttaacctaccgttaacccgtaaacttttcccggtaaccgtttttacccgggaccccggtttaacgggtaaaacccgttaaagggttacggtaaacgttaacgtaaaccccggtaaaacggtaaccgttacggtacggtaacccgtgtaaccccgtaaccgtaccgtacgttccggtactttaccgtacgttcccgttacccctaccgtaactttacggaacccgttaacgtcgtaacgttacccgg

SEQ ID NO: 181051 - DNA, 513 bp, Homo sapiens
  misc_feature: GYAE6OF01DZR3D.38.26.C04.1.454.CMB.1.raw
  modified_base (338)..(338): a, c, t, g, unknown or other
  misc_feature (338)..(338): n is a, c, g, or t
  modified_base (366)..(366): a, c, t, g, unknown or other
  misc_feature (366)..(366): n is a, c, g, or t
  modified_base (509)..(509): a, c, t, g, unknown or other
  misc_feature (509)..(509): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagcaggttcagtggcagtgggctgggaaancttcactctctccatcagcagactggancctgaatatttgcagtgtattaatgtcagcagtatggtaactcacctattcaccgtttcggccctgggaaccaaagtcggatactacaaacgtactgtgctgcaccatctgtcttcactcttcccgcctatctagaacgtgtntacg

SEQ ID NO: 181052 - DNA, 690 bp, Homo sapiens
  misc_feature: GYAE6OF01ESPBQ.38.26.C04.1.454.CMB.1.raw
  modified_base (213)..(213): a, c, t, g, unknown or other
  misc_feature (213)..(213): n is a, c, g, or t
  modified_base (299)..(299): a, c, t, g, unknown or other
  misc_feature (299)..(299): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtctttgtctccaggggaancgccacctctcctgcaggccagtcagagtcttagcagcagctacttagcctggtaccagcagaacctggcaggctccaggcctctnatcgtacgtgcatcagcaggccacgtgacatcccagaccgaggtttcagtggcctaggtcgggtactaggggaaatacctttcgaacttctacgttcccaagttccgagacgtacggaacgtcgggacgacccgttaggtaaacgttacgttttagccgttaagggttacgttaacgtttaaccgttacggttaccgtaaggttaccgttaaacggttaacgttaccgggtttaaaccttcctaaccgttaacgttttacccgttaaaccggtttttcccgggaccccgttttaagggggaaaccccgttaaagggttacggtaaacctttaaccggttaaacccgtaaaacggttaacccggttacgggttaccgggtacgttacccggg

SEQ ID NO: 181053 - DNA, 559 bp, Homo sapiens
  misc_feature: GYAE6OF01D1SMW.38.26.C04.1.454.CMB.1.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtctttgtctccaggggaaancgccaccctctcctgcagggccagtcagagtctagcagcagctacttagcctggtaccagcagaacctggccaggctccgaggcctcctcatctacggtncatccagcagggccactggcatcccgagacaggttcagtggctaggtcgggtctaggggaaatcttcgactctcctccatcagcagactggacgccgtagaagtagttttgacgtagtgtattacgtgtcagtctagttagtacgtaactctaactacttcctacgtttccggaccgttacgggtaaccgtaaaggttacggtaattaacgtaacgtaaacggtaacttacggtcggtcgtacgg

SEQ ID NO: 181054 - DNA, 583 bp, Homo sapiens
  misc_feature: GYAE6OF01AWNBN.38.26.C04.1.454.CMB.1.raw
  modified_base (319)..(319): a, c, t, g, unknown or other
  misc_feature (319)..(319): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagacgccaccctctcctgcagggccagtcagagtcttagcagcagctacttagcctggtaccagcagaaacctggccaggcctccaggcctcctcatcgtacggtncatccagcacgggcccacgtggaccactccccgaagtaccagggtttcaaggtcggaccagggttgggtacgtagggaaaactccgttacactctactccatcagcagactggacgtcctagaacgtagtttcgcgtagtagttatttacgtagtacagtactagttattaggtaacctcacctattccgtaccgtttccggcccgttagggaacctaaggtcgtaattacgtaacgtaaaccgtaagttcggtcggtctaacg

SEQ ID NO: 181055 - DNA, 614 bp, Homo sapiens
  misc_feature: GYAE6OF01CCF4N.38.26.C04.1.454.CMB.1.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (313)..(313): a, c, t, g, unknown or other
  misc_feature (313)..(313): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtcttgtctcaggggaaangccaccctntcctgcagggccagtcagagtctagcagcagctacttagcctggtaccagcagaaacctggccaggctcccaggcctcctcatctacggtncatccagcagggccactcggcatcccagacgaggttcaggtcggacagggtcgggtctaggggaaacgtcttcactctcctccatcagtcaaggtactagggacgtaccgtaggtaacgtattttgacgtagttacgttattacgttagtactaggtacctaagttagttacggtaacctaccgtaacctactttaccgtaaccgttttcccgggaccccgttaggggaaaccctaaagggttacggtaaacttaacgtaaccgtaaaccggtaaccgttcgggttcgggtaccttaccgg

SEQ ID NO: 181056 - DNA, 722 bp, Homo sapiens
  misc_feature: GYAE6OF01C2X7V.38.26.C04.1.454.CMB.1.raw
  modified_base (217)..(217): a, c, t, g, unknown or other
  misc_feature (217)..(217): n is a, c, g, or t
  modified_base (317)..(317): a, c, t, g, unknown or other
  misc_feature (317)..(317): n is a, c, g, or t
tcagtcgatcacgtcacgaccggtgctcgatttagtctagcgacttttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcgagggccagtcagagtctagcagcagctacttgcctggtaccagcagaacctggccaggctcccgagcctctcatcgtacggtncatccagcacgggccagtcggcactacccgagacgtagggtttccaggttcggacgagggttggggtaccgttaggggaaaacgtaccgtttccgaacctttccgtaccgttacccaacgttcccgaaacggtacgtaacggtaaccgttcgggaacgtacccgttaagggtaaacgttacgtttttacggaccgttaaggtttacgggtttaattttaaccgtggttaccgaacggttaccgttaaggttaacgtttacggttaacctaccgttaaacccttacgtttacccgttacggttttacccggaccccggtttaagggtaaaccctaaagggttaccgggaaatttaacgtaaacccgttaaaaaccggttacggttacggtccgggttcgtaaccgg

SEQ ID NO: 181057 - DNA, 818 bp, Homo sapiens
  misc_feature: GYAE6OF01BBYAF.38.26.C04.1.454.CMB.1.raw
  modified_base (214)..(214): a, c, t, g, unknown or other
  misc_feature (214)..(214): n is a, c, g, or t
  modified_base (320)..(320): a, c, t, g, unknown or other
  misc_feature (320)..(320): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctcgaggggaangccaccctctcctgcaggccagtcagagtcttagcagcagcttacttagcctggtaccagcaagaacctggccaggcctcccgaggcctcctacatccgtacggtncagtccagcgacgggccacgtcggaccacgtaccccgaaggtacccgtacgggtttccgaacggttcggacgtacggggttacggggttaccggttaacgggggaaaaccttcccgtttaccgtaaccgtttccccgttaacccttaccccggtaacgttacccgaacggtacccgtaaacgggttaacccggttacgggtaacccgggttacccgtttaaaggggtaaacgttttacgtttttacgggaaccgtttaggtttaagtttaaccgttaccgttacggttaacccgtaagggttaaccgttaaggtttaacgttaaccgggttaacctaccgttaaacccgttagtttacccgtttacccggtttacccgggtaaccccggtttaacgggaaacccgttaaaacggggttaccggttaaacgttaaacccgtaacccgggttaaaacggttaacccggttacgggttaaccgggacccggtttaacccgg

SEQ ID NO: 181058 - DNA, 543 bp, Homo sapiens
  misc_feature: GYAE6OF01ASU2L.38.26.C04.1.454.CMB.1.raw
  modified_base (320)..(320): a, c, t, g, unknown or other
  misc_feature (320)..(320): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggcctcccgaggcctcctcatcctacggtncatccgagcacgggccacgtggcactcccgagacaggttcaggtcggcaggtcggtcgtagggaaatacttcactctctccatcagcagtactggacgccgtagaagtagtttcgacgtagtgttattacgtagtcagtctagtatacggtactcacctattccgtacgttccgccgtaggaactaagtacgtaatactaacgaaacgtactggtgtcgtacg

SEQ ID NO: 181059 - DNA, 497 bp, Homo sapiens
  misc_feature: GYAE6OF01A93D4.38.26.C04.1.454.CMB.1.raw
  modified_base (183)..(183): a, c, t, g, unknown or other
  misc_feature (183)..(183): n is a, c, g, or t
  modified_base (211)..(211): a, c, t, g, unknown or other
  misc_feature (211)..(211): n is a, c, g, or t
  modified_base (400)..(400): a, c, t, g, unknown or other
  misc_feature (400)..(400): n is a, c, g, or t
  modified_base (462)..(462): a, c, t, g, unknown or other
  misc_feature (462)..(462): n is a, c, g, or t
  modified_base (471)..(471): a, c, t, g, unknown or other
  misc_feature (471)..(471): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagngtcttagcagcagctacttagcctggtaccagcagaacctggccaggctcccaggctcctcatctacggtgcatccagcacgggccactggcactcccagacaggttcagtggcaggtgggtctgggaaagcttcactctctcatcagcagactggagcctgagtattttgctagtgttattactgtcngcagtatggtactcactattcactttcgcctggacaagtgatatacaacgatgtgctgcacntctgtctcnctctccgctactctagacgtgcgtcg

SEQ ID NO: 181060 - DNA, 711 bp, Homo sapiens
  misc_feature: GYAE6OF01AV9SM.38.26.C04.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (408)..(408): a, c, t, g, unknown or other
  misc_feature (408)..(408): n is a, c, g, or t
  modified_base (434)..(434): a, c, t, g, unknown or other
  misc_feature (434)..(434): n is a, c, g, or t
tcagtcgatcacgtcacgaccggtgctcgattttagtctagcgactttggggtttgggggcacgagctcctcggagaagagcctgtctcagttaggacccagagggaaccagtcggaaaccccagccgtccaggtctttctccttccgtcctgtctacgtctcggctcccagactaccacgggagaaacttgtgttacgaccgcagtctccgacggcaccctgtctttcgtctcgagggaacncgccaccgtntcctggcgtagggccaggtcgagtacgttcttacgcacgccaggcttacgtagcgtcggtacctgaccacgaactcggtcctacgaccgtaccgacggacctaaccgtccaagttcgtaacggtcgtaccacgtcgaacgtcgacggtacctacnggcactacccgagacgtacggtacgngtggtacgtagttcgggtacgacgggaaacgtccttacgtaccgtccgtacgttccgaacttccgaacgtccgtaacgtacgttacgggtacgtaccggtaggtaaacggttacggtttacgacggtaaggtaacgttacgttacgttcggttacgtacgtacgtagtttacgtaacggttactacgtacgtacgttccgttacggttccggtaccggtacggaacgtaacggtacgtacgttaacgtaccgtaacgagttcggtacgcgttaacgg

SEQ ID NO: 181061 - DNA, 586 bp, Homo sapiens
  misc_feature: GYAE6OF01DJFIN.38.26.C04.1.454.CMB.1.raw
  modified_base (258)..(258): a, c, t, g, unknown or other
  misc_feature (258)..(258): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaggcttctggaggcaccttnagcacctatactttcagtctgggtcgcgacacggcccctggacaagggcttggagtggagtggggagggatcccgtcccgatcgtttaggcaaaccacgacctacgcacactaagttccaggactagactacacgattaccgacggacgaactaccgacgagcacgacgtctaacagtaggacatgagtanccgtaganagtctacgacgacgacggtccgtagttactttcgtgtgaccggtaggaggacgggggccgaggggtcgtcgggttaggtaaacggtttggtacggttacgttttagattgttccggtggggtaacccgg

SEQ ID NO: 181062 - DNA, 590 bp, Homo sapiens
  misc_feature: GYAE6OF01C8EFI.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctactagcctggtaccagcagaaacctggccaggctcccaggctcctcatcacggtgcatccagcagggccactggcatcccagacaggttcagtggcagtgggtctgggaaagacttcactctctccatcagcagactgggagcctagaagtattttgctagtctattactgtcagctagtagtggtaactacacctattcctaccgttttccggcccgttacgggaacctaaaggtcggtaacttacgtaccgaaacgtaacgttaggtggcttacgacctacctattcgttcgttacctttaccgtacttacccgtttccccaccgttacttaccgttacggtaaacgtggtacgttacccgg

SEQ ID NO: 181063 - DNA, 518 bp, Homo sapiens
  misc_feature: GYAE6OF01DWZNZ.38.26.C04.1.454.CMB.1.raw
  modified_base (216)..(216): a, c, t, g, unknown or other
  misc_feature (216)..(216): n is a, c, g, or t
  modified_base (514)..(514): a, c, t, g, unknown or other
  misc_feature (514)..(514): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcagggccagtcagagtcttagcagcagctacttagcctggtaccagcagaacctggccggctccgaggcctcctcatcgtacggtgcatccagcgagggccagtggcactcccgagacaggttcagtcggcaggtgggtctagggaaactcttcgactctctcatcagcagacgtggacgccgtagaagttatttgctagttgttattactgtcagctagtatcgtactcactattactacgttcggccgtaggaactaaggtgatagtacaacgtactgcgntgac

SEQ ID NO: 181064 - DNA, 561 bp, Homo sapiens
  misc_feature: GYAE6OF01A71C4.38.26.C04.1.454.CMB.1.raw
  modified_base (215)..(215): a, c, t, g, unknown or other
  misc_feature (215)..(215): n is a, c, g, or t
  modified_base (314)..(314): a, c, t, g, unknown or other
  misc_feature (314)..(314): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtcttagcagcagctacttagcctggtaccagcagaaacctggccaggctccaggctcctcatctacggtncatccagcagggccacgtggcatccagacaggttcaggtggctaggtgggtactagggaaagtacttcgactctctaccatcagcagactggactccgtagaagtgtttgacgtagtgttattacgtgtacagtactagtacgttaggtaacctccgaactatttccgtacgtttccggacccgttagggaaccgtaaaggtcggtaacttaacgtactaaaccggtattcggttacgcgttaccgg

SEQ ID NO: 181065 - DNA, 174 bp, Homo sapiens; identical to SEQ ID NO: 181005
  misc_feature: GYAE6OF01AMQIL.38.26.C04.1.454.CMB.1.raw
  modified_base (173)..(174): a, c, t, g, unknown or other
  misc_feature (173)..(174): n is a, c, g, or t

SEQ ID NO: 181066 - DNA, 556 bp, Homo sapiens
  misc_feature: GYAE6OF01E09JY.38.26.C04.1.454.CMB.1.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (310)..(310): a, c, t, g, unknown or other
  misc_feature (310)..(310): n is a, c, g, or t
  modified_base (371)..(371): a, c, t, g, unknown or other
  misc_feature (371)..(371): n is a, c, g, or t
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctccaggggaangccaccctntcctgcagggccagtcagagtcttagcagcagctacttagcctggtaccagcagaacctggccaggctccaggctcctcatcacggtncatccagcagggccactggcatcccagacacggtttcagtggcacggtgggtctgggaaancttcgactctctccatcagcagtactggagcctagaacgtnttttgcgtagtgtatttacgtgtacngtaccgtagtacttaggtaaccttcacctacttaccgaaccgttttccggcccgttagggaacctaaacggttacggtaattaacgtaccgtaaacgtaacctcggtaggcttaccgg

SEQ ID NO: 181067 - DNA, 708 bp, Homo sapiens
  misc_feature: GYAE6OF01CTPU3.38.26.C04.1.454.CMB.1.raw
  modified_base (185)..(185): a, c, t, g, unknown or other
  misc_feature (185)..(185): n is a, c, g, or t
  modified_base (284)..(284): a, c, t, g, unknown or other
  misc_feature (284)..(284): n is a, c, g, or t
tcagtcgatcacgtcacgaccggtgctcgatttagtctagcgactttgggtttgggggaagacaatgggtttgatttagattacatgggtgtacttttctgttttatttccaatctcagataccaccggagaaattgtgttgacgcagtctccaggcaccctgtctttgtctccgaggggaaagngccaccctctcctgcgaggccagtcagagtctagcagcagctactagcctggtaccagcaagaaacctggccaggcctccaggctcctcatctacggtncatccagcgaggccagtggcactcccagactaggtcaggtggcaggtgggtctagggaaaactcttacacttctcctacatcgaacgtcaaggtacgtagggacgtaccgtaggtaaagttacgtttcgacgtaacggttagttaactttacgtgtaaccgaggtaccgtaaggttaacgttacgggttaacctaccgtaaaccttacgtttacccgttaaccggttttacccgggaccccggttaagggtaacccgtaaaaggttacgggtaaacttaaccgtaaaccgtaaaaccggtaacgttcgggtacggtaccgttacgacctaaccgtacgttacgttacgttaccttacttacccgttccccgttaccccgacccgttacttaccgttacggtaaaccgttgtaacgtaacccggg

SEQ ID NO: 181068 - DNA, 565 bp, Homo sapiens
  misc_feature: GYAE6OF01D7TWG.38.26.C04.1.454.CMB.1.raw
  modified_base (384)..(384): a, c, t, g, unknown or other
  misc_feature (384)..(384): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggcttctggagcacttcagccacctatactttcagctgggtgcgacaggcccctggacaagggcttgagtggatgggagggatcctcccgatctttggcaaaccgcactacgcacacaagttccaggacagactcacgataccgnggacaatccacgagcacagtctacatcggagaatgagtagccgtgagatcgtgacgacacggtccgtagtactttcgtgtgacgaggaggagggggccgaaggggtcgttacggggtcgggttaaacggtttagggtcgttaccgtttttagggaatttacgtcggtgggggtaacccggg

SEQ ID NO: 181069 - DNA, 175 bp, Homo sapiens
  misc_feature: GYAE6OF01A6IDL.38.26.C04.1.454.CMB.1.raw
  modified_base (172)..(175): a, c, t, g, unknown or other
  misc_feature (172)..(175): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaggactacttccacgtgatcgactgagcgggctggcaaggcgcatagnnnn

SEQ ID NO: 181070 - DNA, 173 bp, Homo sapiens; identical to SEQ ID NO: 181006
  misc_feature: GYAE6OF01DLWVG.38.26.C04.1.454.CMB.1.raw
  modified_base (173)..(173): a, c, t, g, unknown or other
  misc_feature (173)..(173): n is a, c, g, or t

SEQ ID NO: 181071 - DNA, 706 bp, Homo sapiens
  misc_feature: GYAE6OF01DAPT6.38.26.C04.1.454.CMB.1.raw
  modified_base (284)..(284): a, c, t, g, unknown or other
  misc_feature (284)..(284): n is a, c, g, or t
  modified_base (305)..(305): a, c, t, g, unknown or other
  misc_feature (305)..(305): n is a, c, g, or t
  modified_base (315)..(315): a, c, t, g, unknown or other
  misc_feature (315)..(315): n is a, c, g, or t
  modified_base (319)..(319): a, c, t, g, unknown or other
  misc_feature (319)..(319): n is a, c, g, or t
tcagtcgatcacgtcacgaccggtgctcgatttagtctagcgactttgggtttggggcagagctctggagaagagctgctcagttaggacccagagggaaccatcggaaaccccagcgcagcttctcttcctcctgctactctgctcccagactaccacggagaaattgtgttgacgcagtctccaggcaccctgtctttgtctaccgaaggggaacacgcccaccctctcctgcgaggccagtcagagtctagcagcagtctactgctggtacagcagaaccnggccaggcctccgagcctccnatcgtaggtncacnccgagcgaggccagtcgactactcccgagacgtggtcaggtcggacgtagggtcgggtacgtaagggaaaactccgtttacaccgttcctactacccgagttaccgagtaccgaacggtaccgttacgggacctaccggttaaggtaaacggtttacgtttttacggaccgtttaaggtttcggtttaacgtttaaccggttcgttaccgtaacgggttacgttaaggttaacgttaaccgggttaaccttaaccgtaacccgtttaaccgttacccgttaaccgggttttaccccgggacccggttaacgggtaaacctaaacgggttacggtaaacttaaacgtaaccggtaaaaccgtacgttacgggtcgaccgttaacccgg

SEQ ID NO: 181072 - DNA, 609 bp, Homo sapiens
  misc_feature: GYAE6OF01AXI3D.38.26.C04.1.454.CMB.1.raw
  modified_base (216)..(216): a, c, t, g, unknown or other
  misc_feature (216)..(216): n is a, c, g, or t
  modified_base (404)..(404): a, c, t, g, unknown or other
  misc_feature (404)..(404): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctccaggcctcctcatcctacggtcgcatccagcagggccactggcatcccagcaggttcagtggcagtgggtctagggaaagctcactctctccatcagcagacgtggacnccgtagaacgtattttcgactagttagttatttaaccgttgtacgagtacgtaagttaagttacgggttaaccttacctaacccgtattttaccgtaaccgttttcccgggtaccccggttaggggtaaaccctaaacgggttacgggtaaacttaaacgtaccggtaaaaacgtacccggttaggtgggtacccgttaacccgg

SEQ ID NO: 181073 - DNA, 610 bp, Homo sapiens
  misc_feature: GYAE6OF01EWVQL.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtcttagcagcagctacttagcctggtaccagcagaaacctggccaggcctcccaggcctcctcatcgtacggtgcactccagcacgggccacgtggcactcccagactaggttcagtggctaggtcgggtacgagggaaacgtcttcactctctacatcgagcagacgtggactccgtagtagttagtttcgacgtaggttacgttagttaccgttagtacgtacgtcgtaaggttagttacggtaaccttacgtaaccttactttacccgttaaccgttttcccgggacccgttaacgggtaacccgtaaaggttacgtaacgttaacgtaaccggtaaacgtacgttacggtgtacgtaccg

SEQ ID NO: 181074 - DNA, 722 bp, Homo sapiens
  misc_feature: GYAE6OF01AGKE5.38.26.C04.1.454.CMB.1.raw
  modified_base (310)..(310): a, c, t, g, unknown or other
  misc_feature (310)..(310): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaagacgccaccctctcctgcagggccagtcagagtcttagcagcagctacttagcctggtaccagcaagaaacctggccaggcctcccgaggcctccnctatcctacggtcgcactcccgagccgacgggcccacgtcggcacgtccccgaggtaaccgtacgggtttcgaaggttcgggaccgtaaggggttcggggttaaccggtaggggtaaaaacgttccgtttaacccgaccgtttaccccttaccgtacccgtaacgtaccggtaaccgtaccgtaacggtacgggtaccgggtaaccgtaccggtaacggttaacggttttacgtttacggtaccgttaaggtttacgtttaacgtttacgttacgtaccgtacgtaacgtacgtttaacgttaccgttaacctaccgtacttacgttcccgttacggttaccccggtcgtaaccgggtaacgtacggttacgaacttaacgtaacgtaacgtaggtacgtcggtcgtaaccg

SEQ ID NO: 181075 - DNA, 505 bp, Homo sapiens
  misc_feature: GYAE6OF01ECFB0.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggagcctgaagtattttgctagtgtattactgtcagcagtataggtactcacattcacttcgcctggacaagtgatatacaaacgtatgtgctgacaccatctcgtctctctccttcccacctactctagaacgtgatcg

SEQ ID NO: 181076 - DNA, 525 bp, Homo sapiens
  misc_feature: GYAE6OF01DE9OL.38.26.C04.1.454.CMB.1.raw
  modified_base (455)..(455): a, c, t, g, unknown or other
  misc_feature (455)..(455): n is a, c, g, or t
  modified_base (486)..(486): a, c, t, g, unknown or other
  misc_feature (486)..(486): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtcccctgcaaggctctggaggcaccttcagcactatactttcagctggtgcgacaggcccctggacaagggcttggagtggatggggaggatccgtcccgatctttggcaaccacactacgcacacagttccaggacagactcacgattaccgacggacgaatccacgagcacagtctaacatcggagatgagtagcctgagatctgacgacacggtcgtgtattngtgacgagaggaggggcgaggggtctcgggngttaacggttggtgtcgtttagagttatcgtgggaaccg

SEQ ID NO: 181077 - DNA, 732 bp, Homo sapiens
  misc_feature: GYAE6OF01A90DS.38.26.C04.1.454.CMB.1.raw
tcagtcgatcacgtcacgaccggtgctcgatttagtctagcgactttgggtttgggggtatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcgggtgaaggtcccctgcaagggcttcgtggagcaccttcagctacctatacctttcagtcgtgggtcgcgacacggccccctggacgaaggggccttggagtgggagtggggagggactcccgtacccggtattccgttttcgggaccaaaacccacgtaaccgtaaccgtcaaccgacgaacgttccgaggacacgtaccgttacgaacgtacgttacccggacggaacgaacgtacccgaacgacgtacctaacgtacggttacctaacgtaagttgggtaagtacttaggaacgtacgcccgtaggtacggtacgttacgtacggaacgaccgtaacgggtcccgttaggttactttcgtacggtcgtacggtacggacgggaaccgggggtacccgaggggggtacccgttcggggttaaccggggtttaaaccgggtttacggggttacggttccggtttttaggaacgtttaacggttccgggttacgggggtaaacccggg

SEQ ID NO: 181078 - DNA, 176 bp, Homo sapiens; identical to SEQ ID NO: 181015
  misc_feature: GYAE6OF01COWTV.38.26.C04.1.454.CMB.1.raw
  modified_base (173)..(176): a, c, t, g, unknown or other
  misc_feature (173)..(176): n is a, c, g, or t

SEQ ID NO: 181079 - DNA, 784 bp, Homo sapiens
  misc_feature: GYAE6OF01EQ4O1.38.26.C04.1.454.CMB.1.raw
  modified_base (216)..(216): a, c, t, g, unknown or other
  misc_feature (216)..(216): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagactaccaccggagaaattgtgttgacgcagtctccaggcaccctgtctttgctccgaggggaancgcccacctctcctgcacgggccagtcagacgttctagcagcagtctacgttagcctacggtaccagacaacgtaaacccgtggacccacgggccctcccgacggtcccttacccgtcctaacgttcccggtaaccgggtcggacctaccgttaccccgaaggcccggtaaccggggcccctaacggttccgggacctaccgtaccccgaaggtacccgtacgggtttcaacgggtcggaccgtagggttacggggtaccgtaaggggtaaaacgttcccgtttaccgtaaccgttcccgttacctacccgtaactaccgtacggtaccgtaacggtaccgttaccgggtaacgtcccggttaaggtaaacggtttcgttttacgggacccgtttaaaggttcgtttaactttcgttaacggtacgtaacgtacgtaaacgtttacggttaccggttaacctaccgtaacctttaacgtttccgtaccgttttacccggaccgtaaccgggtaactaaggttacgtaacttaacgtaacccgaacgttacgtaggttaccgctaacgg

SEQ ID NO: 181080 - DNA, 544 bp, Homo sapiens
  misc_feature: GYAE6OF01CWI5L.38.26.C04.1.454.CMB.1.raw
  modified_base (259)..(259): a, c, t, g, unknown or other
  misc_feature (259)..(259): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttnagcacctatactttcagctgggtgcgacaggcccctggacaagggcttgagtggagtgggaggatcctcccgatcttggcaaaccacactacgcacacaagttccaggacagactcacgattaccgcggacgaatccacgagcaacagtctaacagtggagatgagtagcctgagatcgtagacgacacggccgtagtactttctgtgcgtagaggaggggccgaggggctcgggtcgggttaacggttagggtgtcgttttagagttagtcgttggggaaccgg

SEQ ID NO: 181081 - DNA, 800 bp, Homo sapiens
  misc_feature: GYAE6OF01BI3J9.38.26.C04.1.454.CMB.1.raw
  modified_base (181)..(181): a, c, t, g, unknown or other
  misc_feature (181)..(181): n is a, c, g, or t
tcagtcgatcacgtcacgaccggtgctcgatttagtctagcgactttgggtttgggggaagacaatgggtttgatttagattacatgggtgacttttctgtttatttccaatctcagataccaccggagaaattgtgttgacgcagtctccaggcaccctgtctttgtctccaggggaaangccaccctctcctgcagggccagtcagagtcttagcagcagctacttagcctggtaccagcagaaacctggccaggctccaggctcctcatctacgtgcactccagcgacgggccacgtggcactcccgagacgacggttcaggtcggactagggtcgggtacgtaggggaaacgtacctttaccgaaccttcctacctacccgattaccgaggaccaaggtaccgttaggggaccgtacccggttaaggaaagttaacgttttttcggaccgttaaggtttacgtttaacgtttaaccgttacggttacgtaacggttaaccgtaacggtttaacggtttaaccgggttaaacccgttacccttaaacccgttaacgttttacccgttaacccggtttttaccccggggtaaccccggtttacggggtaaacccgttaaacgggttacgggtaaaccttaaaccgttaacccgtaaaaaccggttaaccgtttacgggtacggtaccgtacggtacctaacccgtacgttaccgttcgttaccctttacgtaccgtttccccttaccccggtacctaccgtttacccgtaacggtaaccgttcgtaacgttaacccgg

SEQ ID NO: 181082 - DNA, 819 bp, Homo sapiens
  misc_feature: GYAE6OF01BBD4J.38.26.C04.1.454.CMB.1.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccacggagaaattgtgttgacgcagtctccaggcaccctgtctttgtctccgaggggaaagacgcccaccctctcctgcgacgggccagtcagagttcttagcagcagctacttagcctggtaccagcaagaaacctggccaggcctcccgaggcctccncatctacggngcactccagccgacgggcccacgtcggacctacctacccgaaggtaccgtagggttcaagggttcgggacgtacggggttggggttaccggtaaggggaaaacgttacccgtttaccgtaacctttcccgttacccgtccctaacgttcccgaacggtaccgaacgggtaccgttacggggaaccgttcccggttaaggttaaacgtttagtttttacggacgttaacgggtttacgtttaacgtttaccgttaggttcccgtaaagggtaccttaaagggttttaccgttaaccgggtttaaacccttacccgttaaacccgttaccgtttttaaacccgtaccccgggttttttccccgggaacccccgggttttaacgggggaaaaaccccgtttaaaaggggttacccgggttaaaattaaaccggtttaaacccggtaaaaaccccgggtttaacggttccggggtttaaccgggtcccggttaacccgg

SEQ ID NO: 181083 - DNA, 701 bp, Homo sapiens
  misc_feature: GYAE6OF01AYXG2.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaagacgcccaccctctcctgcacgggccagtcagagtcttagcagcagtctacgttacgcctaggtaccagaccagaaacctggaccgacggcctacccgaggtccctcccgtacacgtcgtacggtgaccacgtccgagtcgacgggcctacgtcggaccactcccgagtacgtacggttcaggtcggacgtagggttgggtaccggtaagggaaacgttccgttaccaccttcctaccgtccgacgttccgacgtccgtaagtacgtgggacctaccgttaggtaacgtttattcgtacggttagttacgtttaatttaccggttacgtaccgtagtacgtaacgtttacgttaaccggtaacctaccgtaaccttacgtttaccgtacccggtttccggaacccggttacgggaaaccgttaaacggttacggtaaacttaacggtaaccgtaaacggttacgttacggtaccggtacgtacccgg

SEQ ID NO: 181084 - DNA, 594 bp, Homo sapiens
  misc_feature: GYAE6OF01BW0BC.38.26.C04.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttcgtggaggcaccttcagcacctatactttcagctgggtgcgacaggcccctggacaagggcttgagtggagtgggaggactcctccgatcgttggacaaaccncactacgcacacaagtccaggacagactcacgacttaccgcgacgaactccacgagcacacgtctacagtaggagtatagagtagcctagagtactctagacgacgaccggtcgttgttacttcgtgtcgacggaggacgggacgggggaccgacgggggtccgttacggggttagggtttaaccgggtttagggttacggttacgtttttaggaagtttacgttcgggtgggggtaaaccccgg

SEQ ID NO: 181085 - DNA, 642 bp, Homo sapiens
  misc_feature: GYAE6OF01DW5L5.38.26.C04.1.454.CMB.1.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
  modified_base (482)..(482): a, c, t, g, unknown or other
  misc_feature (482)..(482): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctgctcccagataccaccggagaaattgtgttgacgcagtctccaggcaccctgtctttgtctccaggggaaangccaccctctcctgcagggccagtcagagtcttagcagcagctacttagcctggtaccagcagaacctggccaggcctccgaggctcctcatctacggtncatccagcacgggccacgtcggcacgtcccgaagaccgtaggtttcaaggtcggaccgtagggtggggtccgtaagggggaaaactaccgtttcaaccgtttcctacccgttaccctagttaccgacgacgtaacgtaccgtagggacgtcccgttaggtaaacgttntttttacggacttaaggttacgttagtttaaccgtggtactaggtactaagttagttacggttactaccgtaaccgtacttaccgttacgtttcccgggtacccgtagggtaacctaaggtacgtataaccgtacgaaacgtagttaggtcgtctaacgg

SEQ ID NO: 181086 - DNA, 591 bp, Homo sapiens
  misc_feature: GYAE6OF01D4QQK.38.26.C04.1.454.CMB.1.raw
  modified_base (318)..(318): a, c, t, g, unknown or other
  misc_feature (318)..(318): n is a, c, g, or t
  modified_base (392)..(392): a, c, t, g, unknown or other
  misc_feature (392)..(392): n is a, c, g, or t
  modified_base (404)..(404): a, c, t, g, unknown or other
  misc_feature (404)..(404): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccgaggggaaagagccaccctctcctgcagggccagtcagagtcttagcagcagctattagcctggtaccagcaagaaacctggccaggcctccgaggcctcctcatctacggtgcatccagcagggccagtggcactccagaccgnggttcaggtggcaggtgggtcgtagggaaacgcttcactctctacatcgagcagactggacgtccgtagagttntttgcgtagttnttatacgtgtactagctagtagtacgttaactctactattccgtacgtttccggccgtagggaacctaaggtacgactacgtaacgtaaacgtacgttaggtcgtacgtacgaccacctattccgtcgttaccttactccgttcccttcccgaccttacgtaccgtaacgtacgtcgtacgtaccgg

SEQ ID NO: 181087 - DNA, 713 bp, Homo sapiens
  misc_feature: GYAE6OF01CTQJ4.38.26.C04.1.454.CMB.1.raw
  modified_base (331)..(331): a, c, t, g, unknown or other
  misc_feature (331)..(331): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccacggagaaattgtgttgacgcagtctccaggcaccctgtctttgtctccgaaggggaaagcgccaccctctcctgcagggccagtcagagttcttagcagcacgctaacgttacgcctcggtaaccagacaacgaaaccgtggccaggcctccacggtctcctcatcgtacggtncactccgagccgacgggccacgtggacactacccgagtacgtaggtttcgaaggtcggacgtagggttcgggtacgaacgggtaaacttaccgttcgaccttacctcgttacccgagtaccgaacgaccgaaggtaccggtcgggaaccgtaccgttaggtaaacggtttcttttaacgggacttaaggttacgtttaacgtttaacgttacggtaccgtaaggtaccgttaagttaacggttaaccggttaacctaaccgtaaccgttacgtttaccgttacccggtttacccggtaacccggtagggtaaaaccgtaaagggtttccgaaatttaaccgtaaaccgtaaacggtaccgttagggtacgtccgttaaccgg

SEQ ID NO: 181088 - DNA, 593 bp, Homo sapiens
  misc_feature: GYAE6OF01BAHKS.38.26.C04.1.454.CMB.1.raw
  modified_base (336)..(336): a, c, t, g, unknown or other
  misc_feature (336)..(336): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccagggggaaagagccaccctctcctgcagggccagtcagagtcttagcagcagctacttagcctggtaccagcagaaacctggccaggctccaggctcctcatctacggtgcatccagcaggccacgtggcactcccagacagtcagtgcagtggtcaggaaancttcgactcgtctccatcagcagacgtggagcctagaaacgttatttgactagtgttactttacgtgtacagtactaagtatacggtaactcaacctacttccgtacgtttccggaccctagggaacctaaaggttacgaataactacgaaacgtacgtagacgactggaccctaacattccgtacgttccttactacgtttacccttacccccgccctaacttacccgtaagtaaaccgttcggtaagttaaccgg

SEQ ID NO: 181089 - DNA, 602 bp, Homo sapiens
  misc_feature: GYAE6OF01AX7SW.38.26.C04.1.454.CMB.1.raw
  modified_base (183)..(183): a, c, t, g, unknown or other
  misc_feature (183)..(183): n is a, c, g, or t
  modified_base (283)..(283): a, c, t, g, unknown or other
  misc_feature (283)..(283): n is a, c, g, or t
  modified_base (318)..(318): a, c, t, g, unknown or other
  misc_feature (318)..(318): n is a, c, g, or t
  modified_base (393)..(393): a, c, t, g, unknown or other
  misc_feature (393)..(393): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctccaggcctcctcatctacggtncactccagcacgggcccactggccatcccagaccnggttcaggtgcaggtgggtctagggaaactctcactctcgtaccatccagcaggtacgtggactccgtagaagtnttttcgacgtagtcgttaattacgtgtcagtcgtagtacgtacgtactacactacttctaccgtttcggacccgtagggtaacctaaggtacggtactaacgtaaccgaaacgtacgtaggtcgtacgtacgactaccgtacgttacgtcgttacttacgtaccgttcccgttccccgacctacttactacggtacgtcgtacgtaccg

SEQ ID NO: 181090 - DNA, 589 bp, Homo sapiens
  misc_feature: GYAE6OF01E0P5C.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccagggggaaagagccaccctctcctgcgagggccagtcagagtcttagcagcagctacttagcctggtaccagcagaaacctggccaggcctcccaggcctcctcatcgtacggtgcatccagcacgggccacgtggcactcccagacaggttcaggtcggcgaggtgggtcgtagggaaagtccttcacctctcctaccatcagcagacgtggacgtccgtagaagtagtttgacgtagtgttacttactgtcagtactagtcgtaggtaacctctaactacttccgtaccgttccggtcccgtacgggacctaaaggtgtaactaacgtacaaacgtagtcgtacgactcgacctactattcgtcgttctaccgtcttcccttcccgcctacgtctaggtacgttgacgtaccgg

SEQ ID NO: 181091 - DNA, 648 bp, Homo sapiens
  misc_feature: GYAE6OF01CA5EL.38.26.C04.1.454.CMB.1.raw
  modified_base (212)..(212): a, c, t, g, unknown or other
  misc_feature (212)..(212): n is a, c, g, or t
  modified_base (372)..(372): a, c, t, g, unknown or other
  misc_feature (372)..(372): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtcttgtctcgaggggaanacgccaccctctcctgcgacgggccagtcgagagtcttagcagcagtcctacttagccgtggtaccaggcaagaaaccgtggaccacgggcctaccccgaggtcctcctactagttccgtacggtcgacacgtccgaggcgacgggccacgtcggctacncccaggaccgtggttacgagtcggcgtaggtcgggtacgtaagggaactactcgtactcctctactatccgacgcacgtacgtcggacgtcgtagtaacgttgtttgacgttagttacgttattacgtcgtacgagtacgtacggttacgttacggtaacctcgaacccgttacgttccgttaacccggtttcgggaacccgttacgggaaaccgttagggttacgtaacgttaacgtaaaccgtaacggtacgttcgggtccgggtactaaccgg

SEQ ID NO: 181092 - DNA, 548 bp, Homo sapiens
  misc_feature: GYAE6OF01BF68L.38.26.C04.1.454.CMB.1.raw
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
  modified_base (462)..(462): a, c, t, g, unknown or other
  misc_feature (462)..(462): n is a, c, g, or t
  modified_base (472)..(472): a, c, t, g, unknown or other
  misc_feature (472)..(472): n is a, c, g, or t
  modified_base (538)..(538): a, c, t, g, unknown or other
  misc_feature (538)..(538): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatacttcagctggtgcgacaggcccctggacgaagggcttgagtggagtggggaggactccgtcccgattcgttggacaaaccacactacgcacacagtccagacagactcacgataccgacgacatccacgancacagtacanatggantgagtagctagagactcgagacgacgacggtcgttagtatttcgngtcgcgaggngggagggccgtaggggcgtagggttacgggtacgttagggtcgttcgtttaggattacggttcggngggtaaccgg

SEQ ID NO: 181093 - DNA, 742 bp, Homo sapiens
  misc_feature: GYAE6OF01A49SG.38.26.C04.1.454.CMB.1.raw
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
tcagtcgatcacgtcacgaccggtgctcgatttagtctagcgactttggggtttgggggcagagactctggagaagaggctgctacagttagggacccagagggaaccactgggaaaccccagcgtcagcttctcttcctcctgctactctggcctcccgagataccaccggagaaattgtgttgtacgcagtcctccgaggcaccctgtcttggtctccgaggggaacacgcccaccctctcctgacacgggccagtcagtgttcttagccagactagttaccttagcctggtaccagcagaaacctggccaggcncccaggcctcctcattcgtacggtncctacgtccaggtccgacgggcccacgttggacctacgtccccaaggtaccgtacgggttcgaacggttcgggcctaagggtcgggttcctaaacggggaaactccgttacgaaccttccgtcctacccgagtccacggctaaggaccgtgggacggtcccttaaggtaacgttagttttacggctaaggttcgttaacttacgttcgttaccttaggtaccgttagttaaccgttacgggtaaacccgtaccgtaacccgtaaggtttcccgtaaccggtttaccggtacccccgtttaaggggaaaccccttaaaggggttacgggttaaccgttaacgttaacccgtaaaacccggttaacccgttagggttccggtacccggttcgtaacccccgg

SEQ ID NO: 181094 - DNA, 696 bp, Homo sapiens
  misc_feature: GYAE6OF01EMNX6.38.26.C04.1.454.CMB.1.raw
  modified_base (113)..(113): a, c, t, g, unknown or other
  misc_feature (113)..(113): n is a, c, g, or t
  modified_base (216)..(216): a, c, t, g, unknown or other
  misc_feature (216)..(216): n is a, c, g, or t
  modified_base (294)..(294): a, c, t, g, unknown or other
  misc_feature (294)..(294): n is a, c, g, or t
tcagtcgatcacgtcacgaccggtgctcgatttagtctagcgactttgggtttgggcagagctctggagaagagctgctcagttaggacccagagggaaccatcggaaacccngcgcagcttctcttctcctgctactctggctccagactaccgacggagtaattggtgttgacgctagtcctcgaggctacctgttcttgtctcgagggtaacncgccctacctcgtccgtgcgacgggcctagtacaggacgttcgttagctagcacgtctacgttacgccgtaggtaccngtacaacgtaaccgtcggaccacggtcctaccgaggtccttccgtacacgttccgtacggtcacctacgtccgacgtcgtaacggcctaacgtgaccctaacgtcccgaggtactacggttcgacggtcggacgtcggtcgggtacgtaacggaacgttcgttacctaccgttcgtaccgtccgtacgtacgacgtactacggtacgtacgtacgcgttaagtaacgtttcgttgacgttaggtacttaacgttcgtacgttacgagttacggtaacgttcgttacgtaaccgttccgaacgtttacgtttacccgtacggtttcccggaccgttaacgggtaactaagggttccgaaacgttaaccgtaacgtaaccggttagtcgggtccgtacgtaacg

SEQ ID NO: 181095 - DNA, 699 bp, Homo sapiens
  misc_feature: GYAE6OF01DHEM1.38.26.C04.1.454.CMB.1.raw
tcagtcgatcacgtcacgaccggtgctcgatttagtctagcgactttgggtttggggcagagctctggagaagagctgctcagttaggacccagaggaaccatggaaaccccagcgcagcttctcttcctcctgctactctggctcccagactaccaccggagtaaattgtgttgacgcagtctccgaggcacccttgtctttgtcgtaccgaaggggaaagacgccctaccctctcctgcgacgggccagtcagagtcttagcagcagctacttacgcgtcggtaccagtacaagtaaccgtggaccagggccctacccgaggtcccttccctacgtacgttccgtacggtcgacctacgtaccgaggccgaacggtcccaacgtaccggacctacgtaccccgaaggtaaccgtaacggtttcgacggtcggacgtacgggtacgggttacggtaagggaaactaccgtttaccgtacttcctcgtaccgtacgtccgaagtccgaacggtacgtacggacgtaccgttagtaagttcgtttagacgtagtttacgtacgtttaacgtcgtacgtagtacgtaacggttataccggtaacctcgtaacgttacttaccgtaccggttcccggaccgtaggtaacccgtaaggttacgtaacttaacgtaaaccgtaacgtagttcggttgccgtacg

SEQ ID NO: 181096 - DNA, 182 bp, Homo sapiens
  misc_feature: GYAE6OF01EG6NK.38.26.C04.1.454.CMB.1.raw
  modified_base (174)..(182): a, c, t, g, unknown or other
  misc_feature (174)..(182): n is a, c, g, or t
tcagtcgatcacgtcacgaccggtgctcgatttagtctagcgactttgggtttggggggaagaggaagactgacggtcccccaggagttcaggtgctgggcacagcggccctgggctgcctggtcaaggactacttccacgtgatcgactgagcgggctggcaaggcgcatagnnnnnnnnn

SEQ ID NO: 181097 - DNA, 543 bp, Homo sapiens
  misc_feature: GYAE6OF01DLWP4.38.26.C04.1.454.CMB.1.raw
  modified_base (215)..(215): a, c, t, g, unknown or other
  misc_feature (215)..(215): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtcctttgtctccaggggaangccaccctctcctgcagggccagtcagagtcttagcagcagctattagcctgtaccagcagaaacctggccaggctccaggctcctcactctacggtgcaatccagcacgggccactggcatcccagcaggttcngtggcaggtgggctagggtaaanaccttcactctctcatcagcagactggacgcgtagaagtattttcgactagtagttattactgtacagtcagttataggtacctcgacctattcctacgtttccggtacccgtagggtaaccctaaacggtaggtattaactaaccgtaaacgtacgtcgtcggctacgg

SEQ ID NO: 181098 - DNA, 178 bp, Homo sapiens
  misc_feature: GYAE6OF01ER4US.38.26.C04.1.454.CMB.1.raw
  modified_base (172)..(178): a, c, t, g, unknown or other
  misc_feature (172)..(178): n is a, c, g, or t
tcagtcgatcacgtcacgaccggtgctcgatttagtctagcgactttgggtttgggggaagaggaagactgacggtcccccaggagttcaggtgctgggcacagcggccctggctgcctggtcaaggactacttccacgtgatcgactgagcgggctggcaaggcgcatagnnnnnnn

SEQ ID NO: 181099 - DNA, 529 bp, Homo sapiens
  misc_feature: GYAE6OF01D98YC.38.26.C04.1.454.CMB.1.raw
  modified_base (215)..(215): a, c, t, g, unknown or other
  misc_feature (215)..(215): n is a, c, g, or t
  modified_base (303)..(303): a, c, t, g, unknown or other
  misc_feature (303)..(303): n is a, c, g, or t
  modified_base (312)..(312): a, c, t, g, unknown or other
  misc_feature (312)..(312): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccacggagaaattgtgttgacgcagtctccaggcaccctgtctttgtctccgaggggaaanacgccaccctctctgcagggccagtcagagtctagcagcagctacttagcctggtaccagcaagaacctggccaggctccaggctccnatctaggtncatccagcgaggccagtggcactcccgagacgtggttcaggtgcaggtggtacgagggaactcttcactcctctcatcagcgagactggacgtcctaggtaattagtttgcgttagtgttattacgtgtagagtctagttatagtacctctactattctacgttcggccgtaggaactaggtagtaataacgtacgtaaacgtagttgtgtcgtacg

SEQ ID NO: 181100 - DNA, 630 bp, Homo sapiens
  misc_feature: GYAE6OF01AHISF.38.26.C04.1.454.CMB.1.raw
  modified_base (216)..(216): a, c, t, g, unknown or other
  misc_feature (216)..(216): n is a, c, g, or t
  modified_base (326)..(326): a, c, t, g, unknown or other
  misc_feature (326)..(326): n is a, c, g, or t
  modified_base (550)..(550): a, c, t, g, unknown or other
  misc_feature (550)..(550): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaancgccaccctctcctgcgagggccagtcagagtcttagcagcagctacgttagcctggtaccagcaacgaacctggccaggcctcccgaggcctcctcatccgtacggtcncactccgagccgagggccctaagtcggcctacgtccccgaagaccgtagggttcaggtcggacgtagggtcgggtcgtaagggaactcgtttccaccttctcctccatccgaagtcgagtacgtaggacgtacgtaggtaagttacgtttcgacgttaggttacgttactttacgttcggtacgacgtagttaacggttacgttacggtaacctacgtaccgtntttacccgtaccgttcccggaccgtacgggtaacgtaacggtagtaacttacgtaaccgaaagtcgttaggcgtgtaccg

SEQ ID NO: 181101 - DNA, 513 bp, Homo sapiens
  misc_feature: GYAE6OF01DJVT9.38.26.C04.1.454.CMB.1.raw
  modified_base (214)..(214): a, c, t, g, unknown or other
  misc_feature (214)..(214): n is a, c, g, or t
  modified_base (318)..(318): a, c, t, g, unknown or other
  misc_feature (318)..(318): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (368)..(368): a, c, t, g, unknown or other
  misc_feature (368)..(368): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctcgaggggaanacgccaccctctcctgcaggccagtcagagtctagcagcagctacttagcctggtaccagcaagaacctggccaggctccccgaggcctcctcatcgtacggtncatccagcaggccatggcactcccgagacnggtcaggtggcnggtgggtntagggaaatcttcactctctccatcagcagacgtggacgctagaacgtagttttgctagtgttattactgtacagtctagtatagtactcactattctacttcggtccgtaggactaagtgtatagtacaaacgtatgngntacg

SEQ ID NO: 181102 - DNA, 642 bp, Homo sapiens
  misc_feature: GYAE6OF01D6YUC.38.26.C04.1.454.CMB.1.raw
  modified_base (183)..(183): a, c, t, g, unknown or other
  misc_feature (183)..(183): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctacttagcctggtaccagcagaaacctggccaggcctccgaggcctcctcactccgtacggtgcactccgagccagggcccacgtggccactccccgagaccgtaggttccgaggtcggcgaggtcgggtacgtaggggaaaactccttacgaccgttcctccgtaccagtccgagccaacggtaccgtgggactccgtaaggaacgttattttcggactaggttacgttacttacgtgttacagtacgtaagttagtacggtaacctccactactttccgtacgtttccggccgtaggaactaaggtagacttacgtaacgtaaacgcgttaggacgctacgcctaacgtacgttccgtgttacccttcgtccttcccttacccgcttacgttacgtagaacgttcgacgtaccgg

SEQ ID NO: 181103 - DNA, 198 bp, Homo sapiens
  misc_feature: GYAE6OF01BMHXI.38.26.C04.1.454.CMB.1.raw
  modified_base (177)..(198): a, c, t, g, unknown or other
  misc_feature (177)..(198): n is a, c, g, or t
tcagtcgatcacgtcacgaccggtgctcgatttagtctagcgactttggggtttggggggaagaggaagactgaccggtccccccaggagttcaggtgctgggcacagcggccctgggctgcctggtcaaggactacttccacgtgatcgactgagcgggctggcaaggcgcatagnnnnnnnnnnnnnnnnnnnnnn

SEQ ID NO: 181104 - DNA, 626 bp, Homo sapiens
  misc_feature: GYAE6OF01CDHU8.38.26.C04.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagatacccaccggagaaattgtgttgacgcagtctccaggcaccctgtctttgtctccgaggggaaancgcccacctctcctgcagggccagtcagagtctagcagcagctacttacgcctggtacccagcacgaaccgtggccaggcctcccgaggcctcctcacgtcgtacggtgcactccagtccgagggaccctacgtcggcctacgtcccgaagaccgtaggttcgaggtcggacgaggtcgggtacgtaggggaaactccgttacgaccttctaccgtcctaatccgaacggcctaaggtacgtacggaacgtccgttaggtaagttagttttcgacgttagttcgttagttacgttcgtacgagtactaagttacgtaacggtacctacctaacttacttccgtacggtttcccgtccgtagggtacctaaaggttacgtaatacgtacaaacgtagtcggtcgtctacg

SEQ ID NO: 181105 - DNA, 629 bp, Homo sapiens
  misc_feature: GYAE6OF01BCXZI.38.26.C04.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagngccaccctctcctgcagggccagtcagagtcttagcagcagctacttagcctggtaccagcagaaacctggccaggcctcccaggcctcctcactcgtacggtgcatccagcagggccacgtggacactcccagacaggttcaggtggcaggtgggtctagggaaactcttcacttctctccatacagcagtacgtggacgtccgtagtaagttacgttttgacgttaggttacgtttaacttaccgttgtaccgtaggtacgtaagttacgttacggttaacttaccgtaaccttacgtttccctaccggtttcccggtaccccggttaaggggtaaaccctaaagggttacggtaacttaaacgttaaccgaaaaccggttaacgttacgggttcgggtacccgtaccgg

SEQ ID NO: 181106 - DNA, 700 bp, Homo sapiens
  misc_feature: GYAE6OF01ASTC2.38.26.C04.1.454.CMB.1.raw
  modified_base (125)..(125): a, c, t, g, unknown or other
  misc_feature (125)..(125): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
tcagtcgatcacgtcacgaccggtgctcgatttagtctagcgactttgggtttggggtcgagagctctggagaagagctgctcagttaggacccagagggaaccataggaaacccgagacgacancgttactctcctcctagctactctgcctcccagactaccaccggagtaaattcgtgttgacgcagtcctacaggccaccctgtctttcncgtacaggggaagacnccaccctntcctgcgacgggcccaaggtccagatcgtaggcagcagtctactacgccgtacgtaccacgcacgtaaccgacgtaccgacggtcctccgacgtccgtcctcctactaccgtacggtcacgtacaccgtacgacgacggccaccgtggaccataccccgagtaccgtacggttaccaagggttcgaccgggttaggtcgggtacggtaacggaaacggttacctaccggtaccttccgtacctacccgtacgtaccgaacgtcctaaacggtccgtacggtaccgcgtaacgtaaacggtgttacggtacgtagttacgtaaggttacctagtacccggtataccgtaacggtcgttaacgttaccacgttaactacgttaccgtcgttaacccggtccgtaaacgggtctaaaccgaggtacttaacgtaacgtacgtaacgtcgtaacggtgtaacccgg

SEQ ID NO: 181107 - DNA, 665 bp, Homo sapiens
  misc_feature: GYAE6OF01CD9Y1.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgccaccctcgtcctgcgagggccagtcagagtcttagcagcagctactagcctacggtaccagacaacgaaccgtggacccacggccacccgaggccctcctacactccgtacggtcacatcccgagccgacggcccacgtcgaccacgtcccgaagtacgtaggtttccgaggtcggaccgtagggttcgggtacgtaagggaaactccgttccaccgttcctacctaccgtactccgaacgcgtaacgtacgtcgggtactaccgtagtaacgtagttttcgacgttagttacgttagtttacgtgtaccgtagtacgttagttacgttacgttaacctacctaacctacgtttacgttacccgttaccgggtacccgtagggtaaacccttaagggtacgtagttaactaaccgtaaacggtaagttcggtcggtaccgtaccgg

SEQ ID NO: 181108 - DNA, 671 bp, Homo sapiens
  misc_feature: GYAE6OF01D92IZ.38.26.C04.1.454.CMB.1.raw
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagatacccaccggagaaattgtgttgacgnagtctccaggcaccctgtctttgctccgaggggaancgccaccctctcctgcgaggccagtcagagtcttagcagcagctactagcctggtaccagcaagaacctggaccgacggcctcccgaggccttccctcacgtccgtacggtgctactccgagccgacgggcccacgtcggaccacgtacccgagaccgtaggtttccaaggtcggcgtagggtgggtacgtaaggggtaaacgtacctttcgaccgttccttaccgtacctagtacgacgcaacggtacgtcgggactaccggtagtaacgttagtttcggattaggttacgttacgtttacgtgtcgtaacgtcgttagttacgtacggttaactccgtaaccttacgttacccgttaccgttttcccgggaccggttaaccgggaacgttaaacgggttacgtaacttaacgtaacccggtaaaacggtaccgttcggtcggtccgtaaccgg

SEQ ID NO: 181109 - DNA, 941 bp, Homo sapiens
  misc_feature: GYAE6OF01AFIIH.38.26.C04.1.454.CMB.1.raw
tcagtcgatcacgtcacgaccggtgctcgatttagtctagcgactttgggtttgggcgagagctctggagaagagctgctcgagttacggacccagacgggaaccatcggaaaccccagccgctaggcctttctccttcctcctgccttacttcttgggcctcccagactacccgaccggagaaattgtcgttcgaccgcaggtcctccgaggcctacccgttgttcgttttacgtctaccggaaggggaaagacgcccgtacccgttctccgtggaccgacggggaccctacgtccgaaggtacgttaccgtttaacggcgaaggtacctacggtacccctttaacggtttaaccggtcccgttacgggtaacccaacggtaccgaaacggttaaaaccccgtcggggaccccgtaaccggtccccgtacccccggaagggtacccttcccgtacgtaacgttccggtaaccgggtcgtaccgtacgttcccgaaggccggtacgggtaccctaagtacggaccctaaccgtacccgaggtaccgtaagggttaccgagggttccgggacgtacggggttcgggttaccgtaacggggtaaacctttcccgttaccgtacctttaccgtacccgttaccacgttaccgaacggtaccgtaaccggtaccggttaacggaccgggttacccgttaagggtaacggttttacgtttcccggtacgttaagtttccggtttaaacgttccgtacgggttaacccggtagttacggttaagtttacccggtaacggttaaccctaccggtaccggtttacgttaccccggttacccgggtttaccccggtaacccgggttaagggttaaacccggtaaggtttacggtaaacgtttacgtaaaccgggttaaccggtacggttcgggtaacgggcccgtaaccg

SEQ ID NO: 181110 - DNA, 886 bp, Homo sapiens
  misc_feature: GYAE6OF01D0NIU.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaacctggccaggcctccaggctcctcatctacggtgcatccagcagggcccacgtcggcactcccgagaccaggttcaggtcggctagggtcgggtacgtaggggaaaacgtaccttaccgaccttctcctaccgatccgaggaccaaggaccgttcgggacgtccctaaggtaaagttacgtttttacgggaccgtaagggtttacgtttaacgtttaaccgttacggttaccgtaacgggtaccgttaaaggtttaacggttaccggggtttaaacccttacccgttaaaccccgttaaccgttttaccccgtttaacccggtttttcccccggggtaaccccccggtttaaccggggggttaaaccccgttaaaaacggggttttaccggggtaaaacgttttaaaccggttaaacccggtaaaaaaccgggttaaacccgtttacggggttaccggggttaaccgttaccgggtaacccctaaacccgttaaccgttttacccggttaccggttttaccccttttacccgttaacccgtttacccccggttttaccccccggaaccccgtttaaccgttaaccccggtttaacccgggttaaacccgggtttccggtaacccgtttaaccccgggg

SEQ ID NO: 181111 - DNA, 640 bp, Homo sapiens
  misc_feature: GYAE6OF01B07AT.38.26.C04.1.454.CMB.1.raw
  modified_base (349)..(349): a, c, t, g, unknown or other
  misc_feature (349)..(349): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaaggcttctggaggcaccttcagcacctatactttcagctgggtgcgacacggcccctggacaagggtcttgagtggagtgggaggctcccgtccgatcttggacaaccncactacgcacacaacgtccagacagactcgacgattaccggacgacgaactccgaacggacgaccacacgtacctaacgagttaggacgagtaggagtacgccgtagacgaacttcgtacgaaccgacgacgggtacccttagtttactttcgtcggtgaccggtaggacgggtaacgggggcccgaaggggggtccgttaccgggggttaagggttaaaccgggtttaggggttcggtttaccggtttttaggaaagtttacggttccgggtacggggggtaaacccggg

SEQ ID NO: 181112 - DNA, 772 bp, Homo sapiens
  misc_feature: GYAE6OF01E1AF2.38.26.C04.1.454.CMB.1.raw
  modified_base (286)..(286): a, c, t, g, unknown or other
  misc_feature (286)..(286): n is a, c, g, or t
  modified_base (330)..(330): a, c, t, g, unknown or other
  misc_feature (330)..(330): n is a, c, g, or t
tcagtcgatcacgtcacgaccggtgctcgatttagtctagcgactttgggtttggggcagagctctggagaagagctgctcagttaggacccagagggaaccatcggaaaccccagcgcagcttctcttcctcctgctactctggcctcccagactaccaccggagaaatttgtgttgacgcagtcctccaggccaccctgttctttgtctccgaggggaaagacgcccaccctctcctgcgacgggccagtcagtgtcttagcagcagctactagcctggtaccngcagaacctggccagcctaccgagtcctcctcatccgtacggtncactccagccgacgggcccacgtcggaccacgtcccgaagtaccgtacgggtttacacgggtggaccgtagggttcgggttaccgtaggggtaaaactcccttacgaccttcctaccctaccgacgtaccgacgtaccgtaaggtaccgttacgggaccgtaccgtaggtaaacggttacgttttacggacgtttaacgttacgtttaacgttttaccgttacggttaccgaacgttacgttaacggtttaaccgtttaacggttaaacccttacccgttaacccgttaacgtttttacccggtaaccccggtttttacccggggaacccccggttttaaggggaaaccccgttaaaacgggtttacgggtaaacctttaaaccgtaaacccgtaaacccgggttaaaccgtttccggggttaacggtacccgttaacccgg

SEQ ID NO: 181113 - DNA, 726 bp, Homo sapiens
  misc_feature: GYAE6OF01D9NWK.38.26.C04.1.454.CMB.1.raw
  modified_base (228)..(228): a, c, t, g, unknown or other
  misc_feature (228)..(228): n is a, c, g, or t
  modified_base (719)..(719): a, c, t, g, unknown or other
  misc_feature (719)..(719): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagactaccaccggagtaaattgtgttgacgcagtctccgaggccacccttggttctttcgtcctaccgaaggggaaacncgcccacccttctccgtgacgacgggccagtcgagtagtcttagcaggcagtctacgttacgccgtacggtaccagacaacgtaaccgtcggccgacggcctccgacggtcctaccgtacacgttccgtacggctccactaccgacggccgacggccacgtcggcctaccgtaccgaagacgtcggttacgaggtcggacgtacgggtacgggtacggtaacgggtaaacgtcctttaccgtacgttcccggtaccttaaccgtacgttaccggaacgtcccggtaaaggtacccggtacgggtaaccgtacccggttaaggtaaccgttttacgtttcggaacgtttaggttacgtttaacgttacggtagttacgacggttaacgtaacggttacgtaacccgtactaccgtaacgttcctaccgttaccgttccggaccgttacggaacggtaagtacggtactaacgtactaacgtagtagtcggtntacccgg

SEQ ID NO: 181114 - DNA, 573 bp, Homo sapiens
  misc_feature: GYAE6OF01EV23C.38.26.C04.1.454.CMB.1.raw
  modified_base (388)..(388): a, c, t, g, unknown or other
  misc_feature (388)..(388): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggcctcccgaggcctcctcatcgtacggtgcactccagcacgggccacgtggcactcccagcaggttcaggtgacgtaggtgggtctagggaaacgcttcactctctcatcagcagcgtggagcctagatntttgacgtagtcgtattactgtacagtctagtagtacgtactcactacttcgtaccgtttcgaccgtaggaacgtaaggtgtaatagtaacgtaaacgtatacgtcgactcgtaccacgtactcgtacgttcttactacttcccgttcccgtacctacttaccgtacgtaacggtgtacgtccgg

SEQ ID NO: 181115 - DNA, 719 bp, Homo sapiens
  misc_feature: GYAE6OF01DGZGD.38.26.C04.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagataccaccggagaaattgtgttgacgcagtctccaggcaccctgtctttgtctccgaaggggaancgccaccctctcctgcagggccagtcagacgtctagcagcagctacttacgcctggtaccagcaagaaacctggaccaggcctaccccgaggtcctcccgttacacttaccgtaccggtacgacactccgaagccgacgggcccagtcggacaccgtcccaaggtacctagggttacaacggtggacgtagggttcgggtacgtaacggggtaaagtacctttcgaaccgttcctactaccagtcacggcacgtaacgtaggacgtccgtaggtaagttagttttcgacgttaacgttagtttaacgttaacgtacggttaactacggtacgttaaggttaacgttacgggttaacctaccgtaaacccttacgtttacccgttaacccggttttacccgggtaaccccggtttaggggtaaacccgttaaagggttaccggtaaacttaaaccgttaaccggtaaaaacgtaccggttaaggtaccgggtccgtaaccggg

SEQ ID NO: 181116 - DNA, 680 bp, Homo sapiens
  misc_feature: GYAE6OF01AUIRW.38.26.C04.1.454.CMB.1.raw
  modified_base (212)..(212): a, c, t, g, unknown or other
  misc_feature (212)..(212): n is a, c, g, or t
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
  modified_base (500)..(500): a, c, t, g, unknown or other
  misc_feature (500)..(500): n is a, c, g, or t
tcagtcgatcacgtcacgaccggtgctcgatttagtctagcgactttgggtttgggcagagctctggagaagagctgctcagttaggacccagagggaaccatggaaaccccagcgcagcttctcttcctcctgctactctggctccagataccaccggagaaattgtgtgacgcagtctccaggcaccctgtctttgtctccgagggaagngccacctctctgcgaggccagtcagagtctagcagcagtctacttgcctggtaccngacaagaacctcggacctacggcctccgaggctcctacattcgtacggtcnctacgtcccagaccgacgggccacgtcgacctacgtacccgagaccgtagtcgtagggtcggactaggggtcgggttacgtaacgggaaaacttcttaccgtaccttccgttacctacccgtactccgaacgtaccgtaacggtccggtacgggaccgtaccggttaaggaaacggttttnttttacggacgttaaggtttcgttaaacttcgttacgtcgaacggtacgttaaggttacgttacgttaacctacgtaaccttacgttcccgttaccggtttaccggaccggtttacggaaaccgtaaggttacggtaactaaccgtaacgtaaacggtaagttcgggtacgtcgtaaccg

SEQ ID NO: 181117 - DNA, 550 bp, Homo sapiens
  misc_feature: GYAE6OF01BUM2I.38.26.C04.1.454.CMB.1.raw
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
  modified_base (375)..(375): a, c, t, g, unknown or other
  misc_feature (375)..(375): n is a, c, g, or t
  modified_base (463)..(463): a, c, t, g, unknown or other
  misc_feature (463)..(463): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaacggtcccctgcaagggcttcgtggaggtcaccttcagcacctatactttcagctgggtncgacaggcccctggacaagggcttggacgtggatgggaggatccgtccgatcttggcaaccncactacgcacacagtccagacagacncacgattaccgcggacgatccacgagcacagtcacatggagatgagtagccctgagctgtcgacgacgacggtccgttgttattccgngtcgcgagaggacgggggtccagggggtcttcgggtacgggttaacggttgggtcgttactttggattacgtcggttggggaaccgg

SEQ ID NO: 181118 - DNA, 621 bp, Homo sapiens
  misc_feature: GYAE6OF01A95TK.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgagggaagcgccacctctcctgcagggccagtcagtagtctagcagcagtctacttagcctggtaccagacaacgaacctggaccaggcctcccgaggtcctcctcacgttcgtacggtcacacgtccgagcgacgggccacgtcggaccacgtacccgagaccgtaggttacgaggtcggactagggtcggtacgtaagggtaactcttaccacttcgtacctcgactcgacgacgacgtacgtcggactcgtagtagttactttcgatagttacttactacgtgttacgagtacgtaagttacgttacgtacctacgtaccttacttccgtaaccgtttccggacccgttaggtaaccgtaaggtacgtaacgtacgtaaaccgtaacggtacgttacggtcgtaccgtaccg

SEQ ID NO: 181119 - DNA, 674 bp, Homo sapiens
  misc_feature: GYAE6OF01DYZZO.38.26.C04.1.454.CMB.1.raw
  modified_base (213)..(213): a, c, t, g, unknown or other
  misc_feature (213)..(213): n is a, c, g, or t
tcagtcgatcacgtcacgaccggtgctcgatttagtctagcgacttttgggtttggggcagagctctggagaagagctgctcagttaggacccagagggaaccatggaaaccccagcgcagcttctcttcctcctgctactctggctcccagataccacggagaaattgtgttgacgcagtctcaggcacctgtctttgtctccgagggaaancgccacctctcctgcgacgggccagtcagagtctagcagcagctacttagcctggtaccagacaacgaaccgtggaccacggtcctccgaggtcctccgtcacgtccgtacggtcgcactaccgagtcgacgggcctacgtcggacctacgtcccgaagtaccgtaggttcaagggtcgacgtagggtcgggtacgtaaggggtaaactccttacgtacttccgtacctacctagtaccgaacgacgtaacgtacgtacggacgtaccgttaaggtaacgtttctttacggacttaggttactttaacgttaacgtgtaacgaggttacgttaaggttacgttaacggtaaccttaccgtaactttacgttaccgttaccggtttcccggaccgttaacgggaacttaaagggttacgtaacttaacgtaaccgaaaaccgttgtacggtgtccgtaaccg

SEQ ID NO: 181120 - DNA, 718 bp, Homo sapiens
  misc_feature: GYAE6OF01EJS15.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccagggggaaagagccaccctctcctgcagggccagtcagagtcttagcagcagctacttagcctggtaccagcagaacctggccaggctcccaggcctcctcatctacggtgcatccagcacgggccactggcatcccgagaccaggttcaggtggcaggtgggtctgggaaagtacttcactctctcatcagcagacgtggacgccgtagaagtattttggactagttacgttattacgtgttaccaggtactaagttagttacggttaacctaccctaaccgtaacttttaccgtaacccgtttttccggggtacccccgttacgggggaaccccttaaaagggttacgggttaaacttaacgttaaccgtaaaaaacccggttaaccgttacgggttacgggtaccgtacgggtacctaaccccgtaattacccgtttacggtttaccctttacccgttacccttccccgttttaccccccggaccccttaacgtttaccccgtttaccgggttaaaccggttggttaaccgttaaccccggg

SEQ ID NO: 181121 - DNA, 623 bp, Homo sapiens
  misc_feature: GYAE6OF01CCGNH.38.26.C04.1.454.CMB.1.raw
  modified_base (182)..(182): a, c, t, g, unknown or other
  misc_feature (182)..(182): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (424)..(424): a, c, t, g, unknown or other
  misc_feature (424)..(424): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtcttgtctccgaggggaaangcccaccctctcctgcagggccagtcagagtctagcagcagctacttagcctggtaccagcaagaacctggcccaggcctcccgaggcctccctcattccgtacgggtgaccactcccaggccgacggggcccacgtcggaccactcccgagacacgggttcagtggctaggtgggtcgtagggaaatccttcgacctctcctcatccngcacgcgtggacnctagatatttggactagttnttacttcgtcgtacgtagtacgtagttacgtaggtacctcgtaaccttattacccgtaccgtttccggacccgttacgggaactaaggtacgaacttacgtaacgaacgttacgtggtacgtctcgacacctagttcgtcttccttactccttcccgttacccgacttacgttacgtaacggtacgtcgtacgtaccgg

SEQ ID NO: 181122 - DNA, 710 bp, Homo sapiens
  misc_feature: GYAE6OF01E0HUB.38.26.C04.1.454.CMB.1.raw
  modified_base (184)..(184): a, c, t, g, unknown or other
  misc_feature (184)..(184): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (349)..(349): a, c, t, g, unknown or other
  misc_feature (349)..(349): n is a, c, g, or t
tcagtcgatcacgtcacgaccggtgctcgatttagtctagcgactttggggtttgggggaagacaatgggtttgatttagattacatgggtgactttttctgttttatttccaatctcagataccaccggagaaattgtgttgacgcagtctccaggcaccctgtctttgctccgaggggaaancgccaccctctcctgcagggccagtcagagtctagcagcagcttactagcctggtaccagcaagaaccctggccaggcctacccgagtcctccncacttcgtacggtnacactccagcacgggccacgtggccacgtcccaagaccgaggtttccaggtcggganacgggttcgggggttacgtaagggggtaaactccttacgacttcccgtcctacctgtacagcccaagggtaccgtgggaaccgccgttaaggaagtttcgttttagaccgttagtacgtttactttaccgtcgtactagtacgtagttaacgtacggtaacctaccgtaacctgtttaccgtaccgtttcccggacccggttagggtaacccgaaggttaggaacttaaccgaacgtaaaccgtacgttcggtaccggtctaccggacctccgtaaacgttccgttcgttaccttaccgtacctttacccccgtaccctaccgtacgttaccgttaacggacgttacggtccgttaccggg

SEQ ID NO: 181123 - DNA, 683 bp, Homo sapiens
  misc_feature: GYAE6OF01CCDSE.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctcgaaggggaaagagcccaccctctcctgcgacggggccaggtccaaggtagtcttaggcaggcagctacgttacgccgtaggtaccaggacaacgaaacctcgggccaaggcctaccgaggtcctcctacacttcgtaacgggtcgaccatacccgaggacgacgggccaacgtcggacaactcccgagaacgacgggtttcaggtggacgtaggtcgggtacgtaggggaaactccgttcacgtcctactcctagtacgacgtacgaacgacgtcggacgccgtaggaacgtagttttagacttaggttagttaactttacgtacgtacgaacgtacgttaaggttagttaacggtaactaccgtaaccttacgttacccgttacggtttacccgggacccgttacggggaaaccgtaaaggttaacggtaattaacgtaaaccgtaaaacgtaaccgttggtaccggttcgtaaccg

SEQ ID NO: 181124 - DNA, 639 bp, Homo sapiens
  misc_feature: GYAE6OF01DMFEC.38.26.C04.1.454.CMB.1.raw
  modified_base (183)..(183): a, c, t, g, unknown or other
  misc_feature (183)..(183): n is a, c, g, or t
  modified_base (278)..(278): a, c, t, g, unknown or other
  misc_feature (278)..(278): n is a, c, g, or t
  modified_base (357)..(357): a, c, t, g, unknown or other
  misc_feature (357)..(357): n is a, c, g, or t
  modified_base (392)..(392): a, c, t, g, unknown or other
  misc_feature (392)..(392): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccgaggggaaanagccaccctctcctgcagggccagtcagagtctagcagcagctactagcctggtaccagcagaacctggccagcctccagctcctcatccgtagnctatccagccaggccagtggcacaccgagactggtcaggtggactggtggtacgtaggaaactcttaccgactccgtcnccatcagacacggactgggactccgtagaaagttntttcggactaggttacgtaattacgttgtacgagtacgtaagttagtacggtaacctccaaccttaacttcctaccgtttccggacccgttagggaaccctaaggtacggtaattaccgtaacgtaaaccggtacttgggtacgactaccggacctaaccgtattccgttagttacccttactacccgttccccgttaccccgaccttacgttaccgttaccggtaaccgtgtacccgttacccggg

SEQ ID NO: 181125 - DNA, 703 bp, Homo sapiens
  misc_feature: GYAE6OF01E4CBJ.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanacgccaccctctcctgcagggccagtcagacgtcttagcagcagctacttagcctggtaccagcagaacctggccaggcctccaggctcctcatctacggtcgcatccagcgacgggccacgtcggaccactcccgagaccgtaggttacacggtcggacgtagggtcgggttacgtaggggaaacgtaccgtttaccgtaccgttccgttaccgtacccgtaagttacccgaagaccgaacggtaccgtacgggtaaccgaccgttaggtaaacggttacgttttacggcttaaggttcgttaacgtttacgttacggttaccgacggtaccgtaaggttaacgttacgggtaacccttaccgtaaccctacgttttacccgtacccggttttacccgggtccccggttaacggggtaaacccgtaaagggttacgtaaacttaacggtaaaccgaaaccggtaacgttcggttacggccttacggg

SEQ ID NO: 181126 - DNA, 750 bp, Homo sapiens
  misc_feature: GYAE6OF01E58Y3.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggagttctctttgtggtgcagcagctacaggtgtccagtcccaggtgcagttggtgctagtcgtgggctgaggtgaagagccgtgggtcctcggtagaacggtcccctgacgaaggtctttcgtcgggacggcctaccttcgagcctaaccttacttaacctttcaggtcgtgggtcgcggacgtacggccccgtaggaccgaagggtccttaggaggtagggtacggtaggggtacggacttcccgtacccgtaagtttccgttacggaaccaaaacccgacgaaccgtaacgacctaaccgtaacgtaaaccggtttcccgaacggtaacctaacggtacccgtaacgtaaccggtaaccgttaaacccgggaccggtaaacccgtaacgtaccccgaacggaacgtaccgaaccgtaaccgtacgtaacgtagtacgggagtaacggtacggtaacgtacgtaccgtacgaagtacgtacgtacgacgtaccgtacgggtccgttagttacgttacgtggtaggacggaggacgggacggggtccggtaggggtcgttacgggttcggttacggttagttaggtacgttttagaccgttaggtccggtgggtaaacggg

SEQ ID NO: 181127 - DNA, 776 bp, Homo sapiens
  misc_feature: GYAE6OF01CIN5D.38.26.C04.1.454.CMB.1.raw
  modified_base (216)..(216): a, c, t, g, unknown or other
  misc_feature (216)..(216): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccgaccggagaaattgtgttgacgcagtctccaggcaccctgtctttgtctccgaggggaanacgccacctctcctgcacgggccagtcagtagtcttagcagcagactacttacgccgtaggtaccagtcaacgaaaccgtcggccgacggcctacccgacggtcctcccgtacactaccgtacggtcgtctactccgacgcgacgggccctacgtcggacctacgtcccgagtaccgtaggtcgaaggtcggccgtagggttcgggtacggtaacggggtaaacgtacctttaccgaccgttacctccgtacctacgtcccgacggtaccgtaaacgggccgttacgggtaaccggtccgttaaaggttaaacggtttacgtttttacggacggttaaggttttacgttaactttcgttaacggttacgttaacgggtttaaggttaacggtttaaccggttaaaccttcccgtaaccgtttacccgtttaccggttacccggtttaacccgggtacccggttaaccggggtaaaccttaaaagggttccgggtaaacttaaacggtaaaccggttaaaccgttaacggttaggttaaccggtccgttacgggtaacccc

SEQ ID NO: 181128 - DNA, 752 bp, Homo sapiens
  misc_feature: GYAE6OF01A06QX.38.26.C04.1.454.CMB.1.raw
  modified_base (296)..(296): a, c, t, g, unknown or other
  misc_feature (296)..(296): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtgggctggaggtgaagagccgtgggtcctggtgaacggtcccctgacgaaggtcttcgtggagcctaccttcagccaccttattacctttcgagtcgtgggtnaccgacgcggccccgtggaacgagggtcttaggaggtggaggtggggacggtactcccgtaccgtacgttcgttacggaccaaaccgtacaaccgtaccgacctaacgaacccgttaacggttacccgaaacggaccgtaacgtaccctaccgaaccggtaaccgttacccggaccgggtaaaccgaacctacccgaacggtaccgaccgtaacgtaaccgttacgtaaccgtaagtacgggtaagtacggttaggaaacgtaaccgtccgtaagacgtacgtcgtacgaccggtaaccgacgggttccgttagttactttcgacggttcgacggtagggtaccggggacgggggtccgtacggggggttcgtacggggttaacgggtttaacccgggtttaggtttacggtttcggttttagtaaggttcggttacggggtacggggtaaaccgg

SEQ ID NO: 181129 - DNA, 571 bp, Homo sapiens
  misc_feature: GYAE6OF01BDKXS.38.26.C04.1.454.CMB.1.raw
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagtcgatcacgtcacgaccggtgctcgatttagtctagcgactttgggtttgggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggccaccttcagcacctatactttcagctgggtgcgacacggcccctggacaagggcttggagtggagtgggagggtactcccgtcccgtagtcgtttaggccaaaccgacactacgcacactaagtccgagacagactacacgacgttaccgcggacgaatccgaacgacgacaacgacgtactaacacgttcggaagagtagagtacgcctagacgagtcgcgacgacgaccggtccgtgttacttcgtgtgcgaggnggacggggacgngggcgtcgggtaggtacggttaggtgttcgtttagatgtcgtgggtaacgg

SEQ ID NO: 181130 - DNA, 653 bp, Homo sapiens
  misc_feature: GYAE6OF01A7WXF.38.26.C04.1.454.CMB.1.raw
  modified_base (213)..(213): a, c, t, g, unknown or other
  misc_feature (213)..(213): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtcttgtctccgagggaanagccacctctcctgcgaggccagtcagtagtcttagcagcagtctacttagccgtggtaaccagacacgaaaccgtcggccaggtccctacccgaggcctccctcacgttccgtacggtcgacacgtccgaacggccgtacgggccaacgtcggacctacgacccgacgacgtacgttcggagttcggacgtaggtacgggtaccgtaagggaaacctccgttacgaccttaccgtacccgtactcgtacgacggtccgaacgtacggtcgtaacgtccgtaagtacgtaattcggaacgtagttagttaacttccgtagtaccgtagtacgttacgtaacgtcggttacaccgtaccgtacttacgttcccgtaacggtccccgtaaggacccttaaagcgttaacgaagtaaccaccggtaatccggtcgtcgtaccg

SEQ ID NO: 181131 - DNA, 600 bp, Homo sapiens
  misc_feature: GYAE6OF01COWZD.38.26.C04.1.454.CMB.1.raw
  modified_base (315)..(315): a, c, t, g, unknown or other
  misc_feature (315)..(315): n is a, c, g, or t
  modified_base (401)..(401): a, c, t, g, unknown or other
  misc_feature (401)..(401): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctccagactaccgacggagaaattgtgttgacgcagtctcgaggcctaccctgtctttgacctccgaagggaacgacgccacctcgtcctggacacgggcagtcagtagtctagcagcagtctagtacgcctggtacacgacacgaacctgacgtacgctccgacgtctcncgtactcgacgtgcaactccaagtcgacgggccacgtgcactacccgagacgtagttcaggtgactaggtcggtacgtaggaaacnctacgactctactcatccgagtcaggtacgtgaaccgtcgtagtaacgttgttagacgtaggttacctagtttcccgtagtacgtagtcgtaagttagtaccggtatacccgttaaactctttaaccgtccggttaccgtccggtataacccggtaggttacgactaaccgtaacgaacgtaatcggtaagtctaaccg

SEQ ID NO: 181132 - DNA, 583 bp, Homo sapiens
  misc_feature: GYAE6OF01AW2V6.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagcgccaccctctccgtgcgacgggccagtcagagtcttagcagcagctacttcgcctggtaccagacacgaaaccgtcggccacggcctcccgacggctcctcactcgtacggtgcactccgacgcgacgggccacgtcggcactcccgagacgtagtcgaggtcggcgtggtgggtacgtagggaatcctcactctactctactctacgcgacgacgtcggacgccgtagtaagtagtttcgagtagttcgttattcgtacgtacgagtacgtagttactaggttacctctactcttactccggtttaccggccgtacggaacgtacggtacgtataacgtaacgtaaacgtagtcggtgtctaccg

SEQ ID NO: 181133 - DNA, 616 bp, Homo sapiens
  misc_feature: GYAE6OF01AR85B.38.26.C04.1.454.CMB.1.raw
  modified_base (241)..(241): a, c, t, g, unknown or other
  misc_feature (241)..(241): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctactagcctggtaccngcagaacctggccaggctcccaggctcctcactctacggtgcatccagcgaggccactggcactcccagacaggttcagtggcgaggtgggtacgtagggaaagtacttcacttcgtctaccatcgagcagacgtggacgcgtagtagtattttgctaagtgttagttctaggtactagacgtagtagttggtaacctacacctacttccgtacgtttccggacccgtacgggtaaccgtaacggtacggtactaacgtacctaaacgtaacgtggtacggcgtcgtacctacccgtaagtccgttcgttaccttacctcgtcccctttacccggacctacgttacgttaaccgaacggttcgtagtaacccggg

SEQ ID NO: 181134 - DNA, 723 bp, Homo sapiens
  misc_feature: GYAE6OF01D77DI.38.26.C04.1.454.CMB.1.raw
  modified_base (185)..(185): a, c, t, g, unknown or other
  misc_feature (185)..(185): n is a, c, g, or t
  modified_base (282)..(282): a, c, t, g, unknown or other
  misc_feature (282)..(282): n is a, c, g, or t
  modified_base (667)..(667): a, c, t, g, unknown or other
  misc_feature (667)..(667): n is a, c, g, or t
tcagtcgatcacgtcacgaccggtgctcgatttagtctagcgactttgggtttggggggaaggacaatgggtttgatttagattacatgggtgacttttctgttttatttccaatcctcagataccaccggagaaattgtgttgacgcagtctccgaggcaccctgtctttgtctccaggggaanagccaccctctcctgccaggccagtcagagtcttagcagcagctacttagcctagtaccagcaagaaacccgtggccaggcctccgaggtcctcctnacttccgtacgtgacactcagcagggccacgtcgctactcccagtaccgtaggttccgagtcggactaggtcgggttacaggggtaaactccttcgacttcctcgtacctacgtacgagtccgtaacggtacggtggtaaccgacccgttaaggtaacgtttacttttaggaccgttagttacgttaacgttacgtagtacgtaacggtacgtaagttaacggttaaccggttaaccttaccgtaaccttacgtttacccggttacccgtttacccggtaccggtacggtaaacgtaaggtacgtaactaacgtaacgtaaaccgttacgttcggttacggacgttacccgactaaaccgttcgttacgttacggttccttaacncccgtttaccctcccggaacttacggtaccttacggtaacggtcgtacgttaccgg

SEQ ID NO: 181135 - DNA, 735 bp, Homo sapiens
  misc_feature: GYAE6OF01AZL57.38.26.C04.1.454.CMB.1.raw
  modified_base (116)..(116): a, c, t, g, unknown or other
  misc_feature (116)..(116): n is a, c, g, or t
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (597)..(597): a, c, t, g, unknown or other
  misc_feature (597)..(597): n is a, c, g, or t
  modified_base (722)..(722): a, c, t, g, unknown or other
  misc_feature (722)..(722): n is a, c, g, or t
tcagtcgatcacgtcacgaccggtgctcgatttagtctagcgacttttgggtttggggcagagctctggagaagagctgctcagttaggacccagagggaaccatcggaaaccccngcgcagcttctcttcctcctgctactctggcctcccagactaccgaccggagaaattgtgttgacgtcagtctccgaggccacccttgtctttcgtctaccggaaggggaaacacgccctaccccttctccgtcggacgaccgggtccagtacaggtacttcgttacgacgacgacgacgtacttaacgttcggtacccgtacggtaaccgagaccgaacggtaaaccgtcggacccgaggccctaccggacgtcctaccnctactcgtacggtcgactacnccgaggccgtacggaccaggtccgaccgaccacgtaggtacgtacggtcgtaggtcggacgggttaggttaccgggagtaacggtaacgttacccttaccgtacgtcccgtaaccgtcgtacgtaccggataccggaacgccggtaaggtccgacggttaacttaggttccgttagacgttaagttccgtaagtttcgngtacgtacgtaggttaacgtacgtactacccgtaccttccttacgtacccgttaacccgggttccgggaaccgtacggtaaacggtacggttataaacttacccgtaacggtaacacggggttancgttacgtacccg

SEQ ID NO: 181136 - DNA, 699 bp, Homo sapiens
  misc_feature: GYAE6OF01B96OH.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctccgaaggggaaagcgcctaccctctcctgcgagggccagtcagagttctagcagcagtctactgcctggtaccagcagaacctggaccaggcctccgaggtcctacctcactcgtacggtcacactccgagcgacgggccacgtcggactacgtccgaagtacgtacggtcagggtcggcgtagggtcgggtcggtaagggaacttaccgttacgaaccttccgtacctaccgacgtacacggactaggtaccgtagggaccgtccgtaagggttaagttacgtttacggtacgttaggttcgtttaagttccgtaagtaccgtagtacgttaaggttaacgttacggttaacctaccggtaaccttacgtttacccgttaaccgggtttcccggtaacccgggtttaccggtaaaaccgtaacggggtttaacgtaaacgttaaccgtaaaccggtaaaaccggttaggttacgggtcggttaacccgttaacgg

SEQ ID NO: 181137 - DNA, 598 bp, Homo sapiens
  misc_feature: GYAE6OF01D15NI.38.26.C04.1.454.CMB.1.raw
  modified_base (289)..(289): a, c, t, g, unknown or other
  misc_feature (289)..(289): n is a, c, g, or t
  modified_base (394)..(394): a, c, t, g, unknown or other
  misc_feature (394)..(394): n is a, c, g, or t
  modified_base (416)..(416): a, c, t, g, unknown or other
  misc_feature (416)..(416): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccacctctcctgcagggccagtcagagtctagcagcagctacttagcctggtaccagacagaaaccctggccaggcctcccaggctcctcactctacggtgcacncagcaggccactggacactcccagacgaggttcaggtggcaggttcggacgtagggaaacgcttccactctcctacatcagcaggactggactccgtagtaagtntttgctagtcgttattatgtanagcaagttagtacggtactctaactagttcctaccgtttaccgccgtacggaacaacgtagataacacgtaaacgtaagtcggtagcgtcgacctacgtagttaccgtcgttaccttaccgtacttaccccgtccccgtaaccgtacttaccgttacggtaaaccgttgtaccgtaaccggg

SEQ ID NO: 181138 - DNA, 741 bp, Homo sapiens
  misc_feature: GYAE6OF01DQMC7.38.26.C04.1.454.CMB.1.raw
  modified_base (164)..(164): a, c, t, g, unknown or other
  misc_feature (164)..(164): n is a, c, g, or t
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttcctcttcctcctgctactctggctcccagataccaccgganaaattgtgttgacgcagtctccaggccaccctgtctttgtctccgaggggaaancgcccaccctctcctgcacgggccagtcagngtcttagcngcagctacttagcctggtaccagcaagtaaacctggaccaggcctccgaggtcctcctacacgttccgtaacggtcgactactcccgaggcccgaacggggccctaacgttcggggacctaacccgtacccgtaaggaacccgttaggggtttaccgaacgggttcgggtaccggtaaggggtttccggggtacgttaacgggggaaaaacttcccgtttacgacccgtttacccgtccgtttaaccccagttacccgaacggtacctaacggtaccgttagggaccgtacccgttaagggtaaacgttttcgtttacggaacgttaggtttaacttacgtttacgtacggtacctaggtacctaagggtttacttaacggttaccaccgtaacttcgtccttaaccgtttcccgggacctaacgggtaaacttaggacgtaacttaacgtaaccgtaaacgtcgttcgggtcgtccgtaacg

SEQ ID NO: 181139 - DNA, 743 bp, Homo sapiens
  misc_feature: GYAE6OF01DN56H.38.26.C04.1.454.CMB.1.raw
  modified_base (113)..(113): a, c, t, g, unknown or other
  misc_feature (113)..(113): n is a, c, g, or t
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
tcagtcgatcacgtcacgaccggtgctcgatttagtctagcgactttgggtttggggcagagctctggagaagagctgctcagttaggacccagaggaaccatcggaaacccngcgcagcttctcttcctcctgctactctgctccagactaccacggaagtaattgtgtgacgcatctcagccacctgtcttcgctacgaagggaaancgcctacctntccgtgcgacggtccaagtcagtagtctagcagcacgtacttaactcgacctacggtaaccagacctaacgaaccgtggaccaacggtcctaccccggaaggtcccttcctacgtacgttacggtacggtacaacctacgtaccgagtacccggaacggtacctaacgaccggtaccaacgtaacccgaaggaacttacgggtacgaacggttggaaccggtagggtttacgggaacgtaaggggtaaaccttacctttacgaccttttacccacctaccgtaagtccgtaacgactaacgggtacgtacggaacgtcgtaaagtaccgttagtttccgagttagttaccgttaagttctaacggttcgaacgttacgtaaggtttaataaccggttacctaacgtacccggtttacttacccgggttaccttaccggggaccggttaaacgtaaacggttaggtaacgttaaaccgtaaccgttaaaacggaaacggttaactccggtaacgtccgtaaaccg

SEQ ID NO: 181140 - DNA, 821 bp, Homo sapiens
  misc_feature: GYAE6OF01CSL86.38.26.C04.1.454.CMB.1.raw
  modified_base (215)..(215): a, c, t, g, unknown or other
  misc_feature (215)..(215): n is a, c, g, or t
  modified_base (260)..(260): a, c, t, g, unknown or other
  misc_feature (260)..(260): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaancgccaccctctcctgcgacgggccagtcagacgttctagcagacngtaccttacttacgccgttaggtaacccaggaccaacggtaaacccgtcgggacccacggtccctaccccggacggtcctcccgttaccacttccggttacggtacgacctacttacccgacggccggaaccggggccctaacggttccggacctaacccgtaccccggaaaggtaccgttacgggtttaccgagggttcggacgtagggttacggggtacgtaacggggaaaacttccgtttacgtaccgttccgttacctcccgtaacgtaccgacggtaccgtaacggtaccggtacggtaccggtacccgtaaggttaacggttagttttcggaacgttaggttaacgtttacgtttacgttcggttacgtacgggtacgttaacggttacgttaccggttaacctaccgttaaccgttccgtttacccgtttacccggtttacccgggtaccccggtttacgggaaaccccggttaaaggttaccgggttaaacttaaccgttaaaccggttaaaccgggttaccgttaaccgggttccgggtaccgttaccccgg

SEQ ID NO: 181141 - DNA, 651 bp, Homo sapiens
  misc_feature: GYAE6OF01A9QQ0.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctccagataccaccggagaaattgtgttgacgcagtctccaggcaccctgtctttgtctccgaggggaaagcgcccaccctctcctgcgacgggccagtcagagtcttagcagcagtctactagcctggtaccagcaacgaaaccgtggccacggcctcccgacggcctcctcacgttccgtacggtcgccactccgaacgtccgacgggcctacgtcggacactacccaacgacgtaggtcaggtcggacgtagggtcgggtcgtagggaaacgtccgttacacgtcctcctacacgttccacgaccgacgtacgtaggacgtctagtaacgtgtttacgacgtagttacgttactttacgtgtacctagtacgtacgttaagttaaccgggttacctaccgaaccttacctttaccgttaccggtttacccgggcccggttacgggtaaccgttaaggttacggaacttacgtaaaccgtaaacgtaccttgggtacgctacgg

SEQ ID NO: 181142 - DNA, 744 bp, Homo sapiens
  misc_feature: GYAE6OF01EBTMA.38.26.C04.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggccaccttgtctttgtctcgaggggaaacngccaccctctcctgcgaggccagtcagngttcttagccagcacgcttacgttacgcctcggtaaccagtacaacgaaacctcggacccgaggtccctacccgaacggcctttcccgtacctacgtaccgttcggtacgcctaacttcccgaagtccggaacgggcctaacgtccggacaccgtacccgaagtaccgtgggtttacgacgggttcggacgtagggttcgggttacgtaacggggtaaacttacgttacctaccgtccgttcctaccgtatacgacgacgtaacgtcgtacggacgtacttaaggtaacgtttacgttttacggactttaagggttcctttaacgttaccgttggtacctaacggtagttaaccggtagtttaacgacgttaccgttaaccttacgttcccgttaaccggttttccccggggaaaccgttacggggttaaaccgtaaaggttaccggttaattaaacccgtaacgtaaaacgtacgttacggttccggtcgtttaacgg

SEQ ID NO: 181143 - DNA, 757 bp, Homo sapiens
  misc_feature: GYAE6OF01CAMCC.38.26.C04.1.454.CMB.1.raw
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
tcagtcgatcacgtcacgaccggtgctcgatttagtctagcgactttgggtttggggcagagctctggagaagagctgctcagttagacccagagggaaccatggaaaccccagcgcagcttctcttcctcctgctactctggcctccagactacccacggagaaattgtgttgacgcagtctcagcacctgtctttgtctcgagggaancgccacctctctgcgacggccagtcagacgtntacgcagcagtacttacttacgtccgtacggtacccaggtacaacggtaaccgtcggacccgtacgggtacccttaccccggacggtcccttccctaccgtacgttaccggtaaccgggttacgacccgtaacgttcccgaacgggtacccgaaccgggggtacccaaccggttccggaaccttaaccgtaccccgaaggtaaccgtacggtttaccggagggttccggacggtaggggttccgggttaacggtaggggtaaaaccgttccgttacgtaaccgtcgttacccgtacctacgtaccaacggcggtaacgtacggtacggtacgtaccggttaggtaaacgtttcggttttacgacggtttagttacgttaacgtttcgtacgttacgacggtattacgttaacgttaacggtctaccgtaccttagtcccttaccggttaccgaccgtacggaaacgtacggtaccgtaacgtaaccgtaacgtaacgtacgtaggtcgtcgtacg

SEQ ID NO: 181144 - DNA, 581 bp, Homo sapiens
  misc_feature: GYAE6OF01A1ULZ.38.26.C04.1.454.CMB.1.raw
  modified_base (357)..(357): a, c, t, g, unknown or other
  misc_feature (357)..(357): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccacccctctcctgcagggccagtcagagtcttagcagcagctacttagccttggtaccagcaacgaaacctgggcccagggcctcccaggcctccctcatctacggtgcatccagcacgggcccactggcactcccagacaggttcaggtggcaggtgggtcgtagggaaanacttcactctcctccatcagcagcgtggactcctagtaagttattttcgcgtagtgtacttactgtcagtcagtatcgtaacctcactattccactttccggccctacgggaacctaaggtcgataactacgaaaccgtacgtcgtacgctgaccctacctattcgttcgttccttactccttcccgttccccgacctacttcgttacgacgttcgtagtaccg

SEQ ID NO: 181145 - DNA, 886 bp, Homo sapiens
  misc_feature: GYAE6OF01EB7T2.38.26.C04.1.454.CMB.1.raw
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
tcagtcgatcacgtcacgaccggtgctcgatttagtctagcgactttgggtttggggcagagctctggagaagagctgctcagttaggacccagagggaaccatcggaaaccccagcgcagtcttctcttcctctgctactctggcctccagactaccgacggagtaattgtgttgacgctagttcctccgaggcctaccttgttctttcgtcctacggaagggaacnccgtccctacctctccgtgcgacggccagtcagtacgttactagacngtactacgtacttacgttacgtccgtacgtaccgagtaccgaaacggtaaccgtcggaccgtaccggtacccgtaccgacggttcccctaccgtaccgtacgttaccggttacgggtacctaccgtaaccgtaccgacggacccggtaccggtacccgtaccggtaccgtaccgtacccgttaacccgaggttaacccggtaggtccgttaacgggtacggtacggttacggggttaccgggttaacggtaacgggttaaaccttcccgtttaacgtacccgtttcccgttaaccctacccgtaaccgttaccgggaacgttacccggtaaggtaccgggtaaccggtccggttaacccggttaaaggtttaccggtttaaggtttaccggtaacgtttaacggtttacggtttaacgttaaccgggttctaacggtacgttaaccggttaaccgttaacgtttaccgtaacccttacccgttaactttacccgttaccgttaccgggtttacccggtaaccggttaacgttaaaccggttaacgtaaccggttaaactaaccggttaaaccgtaaaccggttacgttcgggttacctaccggttaacccg

SEQ ID NO: 181146 - DNA, 715 bp, Homo sapiens
  misc_feature: GYAE6OF01DZ263.38.26.C04.1.454.CMB.1.raw
  modified_base (190)..(190): a, c, t, g, unknown or other
  misc_feature (190)..(190): n is a, c, g, or t
  modified_base (371)..(371): a, c, t, g, unknown or other
  misc_feature (371)..(371): n is a, c, g, or t
  modified_base (612)..(612): a, c, t, g, unknown or other
  misc_feature (612)..(612): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggacgttctcgtttgtggtgcagcagctacgaggtgtccagtcccgaggtgctaggttcggngcaggtcgtggggctggaggtagaagacgccgtacggtcctcgggtacgaacggtcccctggacgaaggtccgttagcgggacgtcctaccgttcgacgactaacctattacgtttacagtacgtgggtcgaccgtacgaccggccccggtaggacggtaacggtcgttaggcggttaggnggtacgggacgtacgtcccgtccgtattccgttacggaacctaacacgaccgtacgaccaacaacgtaacgtaccgaacggactacgaccgtacgaccgtacgtaccggacggtaaccgaaccgtcggtaaacgacgtaccgacgtaacgttacgtaactaggtaggaacgtagtacggacgtacgtactacgtacggactacggtaccgaacgtacggaccgttacgggtatttacggtnttaggacggtcggaggaacgggtcgggacggtcggggtacgttacgggtgttaacggtggtttacgttacgttacggaggttcggtacggtacggggtaaccg

SEQ ID NO: 181147 - DNA, 644 bp, Homo sapiens
  misc_feature: GYAE6OF01DNMLB.38.26.C04.1.454.CMB.1.raw
  modified_base (71)..(71): a, c, t, g, unknown or other
  misc_feature (71)..(71): n is a, c, g, or t
  modified_base (75)..(75): a, c, t, g, unknown or other
  misc_feature (75)..(75): n is a, c, g, or t
  modified_base (121)..(121): a, c, t, g, unknown or other
  misc_feature (121)..(121): n is a, c, g, or t
  modified_base (154)..(154): a, c, t, g, unknown or other
  misc_feature (154)..(154): n is a, c, g, or t
  modified_base (287)..(287): a, c, t, g, unknown or other
  misc_feature (287)..(287): n is a, c, g, or t
  modified_base (447)..(447): a, c, t, g, unknown or other
  misc_feature (447)..(447): n is a, c, g, or t
  modified_base (508)..(509): a, c, t, g, unknown or other
  misc_feature (508)..(509): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (524)..(525): a, c, t, g, unknown or other
  misc_feature (524)..(525): n is a, c, g, or t
  modified_base (537)..(537): a, c, t, g, unknown or other
  misc_feature (537)..(537): n is a, c, g, or t
  modified_base (540)..(540): a, c, t, g, unknown or other
  misc_feature (540)..(540): n is a, c, g, or t
  modified_base (595)..(595): a, c, t, g, unknown or other
  misc_feature (595)..(595): n is a, c, g, or t
  modified_base (611)..(611): a, c, t, g, unknown or other
  misc_feature (611)..(611): n is a, c, g, or t
  modified_base (622)..(622): a, c, t, g, unknown or other
  misc_feature (622)..(622): n is a, c, g, or t
  modified_base (638)..(638): a, c, t, g, unknown or other
  misc_feature (638)..(638): n is a, c, g, or t
tcagtcgatcacgtcacgaccggtgctcgatttagtctagcgactttggggtttggggcagagctctgganaagngctgcgtcgaggtacggaccaggacgggaaccagtacggaacccgngcgacgtagtcttctcttcctctgtctacttcncggtacctaccgagaccgtaacccgaaccgggtaagtaaacgttgtaggtcgaaccgccgtacgcctaccgcggtcctaccctgttccgttttccgacctaccgggagggaaccgcctccctaccttctccgnggaccggcggtctagacgacggcttacgtagcagcgtactacgttacgtcgcgtaacggaccaagtccgaaacggaaccccgtgggacctacggcccgtaccaccggtcctaacctcggacttccggtcggctaacgccggcacggttacggcgtccggntccggctaccgcgtaacgcgttacgcgtagcgtcggagtgacgacggtatcacgtctcacnncncgntaggctggcnncgtgattcgtangtntagtactgtaagccgtagcttagctgtaaccgttatcgtacctcgtacgcggtanaaccgtgcgttaacgngtaaccgtaancccggttagcccggtntaaccc

SEQ ID NO: 181148 - DNA, 712 bp, Homo sapiens
  misc_feature: GYAE6OF01BMWRI.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtcctccgaggggaaagagccaccctctcctgcgagggccagtcagagtcttagcagcagctactagcctggtaccagacacgaaccctggaccaggcctcccgaggcctcctcactcgtacggtcgctactccagcgacgggcccacgtggacctacgtccccgaagaccgtagggttcaggtcggcgtaggtcgggtacgtaagggtaaactccgttacacgttcctaccgtaccataccgaggacctaaggtaccgtagggacgtaccgtaaggtaagtttacgttttcggacgttaggttacgttaacgtttcgtgtacgtagactaaggttacgtaaccggtacctccgtaaccgttctttaccgtaccgtttacccggacccgtaacgggaacgtaaggtacggtaacttaacgtaaccgaaacgtacgttaggtacgtcctacggaccttacctcgttcgttcgttcccttaccgtacctttccccgttaccccgtacgttcccgttacggtaacggtacggttcgtaacggttacgg

SEQ ID NO: 181149 - DNA, 712 bp, Homo sapiens
  misc_feature: GYAE6OF01AWO3J.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccgaggggaaagagccaccctctccgtgcagggccagtcagacgtcttagcagcagctacttacgcctaggtaccagcaagaaaccgtggccaggcctccaggcctcctcactcgtacggtcgacatccgaagcgacgggccacgtgggccacgtacccgagaccgtaggtccaggtcggcagggtgggtacgtagggaaactccttcgaccttcctactaccgactcgacgtacgtacgaccttgggacgtccctaaggtaacgttacgtttacgagttaggttacgttagttacgtcgtacgacgtcggtaacgttagtaccggttaacctcctaacttaaccgttcctacccggttttacccggaccggttaacgggtaacctaacgggttacgtaaccgttaaccgttaaaccggtaaaccggttagttccggtagtacccgtcgtaccctaacgttcgttaccgtccgttccgttacgttcccttacccggttccctacccttgttaaccgacgttaaccggttgtaccgtaccgg

SEQ ID NO: 181150 - DNA, 844 bp, Homo sapiens
  misc_feature: GYAE6OF01AE6E5.38.26.C04.1.454.CMB.1.raw
  modified_base (164)..(164): a, c, t, g, unknown or other
  misc_feature (164)..(164): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagactaccaccgganaaattgtgttgacgcagtctccaggccaccctgtctttgtctccgaaggggaagacgccaccctctcctgacgacgggccagtcaggtacgttcttacgcagcagtctacgttacgccgtacggtaaccagaccgaacggaaaccgtcggacccgacggcccgtaccccgacggtcctcccgtaccacgtaccggttacggtcgacctacgtacccgacggccggtaaccgggcccacggttcggaccgaccgtacccgaaacggtaccgttaacgggtttacgacgggtcggtacgtacggggtttacggggttaacggttaacggggtaaaactccgtttaccgtaccgtttccgtaacccgttaccgtacttacccggaacggtaccgttaacggtaccggttacggaccgttaccgtaaggttaaacgtttcgttttacggacgtttaggtttaacgtttaaccgtttacggtacggttacaacgggttacgtaaggttttaacgggtaccgttaaaccgttaccgtaacccgtttatttacccggtttacccgggtttacccggtaaccggtaaccgggttaaacggttaacgggttaaacccggttaaccgttaacccggttaaacccgtaaaacgggttaccggtttaacgggtttacccgggacttaccggg

SEQ ID NO: 181151 - DNA, 928 bp, Homo sapiens
  misc_feature: GYAE6OF01AG0OU.38.26.C04.1.454.CMB.1.raw
tcagtcgatcacgtcacgaccggtgctcgatttagtctagcgactttgggtttgggggagacaatgggtttgatttagattacatgggtgacttttctgttttatttccaatctcagataccaccggagaaattgtgtgacgcagtctccaggcacctgtctttgtctccgtaggggtaacgacgcctaccctctccgtgcgagggccagtcagagtcttagcgagtcgagtctacgttacgccgttacgggtaaccgaggacaacggtaaacccgtggacccgacggtccgtacccggacggtccttcccgtaccgacgttacccggttaaccggtacgtacctaaccgttaccgaacggtaccggaacccggggtaccctaaccggttacggggaaccccgttaacccggttaccccccgtaagggtaacccgttacggggttacccgaacgggtaccgggtaacccggtaggggtcggggttaacggtaacggggtaaaacgttacccgtaacccgttaaccgtttacccgttaccgtaccctaggttaccgacggtacgtaacggtaacggtaccggtaacgtccgtaacgggttaaccgttatttacggaacggtttacgtaacgttactttacggtactaccggtaacgtaccgttaaggtaaccgttacggtaaaccccgttacgttaaaccgtacgtttaccctaccggtttacccgggtaaccgttacccgggaactttaaaacggtaccggttaaactaaccgttaaccgtaaaacccgggttagttaccggtacgggtaccttaaccggcctttaaaacccgttgtaaccccgtttagtccccgttagttaaccccgtcccgtttacccggacccttaaacgcgtaacggttaccggtaacggttaccgtaaccggg

SEQ ID NO: 181152 - DNA, 778 bp, Homo sapiens
  misc_feature: GYAE6OF01DVZUC.38.26.C04.1.454.CMB.1.raw
tcagtcgatcacgtcacgaccggtgctcgatttagtctagcgactttgggtttggggcagagctctggagaagagctgctcagttaggacccaggagggaaccatcggaaaccccagcgcagcttctcttcctcctgctactcgtgcctcccagactaccaccggaagaaattgtgttgacgcagtctcgaggccacccgttgtctttcgtccgtaccggaaggggaaacacgccctacccctctccgtcggcgaggccagtacgagtacgttcgttacggcagcgtaacgtaccttacgttacggcctcggtaacccgagacgaacgtaacccgtcggcccgtaccggaccccgtccgtacggccttacccgtctaccgttccgtacggataccgtacgcccgtacggccggtaccggccgtacgtacggtacctaccgtacccgaaggtaaccgtacggtttaccggagggtcggtacgtacggggttacggttaaccggttaagggaaaacggttacccttacgttaacccgttccgttacccttaacgtaacccgtacgtaaccggaccgtaaggtacccggtttacggaacggttaccgtaacggttaaagtttcgttagtcgttaagttaacgttcttacgtagttaccgagttacgtaagttacgtaagtaccttaccgaacttcgtaacccgttcggtttacccgacggtaacgtaacggtacgtataaccgttaagtaaccggtaacctaaggttcgacggtcgtaccg

SEQ ID NO: 181153 - DNA, 693 bp, Homo sapiens
  misc_feature: GYAE6OF01C0FTF.38.26.C04.1.454.CMB.1.raw
  modified_base (433)..(433): a, c, t, g, unknown or other
  misc_feature (433)..(433): n is a, c, g, or t
  modified_base (465)..(465): a, c, t, g, unknown or other
  misc_feature (465)..(465): n is a, c, g, or t
  modified_base (493)..(493): a, c, t, g, unknown or other
  misc_feature (493)..(493): n is a, c, g, or t
tcagtcgatcacgtcacgaccggtgctcgatttagtctagcgactttggggtttgggggaagacaatgggtttgatttagattacatgggtgtacttttctgttttatttccaatctcagataccgacggagaaattgtgttgacgcagtctcaggcacctgtcttgtctccgaggggaaagagccaccctctcctgcgagggccagtcagagtcttagcagcagactactgctcggtaccagacaacgaaaccgtcggaccgacggtccacccgacggtcctccctactatccggtacggtcgactactcccgaggaccggacggaccgtacgtacgggacctactaccccgaaggtaccgtacgggttacaagggtcggacgtagggtgggtacgtaaggggaaactccgttacacctactaccgtacacnccgagactagacgtaggacgcgtagtaagttnttgacgtagtattataccgtgtacagtnttaacgtagtaacggtacctagtacctacgttacctaccggtttcccggacggtacggaaacgtaacgtagtaactaaaccgtaccgtaaaagtcgtacggtaccgggtactacgacctaaccgtatccgtttacgtaccttaaccgtccgttacccttacccggattacctacgtaacgtacggtgtaacggttacccg

SEQ ID NO: 181154 - DNA, 753 bp, Homo sapiens
  misc_feature: GYAE6OF01D3QDN.38.26.C04.1.454.CMB.1.raw
tcagtcgatcacgtcacgaccggtgctcgatttagtctagcgacttttgggtttggggcagagctctggagaagagctgctcagttaggacccagagggaaccatggaaaccccagcgcagcttctcttcctcctgctactctggctcccagactaccgaccggagaaattgtgttgacgcagtctccgaggccacccttgttctttcgtcctaccggaaggggaaacgcgaccctacccttctccgtggacgacgggccagtcgaggtacgttacgttagcagcacgtaccttaaccgttacgaccgttacggtaaccagacaacggtaaccgtcggaccacgggtcctaccccggaggtcccttacccgtacacgtttccgtaccgggtcactacgtacccgaaggccgaaccgggacctacgtcggacctaccgtaccgaggtacgtaggtttacgaagggtcggacgtagggtacgggtacgtaagggtaaactaccttcgacttacctcctactacgtacgaagtcgaacggacgtacggacgtaccgtagtaaacgtttacgtttcgaacgtttaagttacgttaacttaccgtggtacgtaacgtacgtttaaggtccgttaagtaccctacttaccgttactttcccggttaaccggtttacccggacccgtaacgggtaaaccgtaaaggttacgtaacgtaaaccgtaacgttaaaacggtacgtcgggtaccgtacgtaccg

SEQ ID NO: 181155 - DNA, 790 bp, Homo sapiens
  misc_feature: GYAE6OF01DUSLI.38.26.C04.1.454.CMB.1.raw
  modified_base (589)..(589): a, c, t, g, unknown or other
  misc_feature (589)..(589): n is a, c, g, or t
tcagtcgatcacgtcacgaccggtgctcgatttagtctagcgactttgggtttggggcagagctctggagaagagctgctcagttaggaccagagggaaccatcggaaacccagcgcagtcttctcttcctctcccgctactctggctcccagataccgacggagaattgtgttgacgcagtctccgagcctacccttgttctttcgtacgtccggaagggggaaacaccgccctaacccgtcttcccgtggaccgaacggggcccaacggtaccaacggtaccgttaggttaacgaccgtaggcctaacgtccgtttaacgttaaccggtaccgttaacgggtaaaccctaaacgggtaaaaaccgtaaacccggttcgggaaccctaacggggtaccccttacccggaacgggtcccctttaccttaccgttaacgtttccggttttagggacctacgtacctaccggtacgaccggtacgtacctaacgtcggacctacgtacccgagtaaccgtaacggttcaaggtcggacgtcgggtggtccgtaagggacctaggtacttccgactctaccactacacacgngtacgtgcgtacgtagtaagttcttaggtactttaacgttattccgtgtaaaccgtagtacgttaagttagttacgtttaacgtttaccgtttacccttcggttaccgttacgggttacccggaggggttaccggtacggtagggtactaaccgtactaaacggaacttaacgggtcggtacggtaacctggaaccctacg

SEQ ID NO: 181156 - DNA, 646 bp, Homo sapiens
  misc_feature: GYAE6OF01DDM7U.38.26.C04.1.454.CMB.1.raw
  modified_base (284)..(284): a, c, t, g, unknown or other
  misc_feature (284)..(284): n is a, c, g, or t
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (372)..(373): a, c, t, g, unknown or other
  misc_feature (372)..(373): n is a, c, g, or t
tcagtcgatcacgtcacgaccggtgctcgatttagtctagcgactttggggtttgggggaagacaatgggtttgatttagattacatgggtgacttttctgttttattccaatctcagataccaccggagaaattgtgtgacgcagtctccaggcacctgtcttgtctccgaggggaaagcgcccaccctctcctgcgacgggccagtcagagtcttagcagcagctacttagcctggtaccagcagaacctggccaggcctccaggctcctcaactcgaggtncactccagcgacggccagtcggaccactaccgaagacgtaggtacaggtgcgaggtcggacgtaagggaaactctacncgtctcncannacgctagacgtagacgctaaggtaacgttagtttcgacgtaggttactagtttacacgttagagtactaggttaacgtacgtaacctactacctagttccgtaccgtttccgaccggtacggtaacgtaacgtaggtaactaacgtaaccaaacggtagtccggttaggacctcgtaacccacttacgttccgttacgttaccgttcctccgtttaccccgtacccgtacccttacggttacccggtaaggtacccgtagtacggttaccggg

SEQ ID NO: 181157 - DNA, 748 bp, Homo sapiens
  misc_feature: GYAE6OF01D9IT5.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctgggaggttcctctttgtggtggcagcagctacgaggtgtccagtcccaggtgctagttggtgcaggtcggtggggctggaggtagaagagtccgtgggtcctcgggtagacggtcccctgacgtaacggtcttcgtggacgtcctaccttcgacgacctaaccttatttaaccttcgacgtcggtgggtacgcgtaccgaccggtcccccgtagggaaccgacggggttcttagggacgggtggggacggtaggggtaacgggtccttccccggtccgtacgttcgttaccgggaaacctaacccacgaccgtacgaccactaaccgtacgtacgacggtacacgtaccacgacgtacgtaccggacgaacgaactaccgacgacgaccacttagtacctacgtagaggtaactgtacggacgttacgacgtagtacgtacgttacgcgggaacccgtaccgggtacgggttaccgttagtttcgttcgaccggtgggtaaccggtagggtacggggccggggtaaccggtcgggggttaccggtttacgggttaacggttaacgggttaggttcgtttacggttaggtaacgttccggtaaggggtccgggtaaacggg

SEQ ID NO: 181158 - DNA, 821 bp, Homo sapiens
  misc_feature: GYAE6OF01C5T7Q.38.26.C04.1.454.CMB.1.raw
  modified_base (792)..(792): a, c, t, g, unknown or other
  misc_feature (792)..(792): n is a, c, g, or t
tcagtcgatcacgtcacgaccggtgctcgatttagtctagcgactttgggtttgggggaagacaatgggtttgatttagattacatgggtgtacttttctgttttatttccaatctcagataccaccggagaaattgtgttgacgcagtctccaggcacccttgtctttgtctaccgagggggaaagcgcccaccctctcctgcgagggccagtcagacgtcttagcagcagtctactacgccgttaggtaccaggccaacggaaaccgtcggacccgtaggccctacccgacggtcctaccctcgaacttccgttaacgggtcacctactacccgaggaccggacggggcccctaacggttcgggaccaacctacccgacggtaaccgtaacgggtttcccagggttcggacgtaacgggttcgggggttacgtaaggggggaaaaccttaccgttccgaaacctttccgtaccttacccgtaacgttaccgaacgtacggtaacgggtaccggtacggggtaccgttaccgtaaggttaaacgtttacgtttaccgggacgttaaggttacggtttaacgtttacgttacggtaacgtacggtaacttaacggttacgttacgggtaacccttacggtaccttaacgtttccgttaacccggttttcccggaacccggttacggaaccgttaaagggttaccgtaacgttaaactaaccgtaaacgttagttcggacgtccgtaacgacctaacgtacgttcttaccggtcttactccttcccgtacccncgttacgttccgagtaacgtgtacgtacg

SEQ ID NO: 181159 - DNA, 201 bp, Homo sapiens
  misc_feature: GYAE6OF01BTGWA.38.26.C04.1.454.CMB.1.raw
  modified_base (175)..(201): a, c, t, g, unknown or other
  misc_feature (175)..(201): n is a, c, g, or t
tcagtcgatcacgtcacgaccggtgctcgatttagtctagcgactttgggtttggggggaaggaggaagactgacggtccccccaggagttcaggtcgctgggcaccagcggccctgggctgcctggtcaaggactacttccacgtgatcgactgagcggctggcagcgcatagnnnnnnnnnnnnnnnnnnnnnnnnnnn

SEQ ID NO: 181160 - DNA, 772 bp, Homo sapiens
  misc_feature: GYAE6OF01E12K3.38.26.C04.1.454.CMB.1.raw
  modified_base (219)..(219): a, c, t, g, unknown or other
  misc_feature (219)..(219): n is a, c, g, or t
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
tcagtcgatcacgtcacgaccggtgctcgatttagtctagcgactttgggtttggggcagagctctggagaagagctgctcagttaggacccagacgggaaccatcggaaaccccagcgcagcttctcttcctcctgctactctggctcccagataccaccggagaaattgtgttagacgcagtctccaggccaccctgtctttgtctccgaggggaancgccacctctcctgccgaggccagtcagtgtcttagcagcacgtactacttagcctaggtaccagcaagaacctggaccacgtccaccgcgtctcctnacgttcgtacggtnacactccaggccgacgggcctacggtcggacctacgtaccccaagggtacccgttaaggttccgtaacgggtccgggtaacgtacgggtttcggggttaacggtaaccggggttaaacgtaccccttttaaccgtacccgttaccgttacccggttaccctaacggttacccgtaacgtaccgggtaaggtaccggttacgggtaaccgttacccggttaaacgggtttaaacgtttaccggtttttcgaccgtttaacggtttaaccggttactttaaccggtagtaaccgtacgtacgttaacgttacgttacggtaaccttaccctacgttaccgttaaccgttaccccgtttaccgggtacccggttaacgggaaccttaaaggaccgtaacttttaaccgaaaccgtaaacgtcgtaccgggttcgccgttacccg

SEQ ID NO: 181161 - DNA, 643 bp, Homo sapiens
  misc_feature: GYAE6OF01BCXWU.38.26.C04.1.454.CMB.1.raw
  modified_base (214)..(214): a, c, t, g, unknown or other
  misc_feature (214)..(214): n is a, c, g, or t
  modified_base (223)..(223): a, c, t, g, unknown or other
  misc_feature (223)..(223): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtctttgtctccgaggggaangccaccctntcctgcagggccagtcagagtctagcagcagctacttagcctggtaccagcagaaacctggccaggctcccgaggcctccgtcatcgtacggtgcactccaggtcagggccacgtggacactcccagtacacggttcacggtggccagggtcgggtcagggaaactcttacgactctctaccgatcacgtcacgtcgtacggactccgtagtacgtattttcggacgtaggttacgttaactttacgtagttccgacgttacgtaaggttacgttaacgggtaaccttacgtaacccgttaagttcccgttaaaccggttttcccgggtaccccggttaaggggtaaccccgtaaagggttacgtaaacgtaacgttaacccgtaaaaggtaaccgtttacgggtacggccgttaaccgg

SEQ ID NO: 181162 - DNA, 664 bp, Homo sapiens
  misc_feature: GYAE6OF01CJ3DE.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaagccgtgggtcctcgggtgaacggtcccctgacaaggtcttcgtgggacggcctaccttcacgtaccaccttattacctttcaggtcgttgggtgcgacgacggcccctgggaacgaagggtcttggacggtggacgtggggaggtactcccgtaccgtagttcgttacggaaccaaacctacgtactaccgacacaacgtaacgtcgaggacacgactacacgtactaccggacgaacgactaccacgacacacgacgtactacagtagagtagtgagtcgactagagtactcgtacgacgtacgaccgttcgtattacgttcgtgtcggtacggaggacggggacggggtaccggtaggggtacggttaccggggttaagggtttaaccgggtttgggttacggttacggttttaacgaggtttacggtccggggtacggggtaaacccggg

SEQ ID NO: 181163 - DNA, 747 bp, Homo sapiens
  misc_feature: GYAE6OF01ESW3Z.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagactaccaccggagtaaattgtgttgacgcagtctccaggcaccctgtctttgtctcgaagggaagacgcccacccttcctcctgcgacggcccagtccgagtacgtcttagcagcagactacgttacgcctacgtacagaccgaacgtaaccgtcggaccgacggccctacccgacggtcccttcctacctactttacccggtaaccggtcgtaccgtaccgtcccgacggaccgtacggggaccctaccgttcggacctaccgtacccaaggtaaccgtacggtcgtaacggtcggacggtacgggttcgggtacggtaggtaaacgttcttaccgtacctcttacccgtacctagttaccgacgtaccgaacggtacggttacggaaccgttaccggttaaagggtaacgttttacgttttacggacggtttagtttacgtttacgtttaacgtacgtacgtaccgtagttacgttacgttaacgttacctaccgtacttactttaccgtacccgtttcccgggtaccgtacgggtaaccgtaaggtacgtaacgtaaccgtaacgtaaacgtaggttacgtcgtaccgtacg

SEQ ID NO: 181164 - DNA, 653 bp, Homo sapiens
  misc_feature: GYAE6OF01C50ZF.38.26.C04.1.454.CMB.1.raw
  modified_base (233)..(233): a, c, t, g, unknown or other
  misc_feature (233)..(233): n is a, c, g, or t
  modified_base (336)..(336): a, c, t, g, unknown or other
  misc_feature (336)..(336): n is a, c, g, or t
  modified_base (513)..(513): a, c, t, g, unknown or other
  misc_feature (513)..(513): n is a, c, g, or t
tcagtcgatcacgtcacgaccggtgctcgatttagtctagcgacttttgggtttgggggcagagctctggagaagagctgctcagttaggacccagagggaaccatcggaaaccccagcgcagcttctcttcctcctgctactcgtggctcccagactaccgacggagaaattgtgttagacgcagtctcgacggcctacccttgttctttgtctaccggaaggggaaacgcnccctaccctcgtacctgcgaggccagtacgagcgtctagcagcagtcctacttacgccgtacggaccacgaccgaacgaacctcggaccacggtcctacccgnggcctcctcgactcgtacggtcgcacgtccgagccgacgggacctcgtcgctactaccgaacgacgtacgtcgaggtacggcgtacgggttagggtacgtacgggtaactcttccacgttcctcacgtactacgcgacgtacgtacgtaggtaccgcttaaggtacgttgtttacgngttacgttgttacgttacgtacgtagtacgtcgtagttacgttacgttactactaccgttaacctccggttacgttaccggtacggtaacgtaactaacggtacgttaacaacgtaactaacggtatacgggcgtcgtac

SEQ ID NO: 181165 - DNA, 676 bp, Homo sapiens
  misc_feature: GYAE6OF01EGSYB.38.26.C04.1.454.CMB.1.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
tcagtcgatcacgtcacgaccggtgctcgatttagtctagcgactttgggtttggggcagagctctggagaagagctgctcagttacggacccagagggaaccatggaaaccccagcgcagcttctcttcctcctgctactctggctcccagataccacggagaaattgtgttgacgcagtctccaggccacctgtctttgctccgaggggaaacngcccacctctccgtgcgaggtccagtcaggngttcttagcagcagtccacttacgctggtaccagcaagaaccgtggccaggcctaccgaggcctactctacgtccgtacggtcacgtactccgagccgaacgggcctaacggtcggctaacgtccccgaaggactagggttaccaagggtggtacctagggtacggtcggtaaaggggtaaacttacgttaccgtaacttcctaccgttaccaacgtaccgagaccgaagtacggtacgacggtccttaggtacgtatttacgtacgtagtttaggttactacttaggcgtacgtaggttaacgttacgttacggaacgtacctacgtacttaccggtacgtttaacccgggccgttaggggtaactaaacgggttgggtaaacttaaccgtaaccggtaaacgtaccgttggtaaccgttcgtaaccg

SEQ ID NO: 181166 - DNA, 851 bp, Homo sapiens
  misc_feature: GYAE6OF01DWZMG.38.26.C04.1.454.CMB.1.raw
  modified_base (191)..(191): a, c, t, g, unknown or other
  misc_feature (191)..(191): n is a, c, g, or t
tcagtcgatcacgtcacgaccggtgctcgatttagtctagcgactttgggtttgggatcacataacaaccacattcctcctctaaagaagcccctgggagcacagctcatcaccatggactggacctggagttcctcttgtcggtggcagcagtctacgaggtcgtccacgtcccaggtgcgtagttggtnctaggtcgcgggctggaggtgaaacgacgtccggtgggtcctacgggtacgtaaccggtcccctagccgtaacggtccttacggaggacgtcctaaccggttcaacgtaccctaaccttagtttaaccgtttcgacggtacgttggggtaccaccggtacgacccggtccccgtaagggtaacccgtaaggggtaccgtttgggacgggtacggtacggtcggggtaacgggtccttacccggtcgttaacggtttccgtaacgaacctaaccgtaccggtactaccgggaacctacgaaacccgttacggtaaacgaaccggtactaaccggtacccgtacggtaaccggttaacccgtaacccgggtaaccggtaacgaaaccgttaacccgacgtaaccgttaccgaaacgttacgtaacgtaagtaccggtacgaagggttaccgtacggttaccgacggacccgttaggaccgtacgtttcggaaccggtaaccgtaccgggtccggttagtttacggttaacgttccggtaggtcggtaaacggagggtacccgggtacggggtccgggtacgggttaccggttggtaacgggttaaggtttccgggttaagtccggtttaacggtgttacggttcgggtaaacggtaacgggg

SEQ ID NO: 181167 - DNA, 758 bp, Homo sapiens
  misc_feature: GYAE6OF01DQS7Y.38.26.C04.1.454.CMB.1.raw
  modified_base (151)..(151): a, c, t, g, unknown or other
  misc_feature (151)..(151): n is a, c, g, or t
  modified_base (183)..(183): a, c, t, g, unknown or other
  misc_feature (183)..(183): n is a, c, g, or t
  modified_base (203)..(203): a, c, t, g, unknown or other
  misc_feature (203)..(203): n is a, c, g, or t
  modified_base (218)..(218): a, c, t, g, unknown or other
  misc_feature (218)..(218): n is a, c, g, or t
  modified_base (248)..(248): a, c, t, g, unknown or other
  misc_feature (248)..(248): n is a, c, g, or t
  modified_base (260)..(260): a, c, t, g, unknown or other
  misc_feature (260)..(260): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (746)..(746): a, c, t, g, unknown or other
  misc_feature (746)..(746): n is a, c, g, or t
tcagtcgatcacgtcacgaccggtgctcgatttagtctagcgactttgggtttggggcagagctctggagaagagctgctcagttaggacccagagggaaccatcggaaaccccagcgcagtcttctcttctctgctactctagcctccanactaccacggagtaattgtgtagacgcagtcncgagcctaccttgtacttcnctaccgaagggtaancgtaccaccgtctcctggcgacggcacgtnagtagtctacgnagcgatacttacgtcgcgtacggtacagacaacgtaaccgtggaccgtacggtcctaccgacggtcctactctacgtcgtacggnacgactcgagtcgaccgcacgngtactactaccgagtaacgtgtacgaggtggacgtacgttggaaccggtaggaacgttacttccgcttacccgtacgtaaccgagtaccgaaggacgtaaccggtcggtaacggaccgttacggttaagttaacgtttacggtttcgtaaacggttaccggttttaacgtttacgtttaaccggtacgttaaccgtacggttaaccgttaaggtttaacccgttaacgggtacctttacccctaagtttacccggtaccttttaacccggggttacccgtacccgggtttaaaacgggtaacccggttaaagggttacccgtaaaccgtttaaaccggtaaaccggtttaaaccggtaccgtttacggttaacccgggntttaaccccggg

SEQ ID NO: 181168 - DNA, 711 bp, Homo sapiens
  misc_feature: GYAE6OF01ELNVY.38.26.C04.1.454.CMB.1.raw
  modified_base (148)..(148): a, c, t, g, unknown or other
  misc_feature (148)..(148): n is a, c, g, or t
  modified_base (593)..(593): a, c, t, g, unknown or other
  misc_feature (593)..(593): n is a, c, g, or t
  modified_base (616)..(616): a, c, t, g, unknown or other
  misc_feature (616)..(616): n is a, c, g, or t
  modified_base (703)..(703): a, c, t, g, unknown or other
  misc_feature (703)..(703): n is a, c, g, or t
tcagtcgatcacgtcacgaccggtgctcgatttagtctagcgactttgggtttggggcagagctctggagaagagctgctcagttacggacccagacgggaaccatacggaaaccccagccgcagtcttctcttcctcctgctactcnggcctccagactaccacggagaattgtgttgacgcacgtctccacggcctaccgttgttctttcgtccgtaccggaaagggggaaacgaccgccctacccttccttccgtcggaccgaccgggtccctacggtaccgaacggtacgttccgttaacggccacggaccgtacgtacctttaccgttacggcccgtacggtacccgacgtaccaacggaaaccgtcggaccgaccggtcccgtcccgacggttcctacccgttacgacgttaccggtaccggtcgacctaccgtaccgaacggccgtaacgggcctaaccggtcgtacccgactaccgagaacgtcggtagaggtcggacgttacgggtaggtcggtaagggaactccttacgaccttctaccgtcatacgacgtcaaggtctacggctcgtagtactttgttacgngttagttattctacgtacgtacngttacggtaacttaggtactactctacgttacgttcctaccggttcggaccttaagggactagtacgaataacctacgaataggttngtactacg

SEQ ID NO: 181169 - DNA, 765 bp, Homo sapiens
  misc_feature: GYAE6OF01C9JEE.38.26.C04.1.454.CMB.1.raw
  modified_base (90)..(90): a, c, t, g, unknown or other
  misc_feature (90)..(90): n is a, c, g, or t
  modified_base (185)..(185): a, c, t, g, unknown or other
  misc_feature (185)..(185): n is a, c, g, or t
  modified_base (195)..(195): a, c, t, g, unknown or other
  misc_feature (195)..(195): n is a, c, g, or t
  modified_base (292)..(292): a, c, t, g, unknown or other
  misc_feature (292)..(292): n is a, c, g, or t
  modified_base (337)..(337): a, c, t, g, unknown or other
  misc_feature (337)..(337): n is a, c, g, or t
  modified_base (414)..(414): a, c, t, g, unknown or other
  misc_feature (414)..(414): n is a, c, g, or t
tcagtcgatcacgtcacgaccggtgctcgatttagtctagcgactttgggtttgggggaagacaatgggttgatttagattacatgggtntacgttttctgttttatttccaatctcagataccaccggagaaattgtgttgacgcaggtctccgaggcaccctgtctttgctccgaggggaaancgcccacctntccgtgcgaggccagtcagacgtcttagcagcagtctactagcctggtaccagcaagaacctgccagcctccgaggctccgtcacgtcgtaggttcncgtaactccagctaacgggccctagtcggacacgtcccagggtanacggttcgaggttggactagggtcgggtactacggggaaactcctttcgaacttcctccgtactacgtcgaacggtntaacccgggcttcgggaccgtaccgtaagttaccggtttagtttcggtaacccgttaggttacggttaacgtttacccgttaggttacgaaccgttacggtaaggtttaaaccggttacgggtaaccgttaccgtaaacccttacctttaaccgtaccggttttttaccccgcccgggttaacggtaacccggtaaagtttacgtaaacggttaaccgttaaacgtaaaccggtaaaccggttggttaccggtacgttaccgaccgtacccttaagtccggttcgttaactttcccggttaacttcccgttacccgacttacccgcgtttacgacgttgaccgttaacggg

SEQ ID NO: 181170 - DNA, 918 bp, Homo sapiens
  misc_feature: GYAE6OF01EOXVP.38.26.C04.1.454.CMB.1.raw
  modified_base (197)..(197): a, c, t, g, unknown or other
  misc_feature (197)..(197): n is a, c, g, or t
  modified_base (236)..(236): a, c, t, g, unknown or other
  misc_feature (236)..(236): n is a, c, g, or t
tcagtcgatcacgtcacgaccggtgctcgatttagtctagcgactttggggtttggggcagagctctggagaagagctgctcaggttacggacccaggacggaccagtacggaaaccccagcgcagtccttcttccttcctcctgctacgtctcggcctccagactaccgacggagtaagttgtgtgcgctacgtcnccgagcctaccttgttcttcgccgtacggaagggtaacncgccctcctccgtcgtcgacggacggacctagtcgacgtacgtcgtaggacctaggctaaccgtacgttacgtacgtccgtacggtacctacgaaccgtaacgaaccgtcggaccgtaccggtccctaccggacggttcccttaccgacgttacgtaccggtacggtccacgtaccgtacggacggacccggacggtacccacgttccggaacctaccggtaccgaacgggttacggtaccgggtttagaccggggtttccggaagggttacggggtttaaccgggacgggttaaaacgggtaaccttaccctttcccgttaacgtccccggttaacccgtccgtaacgaccggtacgtaaccggtacgggttaaccggccggtaaccgggttcggttaaggttaccgtttaaggtttacgtacgttttaacggtaacgtttttacgaccgttaggttaacccggagttaacccgggttaatttaccgggtaaccccggtttaaccgttaaccttaccgggtttaaccccgttttaaacgggttacccccgggtttaccccggggtaaacgggtttaacccgggttaaaaccggggttaaccgttaacgggtaaaacccgttacgggtaaaaaccccggttaacgtacgggtttacccggtacgttaaccgggttaaacccc

SEQ ID NO: 181171 - DNA, 726 bp, Homo sapiens
  misc_feature: GYAE6OF01BY8CR.38.26.C04.1.454.CMB.1.raw
  modified_base (248)..(248): a, c, t, g, unknown or other
  misc_feature (248)..(248): n is a, c, g, or t
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (326)..(326): a, c, t, g, unknown or other
  misc_feature (326)..(326): n is a, c, g, or t
  modified_base (668)..(668): a, c, t, g, unknown or other
  misc_feature (668)..(668): n is a, c, g, or t
tcagtcgatcacgtcacgaccggtgctcgatttagtctagcgactttgggtttggggaagacaatgggtttgatttagattacagtgggtgtacttttcttgttttatttccaatctcagataccaccggagaattgtgttgacgcagtctccaggccacctgtcttgtctccgaggggaaagcgccacctctccgtgcgacgggccagtcagagtcttagcagcagtctacttagcccgtggtaccnggacacgttaaccngccgaggctacccnggcctcgtcacgtctacggtagctagccaggtcgacgggccacgtcggcntacccagacgtaggttccaaggtggtccgtagggtagggttacgtagggtaacggaacctttcacgtactcgtcccatacagctaagcgtcggtaggacctaggtaaagttgttcgtaacgtacttaggttaagttacgttacgttacgttacgaactaggtaacgtacggttaaccgttacttaaccgaccctttaaccacccggtttaaccgtccggttaaaccgggttcccgaacggtttaaccgggaacgtaacggtaacgtaaacccgtaacggtaacgtacccggtaagtcgtcccgtaaacccggacttcctccggtttacccttcggttaaccnccgggttttacctaccccggttacaacccgttcgtaacgtacggttaacgtaacccgg

SEQ ID NO: 181172 - DNA, 715 bp, Homo sapiens
  misc_feature: GYAE6OF01CAVIX.38.26.C04.1.454.CMB.1.raw
  modified_base (366)..(366): a, c, t, g, unknown or other
  misc_feature (366)..(366): n is a, c, g, or t
tcagtcgatcacgtcacgaccggtgctcgatttagtctagcgactttgggtttggggcagagctctggagaagagctgctcagttaggacccagagggaaccatacggaaacccagcgcagcttctcttcctcctgctactctgctccagactaccacggataaattgtgttgacgcagtctccaggcctacccttgttcttttgtcctaccgaaggggaaacgcgccctaccctctcccgtggccgacgggtccaaggtcaacgtacgttccgttagcacgcacgtacttactacgccgtcgtaacacgcaacgtaccgtcggaccgacggcctaccgacgtcctaccgtcacgtaccgtacgtnactactcgacgcgacggtccacgtgcctacgaccgagtacgtgtacgcggtggtacgtgggtacggtacgtaagggtaacttacgttctaaccgttccttacctacgtacgtacacggcgtaacggtacggtggacgttccgtaaaggtttagtttacgtttacgtaacgttaggttacttacgtttaactacgtacggtagttaccgttagtttacggtaaccgttactaacccggttaacctagttttaccccgttaccggtttacccggaccggttaaaccgggtaacttacggttaacgtaacttaacgtaaacccgttaaggtacgttcggtaacgtcgtaccg

SEQ ID NO: 181173 - DNA, 656 bp, Homo sapiens
  misc_feature: GYAE6OF01DJCW5.38.26.C04.1.454.CMB.1.raw
  modified_base (210)..(210): a, c, t, g, unknown or other
  misc_feature (210)..(210): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (332)..(332): a, c, t, g, unknown or other
  misc_feature (332)..(332): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctctcctcctgctactctgctcccagactaccaccggagaaattgtgttgacgcagtctcaggcacctgtcttgctccgaggggaancgcctacctctcctgacgacggccagtcaggatctagcagcagctacttcgccgtacggtaccagcaacgaacctggccaggcctaccgacgtcctcgtacactcgtacgtnacgntacccngacgtacggccacgtggacctacgtccaagtacgtacggtttaacgacggtcggacgtacgggtacgggtacggttaacggggaaactaccggttactaccttaccgttacctaccgtacgttaccgacgtactaaacggtacgtacggacgtaccgttagtaacgttagttacggtacgtagtacgtttacttacgtacgtacgtagtacgtagttaactaggtaacctacgttaaccctacgtacgttaccgtccggtaaccgtaggtaaccgtaacggtacgtaactaacgttaccgaaaacgtcggttagcgtgtaaccg

SEQ ID NO: 181174 - DNA, 772 bp, Homo sapiens
  misc_feature: GYAE6OF01CIJBE.38.26.C04.1.454.CMB.1.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttctctttgtggtggcagcagctacaggtgtccagtcccaggtgcagttggtgcagtcgtggggctgaggtgaagaagcctgggtctcggtgaaggtccctggcaaggctttcgnggacggcaccttcagcacctatactttcagtcctggggtcncgaccgacggccccgtaggaccgaacgggtcttaggacgttggagtggggaggtactccgtacccgattcgtttagggaccaaaacctccgaactacgcaccgaactaaggttcccaagggtacacggaacctcgtaacgacgttaccgacggaaccgaactacccaaggacgaccaaccgtaggttacaaccgtaagtacgggaacgtaacgttagaacgtaagtcccgttagaacgtaacgttccgttaagggaacccgtaacccggtaacggggtacccgtttacggtttaacgttttcccggtaggttacgggacccgggtaggggaaccgggggtaaacccggggggtcccggtaaaccgggggggttcctttaccgggggggtacgggttttaaaaccgggtttacggggggtttacgtttccgggtttttaacgggtaatttaccgggttacgggttacggggggtaaaccccggg

SEQ ID NO: 181175 - DNA, 694 bp, Homo sapiens
  misc_feature: GYAE6OF01BKELN.38.26.C04.1.454.CMB.1.raw
  modified_base (141)..(141): a, c, t, g, unknown or other
  misc_feature (141)..(141): n is a, c, g, or t
  modified_base (221)..(221): a, c, t, g, unknown or other
  misc_feature (221)..(221): n is a, c, g, or t
tcagtcgatcacgtcacgaccggtgctcgattttagtctagcgactttgggtttggggcagagctctggagaagagctgctcagttaggaccagagggaaccatcggaaacccagcgcagcttctcttcctctgctactcnggactccagactaccacggataattgtgttgacgctacgttctcgaggtcctaccttgttctttcgctcggaagggaacnccgacctacctctcgtacgcgacggactagtcgagtagtactagcgagctaagtcttacgttcgacgttcggtaaccagaactaacgtaaccgtcggacctacggtccctaccggacgttcctacctagtacgttacgtacgtcgacctagtaccgtacggaccgtacggtccacggtccgactaccgacgacgcgttacgtcgaacggtcgacggtgggttacggtacgtaacggaacctttcctaacgtacgttcttacctacgtaacgtacacggtaccgtaacgacggtagacgtactttaaggactttacgttgaaccttgttaacgtacttcggtatacgacgtagttaagtacgtaactcgtaaccttcctacgtttccgtaaccggttccgtaaccggttaagaaccggtttaagtaacgtaagtaaccgttaacgaccggttagtaacggttctaaacggtccc

SEQ ID NO: 181176 - DNA, 667 bp, Homo sapiens
  misc_feature: GYAE6OF01EWUSV.38.26.C04.1.454.CMB.1.raw
  modified_base (351)..(351): a, c, t, g, unknown or other
  misc_feature (351)..(351): n is a, c, g, or t
tcagtcgatcacgtcacgaccggtgctcgatttagtctagcgactttgggtttggggcagagctctggagaagagctgctcagttaggacccagagggaaccatcggaaaccccagcgcagcttctcttcctcctgctactctggctccagactaccacggtagaaattgtgttgacgcacgtctccgaggcctaccttgttcttgtcctaccggaaggggaactcgccctaccttctctgcgacggcagtcagtcgtcgttagctagcagtcttactacgcgtacgacacgactaacgaaccgtcggacctcggtcctaccgacggtccttcctacgacgtacgtcgacnctacgtaccgagaccggtacggcctacggcgacctactaccggacgtacgtcggtaacgtcggtcggacgttacgggtacgggtacgtaagggtaacttctacgtcgtacctcgtactacgtacgacgactacgggtactacggtaccgtacgttaaggtacgtttacgttcgtaagtttacgttaacgttcttacggtactcgtaacgttacgtagttacgttacctacgtactaccttacgttacgtccggttaaccggtggtacgtaacggtaagtctaacgtactaaacgtaacgtgttcggacttgtaacg

SEQ ID NO: 181177 - DNA, 208 bp, Homo sapiens
  misc_feature: GYAE6OF01CW594.38.26.C04.1.454.CMB.1.raw
  modified_base (181)..(208): a, c, t, g, unknown or other
  misc_feature (181)..(208): n is a, c, g, or t
tcagtcgatcacgtcacgaccggtgctcgatttagtctagcgactttgggtttggggggaagaggaagactgaccggtccccccaggagttcaggtgctgggcacagccggccctgggctgcctggtacaaggacctacttcacgtgatacgactgagcgggctggacaaggcacgatagnnnnnnnnnnnnnnnnnnnnnnnnnnnn

SEQ ID NO: 181178 - DNA, 755 bp, Homo sapiens
  misc_feature: GYAE6OF01AHTDB.38.26.C04.1.454.CMB.1.raw
  modified_base (300)..(300): a, c, t, g, unknown or other
  misc_feature (300)..(300): n is a, c, g, or t
tcagtcgatcacgtcacgaccggtgctcgatttagtctagcgactttgggtttgggggaagacaatgggtttgatttagattacatgggtgacttttctgttttattccaatctcagatacccaccggagaattgtgttgacgctagtctccaggacaccctgttctttgtctccgaggggaaagcgcccaccgtctcctgcgacgggcacgtcagagttcttagccagcacggccttacgttacgcgttacggaaccagactaacgaaaccgtcggccgaggtccctccgacggtcccncctacacttcgtaccggtgcctactaccgagtaccgacgggtacccaaccgttcgggcctaaccgtaccccgtagaaccgtacggttacggacggttacggtcgtacgggttacgggtacggtaagggaaccgttcttaccggtaccttccgtacgtccctaacgtcgacgtacgtaacgtcgtacggtacgtccgtaggttaacttaggtttacgacgtagttacgttaacgtttcacgttacgaacgtacgttaggttaagttacgtaacctttaccgtaccttacgttcgttacccggttccggtacccgtacggtaacgtaggtacgttaacgttaaccgtaaccgaaccgttagtcgtaccggtactacgacgttacccgtagtaccgtattaccgttacctccgttcccgttcccgtccgtacgttacaacgtacgttccgtcgtacgg

SEQ ID NO: 181179 - DNA, 757 bp, Homo sapiens
  misc_feature: GYAE6OF01BQ7I6.38.26.C04.1.454.CMB.1.raw
  modified_base (148)..(148): a, c, t, g, unknown or other
  misc_feature (148)..(148): n is a, c, g, or t
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
  modified_base (255)..(255): a, c, t, g, unknown or other
  misc_feature (255)..(255): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
tcagtcgatcacgtcacgaccggtgctcgatttagtctagcgactttgggtttgggggaagacaatgggtttgatttagattacagtgggtgtactttttctgttttatttccaatctcagataccaccggataattgtgttagacgnagtcctcaggccaccctgttctttgctcgaaggggaanacgtcccaccctctcgtgacgacggccagtcagtactctagcaancagtcttactcgccgtggtaaccngtacaacgaaccgtcgacgcggtccaccgtcgccttccgctacgtcgtacggtacnccaacgtaccgnggaccggaccggtccaaccggttcgacgaccctaccgtaagggttaccgttacgggttacgtacgggtacggtaggtacgggttacggttacgggtaaaaggtaacccggttccttaaccgtcctccggttaccaaccggtactccgaaaggtcccgaaggttaacgtcggggaaccgttaccgtagtaaagtttcgttaacgacgtttagttacgttagtacttcggtagtacgtagttacgttaacgttacgtacctcgtactaccggtttaccgttaccgttccgtacggaacgtaacgtaacgtacggtactacgtaaccgtacggttacgtcggtacgacgtccaacttccgtacttccggttacttcgaccctttccgtaccctacgtttacctacgtacccgttaggacttacccgtgtaaaccggg

SEQ ID NO: 181180 - DNA, 168 bp, Homo sapiens
  misc_feature: GYAE6OF02GKGIK.38.26.C04.1.454.CMB.1.raw
  modified_base (167)..(168): a, c, t, g, unknown or other
  misc_feature (167)..(168): n is a, c, g, or t
tcagtcgatcacgtcacgaccggtgctcgatttagtctagcgactttggttgggaagaggaagactgacggtcccaggagttcaggtgctgggcacagcggccctgggctgcctggtcaaggactacttccacgtgatcgactgagcgggctggcaaggcgcatagnn

SEQ ID NO: 181181 - DNA, 187 bp, Homo sapiens
  misc_feature: GYAE6OF02IMBX9.38.26.C04.1.454.CMB.1.raw
  modified_base (171)..(187): a, c, t, g, unknown or other
  misc_feature (171)..(187): n is a, c, g, or t
tcagtcgatcacgtcacgaccggtgctcgatttagtctagcgactttgggttggggaagaggaagactgacggtccccaggagttcaggtgctgggccacagcggcctgggctgcctggtcaaggactacttccacgtgatcgactgagcgggctaggcaaggcgcatagnnnnnnnnnnnnnnnnn

SEQ ID NO: 181182 - DNA, 190 bp, Homo sapiens
  misc_feature: GYAE6OF02HKJAA.38.26.C04.1.454.CMB.1.raw
  modified_base (173)..(190): a, c, t, g, unknown or other
  misc_feature (173)..(190): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnnnnnnnnnnnnnnnn

SEQ ID NO: 181183 - DNA, 174 bp, Homo sapiens; identical to SEQ ID NO: 181005
  misc_feature: GYAE6OF02IKM6L.38.26.C04.1.454.CMB.1.raw
  modified_base (173)..(174): a, c, t, g, unknown or other
  misc_feature (173)..(174): n is a, c, g, or t

SEQ ID NO: 181184 - DNA, 176 bp, Homo sapiens; identical to SEQ ID NO: 181015
  misc_feature: GYAE6OF02HWFV8.38.26.C04.1.454.CMB.1.raw
  modified_base (173)..(176): a, c, t, g, unknown or other
  misc_feature (173)..(176): n is a, c, g, or t

SEQ ID NO: 181185 - DNA, 504 bp, Homo sapiens
  misc_feature: GYAE6OF02JC93P.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggagcctgaagattttgcagtgtattactgtcagcagtatggtactcacattcactttcgccctgggaccaaagtggatatcaaacgaactgtggctgcaccatctgtcttcatccttcccgctactctgacgtgatcg

SEQ ID NO: 181186 - DNA, 174 bp, Homo sapiens
  misc_feature: GYAE6OF02GE077.38.26.C04.1.454.CMB.1.raw
  modified_base (172)..(174): a, c, t, g, unknown or other
  misc_feature (172)..(174): n is a, c, g, or t
tcagtcgatcacgtcacgaccggtgctcgatttagtctagcgactttgggtttgggggaagaggaagactgacggtccccaggagttcaggtgctgggcacagcggccctgggctgcctggtcaaggactacttccacgtgatcgactgagcgggctggcaaggcgcatagnnn

SEQ ID NO: 181187 - DNA, 586 bp, Homo sapiens
  misc_feature: GYAE6OF02HIFCU.38.26.C04.1.454.CMB.1.raw
  modified_base (344)..(344): a, c, t, g, unknown or other
  misc_feature (344)..(344): n is a, c, g, or t
tcagtcgatcacgtcacgaccggtgctcgatttagtctagcgacttgggtttggggtcgagacgactctggagaagaggctggctccagttaggacccagagggaaccgatagggaaaaccccacgcggccaggcttacgtcttcctcctgactactctggcgtcccagattaccaccggagaaaatttcgtgttgacgcaggtctccaaggcgacccctggtcctttaggtcctccaggggaagagccgaacctctcctgcacgggaccagttcagagtcttagcagcagctataagcctggtaccagcagaaacctggcaggctccagctcctcatcacgtncagtcagcagggccactggcattccagacaggttcagttgtcagtggctgggaaagcgttcgactcgtctacctactcagtcgacgacgtacggagccgtacgtagtactttcgctacgtcgtacttacgtcgtactagtcctacgttagtcgtaacctcctaccattacgtactttccggtcccgttcgggtacctaacgtacggtacgtactacggaacgtacgtcgtacggtctaacgg

SEQ ID NO: 181188 - DNA, 174 bp, Homo sapiens; identical to SEQ ID NO: 181005
  misc_feature: GYAE6OF02GRGCO.38.26.C04.1.454.CMB.1.raw
  modified_base (173)..(174): a, c, t, g, unknown or other
  misc_feature (173)..(174): n is a, c, g, or t

SEQ ID NO: 181189 - DNA, 498 bp, Homo sapiens
  misc_feature: GYAE6OF02H3HSR.38.26.C04.1.454.CMB.1.raw
  modified_base (215)..(215): a, c, t, g, unknown or other
  misc_feature (215)..(215): n is a, c, g, or t
  modified_base (373)..(373): a, c, t, g, unknown or other
  misc_feature (373)..(373): n is a, c, g, or t
  modified_base (494)..(494): a, c, t, g, unknown or other
  misc_feature (494)..(494): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaancttcactctctccatcagcagactggagcctgaagtatttgctagtgtattactgtcagcagttatggtaactcactattctactttcggcctaggacaagtgatatacaacgtactgtgntacg

SEQ ID NO: 181190 - DNA, 506 bp, Homo sapiens
  misc_feature: GYAE6OF02HU5N9.38.26.C04.1.454.CMB.1.raw
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
  modified_base (479)..(479): a, c, t, g, unknown or other
  misc_feature (479)..(479): n is a, c, g, or t
  modified_base (502)..(502): a, c, t, g, unknown or other
  misc_feature (502)..(502): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggctgggaaancttcactctctccatcagcagactggacncctagaagtattttgctagtgtattactgtcagcagtatggtaactcacctattcactttcgcctagggaccaagtggactatacaaacgactgtgctgcacatctgtctnacttcctcccgcatcctggactnatcg

SEQ ID NO: 181191 - DNA, 175 bp, Homo sapiens; identical to SEQ ID NO: 181011
  misc_feature: GYAE6OF02FV9PB.38.26.C04.1.454.CMB.1.raw
  modified_base (173)..(175): a, c, t, g, unknown or other
  misc_feature (173)..(175): n is a, c, g, or t

SEQ ID NO: 181192 - DNA, 499 bp, Homo sapiens
  misc_feature: GYAE6OF02JWGG0.38.26.C04.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
  modified_base (373)..(373): a, c, t, g, unknown or other
  misc_feature (373)..(373): n is a, c, g, or t
  modified_base (402)..(402): a, c, t, g, unknown or other
  misc_feature (402)..(402): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaacctggccaggctcccaggctcctcatctacggtncatccagcagggccactggcatcccagacaggttcagtggcagtgggtctagggaaancttcactctctccatcagcagtactggancctagaagtatttgctagtgtattactgtcagcagtataggtactcactattctacttcggcctaggactaagtgaatactacaagactgtagctcg

SEQ ID NO: 181193 - DNA, 565 bp, Homo sapiens
  misc_feature: GYAE6OF02FRKQ1.38.26.C04.1.454.CMB.1.raw
  modified_base (528)..(528): a, c, t, g, unknown or other
  misc_feature (528)..(528): n is a, c, g, or t
tcagtcgatcacgtcacgaccggtgctcgatttagtctagcgactttgggtttgggggaagacaatgggtttgatttagtattacgatggggtgactttctgtttatttccgaatctcagataaccaccggagaaattgtgttgacgcagtctccaggcaccctgtctttgtctccgaggggaaagagtccaccctctcctgcaggggccagtcagagtcttagcaggcaggctacttagcctggtaccagcacgaaaccctggaccgacggcctccccgacggtcccttccgtccactctaccggtcgcgatccacgccaggggccactggcacgtccccaggaccaggttccaggttcgggacgaggttcggggttcctggggaaacgacttccgacttcgtcgtccgatcgagcgacgactggacgcctgaagtattttgctagtgtattactgtcagcagtatggtaactcgacattcacttcgcctgggacaagtgatatacaacgactgtgctgcacatctntcttctactccttccgcctattcctgacgttgatccg

SEQ ID NO: 181194 - DNA, 185 bp, Homo sapiens
  misc_feature: GYAE6OF02HJCGY.38.26.C04.1.454.CMB.1.raw
  modified_base (173)..(185): a, c, t, g, unknown or other
  misc_feature (173)..(185): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnnnnnnnnnnn

SEQ ID NO: 181195 - DNA, 495 bp, Homo sapiens
  misc_feature: GYAE6OF02I16I4.38.26.C04.1.454.CMB.1.raw
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcaggccactggcatccagacaggttcagtgcagtggtctgggaancttcactctctccatcagcagactggacgccgtgaagtnttttgctagtgtattactgtcagctagtatgtactcactattcactttcggcctaggacaagtgaatactacaacgactgtagctacg

SEQ ID NO: 181196 - DNA, 502 bp, Homo sapiens
  misc_feature: GYAE6OF02FM3Y3.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaagacttcactctctccatcagcagactggagcctgaagattttgcagtgtattactgtcagcagtatggtaactcaccattcactttcgcctgggaccaagtgatatcaagaactgtgctgcacatctgtcttcgactcttcccgcctatcctgacgttgatccg

SEQ ID NO: 181197 - DNA, 205 bp, Homo sapiens
  misc_feature: GYAE6OF02GGU0X.38.26.C04.1.454.CMB.1.raw
  modified_base (189)..(205): a, c, t, g, unknown or other
  misc_feature (189)..(205): n is a, c, g, or t
tcagtcgatcacgtcacgaccggtgctcgatttagtctagcgactttgggtttggactttgggtttggggggaagaggaagactgacgggtcccccaggagttcaggtgctgggcacagcggccctgggcttgcctggtcaaggactacttccacgtgatcgactgagcgggctggcaaggcgcatagnnnnnnnnnnnnnnnnn

SEQ ID NO: 181198 - DNA, 571 bp, Homo sapiens
  misc_feature: GYAE6OF02H6W7N.38.26.C04.1.454.CMB.1.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (311)..(311): a, c, t, g, unknown or other
  misc_feature (311)..(311): n is a, c, g, or t
tcagtcgatcacgtcacgaccggtgctcgatttagtctagcgactttgggtttggggcgagagctctggagaaggagctgctcgagttaggaccccaggacgggaaccatggaaaccccagcgcagcttctcttcctcctgctactctggctcccagataccaccggagaaattgtgttcgacgcagtctccaggcaccctgtcttgctccagggaangccacctcnctgccgagggccagtcagtagtcttagcagccagtctactaaggcctggtaccagcagaacctggccaggctcccaggctccgnatcctacgtgcatccagcgacggccacgtggcactcccagacaggtcagtggcagtggcgtaggaatctcactctcctactatcagtcagtactggactccgtagtaagtgtttcgactagtcgtattacgtgtcagtcaagttagtacggtaaactcgtaaccgtattccgtaaccgttttcccggcccgttacgggaaccctaaacgggttcgtaacttaccgtaaccgaaaaccgtaacgttggtacggacttacgg

SEQ ID NO: 181199 - DNA, 178 bp, Homo sapiens
  misc_feature: GYAE6OF02JO5XX.38.26.C04.1.454.CMB.1.raw
  modified_base (173)..(178): a, c, t, g, unknown or other
  misc_feature (173)..(178): n is a, c, g, or t
tcagtcgatcacgtcacgaccggtgctcgatttagtctagcgactttgggtttgggggaagaggaagactgacggtcccccaggagttcaggtgctgggcacagcggccctgggctgcctggtcaaggactacttccacgtgatcgactgagcgggctggcaaggcgcatagnnnnnn

SEQ ID NO: 181200 - DNA, 736 bp, Homo sapiens
  misc_feature: GYAE6OF02GQ06K.38.26.C04.1.454.CMB.1.raw
  modified_base (323)..(323): a, c, t, g, unknown or other
  misc_feature (323)..(323): n is a, c, g, or t
tcagtcgatcacgtcacgaccggtgctcgatttagtctagcgactttgggtttgggggcagagctctggagaagagctgctcagttaggacccagagggaaccatggaaaccccagcgcagcttctcttcctcctgctactctggctcccagataccaccggagaaattgtgttgacgcagtctccaggcaccctggtctttgtctccaggggaaagagccaccctctcctgcagggccagtcagacgtcttagcagcagctactagcctggtaccagcagaacctggccaggcctacccgaggcctcctcactcgtacggtncatccagcgacggccacgtggacactcccgagacctaggttcaggtggctaggtcgggtactaggggaaactaccgttcacgttctacctaccgataccgacgacgtaacgtaccgtcgggtacgtaccgttaaggaacgttacgttttacgaccgtaaggtttacgttaacgtttaccgtacgttaccgtaacggttacgttaaggtttaacgtttacgggtttaaaccttacccgtaaacccgtttaacgtttaccgttaacccgggtttttaccccgggtaaccccgggttaacgggggttaaaccccgttaaaacggggtttaaccgggtaacccgtttaaacggttaacccggttaaaaacccggttaacccggtttaccgggtttaccggggtacccgttaacccgg

SEQ ID NO: 181201 - DNA, 505 bp, Homo sapiens
  misc_feature: GYAE6OF02GMMAL.38.26.C04.1.454.CMB.1.raw
  modified_base (216)..(216): a, c, t, g, unknown or other
  misc_feature (216)..(216): n is a, c, g, or t
  modified_base (502)..(502): a, c, t, g, unknown or other
  misc_feature (502)..(502): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctcccaggctcctcatctacggtgcatccagcagggccactggcatcccagacaggttcagtgcagtgggtctagggaacacttcactctctccatcagcagacgtggacgcgtagaagtatttgctagtgttattatgtcagcagttatgtactcactattctacgttccggccgtacggacctaaggtgatatacaacgtactgtcgntcg

SEQ ID NO: 181202 - DNA, 508 bp, Homo sapiens
  misc_feature: GYAE6OF02H5AND.38.26.C04.1.454.CMB.1.raw
  modified_base (372)..(372): a, c, t, g, unknown or other
  misc_feature (372)..(372): n is a, c, g, or t
  modified_base (504)..(504): a, c, t, g, unknown or other
  misc_feature (504)..(504): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccatggcatcccagacaggttcagtggcagtgggtctgggaaancttcactctctccatcagcagacgtggagcctgaagtattttgcagtgtattactgtcagcagtatggtaactcacctattctactttcggccctagggacctaaagtgatactacaaacgtacgtgtaggntacg

SEQ ID NO: 181203 - DNA, 500 bp, Homo sapiens
  misc_feature: GYAE6OF02H9406.38.26.C04.1.454.CMB.1.raw
  modified_base (316)..(316): a, c, t, g, unknown or other
  misc_feature (316)..(316): n is a, c, g, or t
  modified_base (373)..(373): a, c, t, g, unknown or other
  misc_feature (373)..(373): n is a, c, g, or t
  modified_base (497)..(497): a, c, t, g, unknown or other
  misc_feature (497)..(497): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtncatccagcagggccacgtggcatcccagacaggttcagtggcagtggtctgggaaancttcactctctccatacagcagacgtggacgcctgaagtattttgctagtgtattactgtacagcagtatgtactcacattcactttcggcctggactaagtgatatacaaacgtactgtcgtntcg

SEQ ID NO: 181204 - DNA, 174 bp, Homo sapiens
  misc_feature: GYAE6OF02FRXY9.38.26.C04.1.454.CMB.1.raw
  modified_base (174)..(174): a, c, t, g, unknown or other
  misc_feature (174)..(174): n is a, c, g, or t
tcagtcgatcacgtcacgaccggtgctcgatttagtctagcgactttgggtttgggggaagaggaagactgacggtcccccacggagttcaggtgctgggcacagcggccctgggctgcctggtcaaggactacttccacgtgatcgactgagcgggctggcaaggcgcatagn

SEQ ID NO: 181205 - DNA, 721 bp, Homo sapiens
  misc_feature: GYAE6OF02IDJKZ.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggaccccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtcttagcgagcagcttacgttacgccgtacggtaccagacgaaacgtaaaccgtcggaccgacggtcctaccccggaggtcccttccgtactacttccgtacggtcacctactaccgagaccggacgggaccctaggtcggacctaccgtacccgaagaccggttacggttacagggtcggacgtagggttcggggttcggtaaggggaaaactttccgttacctaaccttccttacccgtacctagtaccgagaccgacggtacgtgggacgtccgtaaggtaacgtttagtttcgacgttaggttaacgtttacgttacgtcggtacgacgtacgtaagttacgttaacggttaacctacctaacttactttaccgttaccggttttcccggacccggttacgggaaaccgtaaggttacggtaacttaacgtaaaccgtaaaccggttaacgttgggttaccgtacgtacccg

SEQ ID NO: 181206 - DNA, 549 bp, Homo sapiens
  misc_feature: GYAE6OF02F87J8.38.26.C04.1.454.CMB.1.raw
  modified_base (215)..(215): a, c, t, g, unknown or other
  misc_feature (215)..(215): n is a, c, g, or t
  modified_base (383)..(383): a, c, t, g, unknown or other
  misc_feature (383)..(383): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtcttagcagcagctacttagcctggtaccagcaagaaacctggccaggcctcccgaggcctcctcatcgtacggtgcatccagcgaggccacgtgcactcccagacgaggttcaggtcggcagtgggtacaggggaacncttcactctctccatcagcagacgtggacgtccgtagaagttgtttgacgtagttgttaacttacgtgtaccagtcgtaagttagtacgtaactcactattctaccgtttccggccgtaggaacctaaggtacgtactactacgaacgtacgtggtacgtcgtacg

SEQ ID NO: 181207 - DNA, 570 bp, Homo sapiens
  misc_feature: GYAE6OF02HX8EB.38.26.C04.1.454.CMB.1.raw
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggttcccagataccaccggagaaattgtgttgacgcagtctccaggcaccctgtctttgtctccaggggaaangccaccctctcctgcagggccagtcagagtcttagcagcagctacttacgcctggtaccagcagaaacctggccaggcctcccaggcctcctcatctacggtncatccagccagggccagtggcactcccagacaggttcaggtggcaggtgggtctaggggaaatcttcactctctccatcagcagacgtggacgtccgtagaagttattttgctagttgtaatttacgtcgtactagactagttagttacggttaactccaaccttattcctaccgtttccggtacccgttacgggaacctaaggtcggtaacttacgtaacgaaacggtacttaggtacgtccgtagaaccc

SEQ ID NO: 181208 - DNA, 940 bp, Homo sapiens
  misc_feature: GYAE6OF02G5D8J.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccccgtgttcttcgtcctacgggaaaggggaaagcgacccctacccttcctccgtcgacgggacgggaccgtacgtacgaaggtacgtttacgttacgacgacgacgacgtacctttaacgttaccgtccggttacggtaaccgacgacgaaaaccgtaaaccggtccggaccggacggtcccctaccggacggtccctccctactacttaccggttacgggtcactacctaccgacgacgggaccgggtaccctacggtcggactaccctaccgaacgacggttacggtacgtagggtcggacgtaggggttcggtcgggtaaaggggaaaacttccgtacctaccttccttcccacctactcgacgtacgaacgttacggtacggaccttccgtaaagggtaaacgtttttacgttttcggacggtttaacggtttagttttaaacgttttacggtccgtaacgtacggtaacgttaaggttaggttaaaccggttaaccctaacctaaacctttacgtttacccgttaccggttttaccccgggtacccggttaaccgggaaaaccgtttaaacgggtacggttaaactttaaccgtaaaacccggaaaacccggtttagtttaccgggtacggttaccgtaccgtaacccgtaaccgttcgtttaacccggtttccggtttaccctttaccgttaaccccttttccccccggttacccccgactttaccgtttacccgggaaacggtttacccgggttacctaaccgggttaaccccgg

SEQ ID NO: 181209 - DNA, 544 bp, Homo sapiens
  misc_feature: GYAE6OF02I1PH8.38.26.C04.1.454.CMB.1.raw
  modified_base (317)..(317): a, c, t, g, unknown or other
  misc_feature (317)..(317): n is a, c, g, or t
  modified_base (431)..(431): a, c, t, g, unknown or other
  misc_feature (431)..(431): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggcccagtcagagtcttagcagcagctacttagcctggtaccagcagaaacctggccaggctcccaggctcctcatctacggtncatccagcagggcccacgtggcactcccagactaggttcaggtcggctaggtcgggtctaggggaaacgtcttcactcctcctccatccagcagactggacgtcctagaacgtntttcgactagttgtaactttacgtgtacagtctagtagttaggtactaccactatctacttccggccgtaggaacctaagtgaattacgtacgtaaacgacgtcgtcgctacg

SEQ ID NO: 181210 - DNA, 514 bp, Homo sapiens
  misc_feature: GYAE6OF02HEV4A.38.26.C04.1.454.CMB.1.raw
  modified_base (488)..(488): a, c, t, g, unknown or other
  misc_feature (488)..(488): n is a, c, g, or t
  modified_base (500)..(500): a, c, t, g, unknown or other
  misc_feature (500)..(500): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccactggcatcccagacaggttcagtggcagtgggtctgggaagacttcactctctccatcagcagactggagcctgaagattttgcagtgtattactgtcagcagtataggtaactcaacctacttctactttcgcccgtgggaccaagtggatacgtacaaacgtaacgtgtcggctgcacatctgtcttcntccttccgcctntctgacgttgatcg

SEQ ID NO: 181211 - DNA, 502 bp, Homo sapiens
  misc_feature: GYAE6OF02HAA5H.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtggtctgggaagacttcactctctccatcagcagactggagcctgaagattttgcagtgtattactgtcagcagtatggtactcactattcacttcgcctggaccaaagtggatatacaacgtaactgtcgctgccacatctgtcttcatccttccgctactcctgaacgtgatcg

SEQ ID NO: 181212 - DNA, 537 bp, Homo sapiens
  misc_feature: GYAE6OF02G01VL.38.26.C04.1.454.CMB.1.raw
  modified_base (215)..(215): a, c, t, g, unknown or other
  misc_feature (215)..(215): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (424)..(424): a, c, t, g, unknown or other
  misc_feature (424)..(424): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaaacctggccaggctcccaggctcctcatctacggtgcatcccagcgagggccacgtggcacgtcccagacagggtttcaggtggcaggtgggtctaggggaaancttcactctctccatcgagcagactggacncctagaagtntttgctagtgtattctgtcagctagtagtaggtaactcacctattctacgtttccggcccttagggaacctaaggtcgtaatacgtacgtaaacgtacgtggtacggactacg

SEQ ID NO: 181213 - DNA, 195 bp, Homo sapiens
  misc_feature: GYAE6OF02GM6NB.38.26.C04.1.454.CMB.1.raw
  modified_base (175)..(195): a, c, t, g, unknown or other
  misc_feature (175)..(195): n is a, c, g, or t
tcagtcgatcacgtcacgaccggtgctcgatttagtctagcgactttgggtttgggggaagaggaagactgacggtccccccaggagttcaggtgctgggacacagcggccctgggctgcctggtcaaggactacttccacgtgatcgactgagcgggctggcaaggcgcatagnnnnnnnnnnnnnnnnnnnnn

SEQ ID NO: 181214 - DNA, 551 bp, Homo sapiens
  misc_feature: GYAE6OF02G4XYX.38.26.C04.1.454.CMB.1.raw
  modified_base (344)..(344): a, c, t, g, unknown or other
  misc_feature (344)..(344): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatccgtccgatcttggcaaaccncactacgcacacaagttccaggacagactcacgattaccgcggacgaatccacgacgcacagtctacatggagatgagtacgctgagatctgacgacgacggccgtgttatttcgtgtcgacgtagacgggagggggccgagggggtctcggggtaggtaacggtttgggtcgtcgttttggagttacgttcggtaggggtaacccg

SEQ ID NO: 181215 - DNA, 525 bp, Homo sapiens
  misc_feature: GYAE6OF02GB8QP.38.26.C04.1.454.CMB.1.raw
  modified_base (317)..(317): a, c, t, g, unknown or other
  misc_feature (317)..(317): n is a, c, g, or t
  modified_base (521)..(521): a, c, t, g, unknown or other
  misc_feature (521)..(521): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggcctcccaggctcctcatctacggtncatccagcagggccacgtggcactcccagacaggttcaggtggactaggtgggtcgtagggaaactcttcactctctccatcagcagactggacgccgtagaagtatttgctagtgtattactgtcagtctagttagtagtaactcactattctacgtttcggcctacggaccgtaagtgatactacaaacgtactgtacggtntacg

SEQ ID NO: 181216 - DNA, 178 bp, Homo sapiens; identical to SEQ ID NO: 181199
  misc_feature: GYAE6OF02HQREX.38.26.C04.1.454.CMB.1.raw
  modified_base (173)..(178): a, c, t, g, unknown or other
  misc_feature (173)..(178): n is a, c, g, or t

SEQ ID NO: 181217 - DNA, 185 bp, Homo sapiens
  misc_feature: GYAE6OF02FTTS7.38.26.C04.1.454.CMB.1.raw
  modified_base (174)..(185): a, c, t, g, unknown or other
  misc_feature (174)..(185): n is a, c, g, or t
tcagtcgatcacgtcacgaccggtgctcgatttagtctagcgactttgggtttggggggaagaggaagactagacggtcccccaggagttcaggtgctgggcacagcggccctgggctgcctggtcaaggctacttccacgtgatcgactgagcgggctggcaaggcgcatagnnnnnnnnnnnn

SEQ ID NO: 181218 - DNA, 505 bp, Homo sapiens
  misc_feature: GYAE6OF02GP8VT.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagacttcactctctccatcagcagactggagcctgaagattttgcagtgtattactgtcagcagtatggtactcacattcactttcgcctgggaccaagtggatatacaaacgaactgtgctgctacatctgtcttctactccttcccgcctatcctgacttgatcg

SEQ ID NO: 181219 - DNA, 544 bp, Homo sapiens
  misc_feature: GYAE6OF02FNYYJ.38.26.C04.1.454.CMB.1.raw
  modified_base (187)..(187): a, c, t, g, unknown or other
  misc_feature (187)..(187): n is a, c, g, or t
  modified_base (353)..(353): a, c, t, g, unknown or other
  misc_feature (353)..(353): n is a, c, g, or t
  modified_base (370)..(370): a, c, t, g, unknown or other
  misc_feature (370)..(370): n is a, c, g, or t
tcagtcgatcacgtcacgaccggtgctcgatttagtctagcgactttgggttggggaaggacaagtgggtttaggatttagatttaacatgggtgacttttctgttttatttccaatctcagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctcccaggctcctcatctacggtgcatccagcagggccactggcatcccagacaggttcagtggcagtggtctgggaagacttcactctntcatcagcagactggancctgaagtattttgcagtgtatttacgtgtccagctagtagtggtaactcaccatttcacctttcggccctgggaaccaaaggtcgtatactacaaacgtaactggtaggccgttagcgaccataccgtgttctctaactcctttcccgcctacttcgtagacgttcgataccg

SEQ ID NO: 181220 - DNA, 523 bp, Homo sapiens
  misc_feature: GYAE6OF02H0LY2.38.26.C04.1.454.CMB.1.raw
  modified_base (478)..(478): a, c, t, g, unknown or other
  misc_feature (478)..(478): n is a, c, g, or t
  modified_base (488)..(488): a, c, t, g, unknown or other
  misc_feature (488)..(488): n is a, c, g, or t
tcagtcgatcacgtcacgaccggtgctcgatttagtctagcgactttggggtttgggggaagacaatggggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcaggggccactggcatcccagacaggttcagtggcagtgggtctgggaaagcttcactctctccatcagcagactggacgcctagagtattttgctagttgtattactgtcagctagtagtggtaactcacctattctacttcggcctcgggaacaagtgatatacgaacgaactgtagctgcacntctgtcttcncttcctcccgtccactcctagtaacgtgtactacg

SEQ ID NO: 181221 - DNA, 505 bp, Homo sapiens
  misc_feature: GYAE6OF02F271U.38.26.C04.1.454.CMB.1.raw
  modified_base (215)..(215): a, c, t, g, unknown or other
  misc_feature (215)..(215): n is a, c, g, or t
  modified_base (372)..(372): a, c, t, g, unknown or other
  misc_feature (372)..(372): n is a, c, g, or t
  modified_base (502)..(502): a, c, t, g, unknown or other
  misc_feature (502)..(502): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtcttagcagcagctacttagcctggtaccagcagaaacctggccaggctcccaggctcctcatctacggtgcatccagcagggccactggcatcccagacaggttcagtgcagtgggtctgggaaancttcactctctccatcagcagactggacgcctgaagtattttgctagtgttattactgtcagtcagtatggtaactcacctattctacttcggccctacggacctaagtgatatacaaacgtacgtgtgntcg

SEQ ID NO: 181222 - DNA, 550 bp, Homo sapiens
  misc_feature: GYAE6OF02IYRBZ.38.26.C04.1.454.CMB.1.raw
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctntcctgcagggccagtcagagtcttagcagcagctacttagcctggtaccagcagaaacctggccaggcctccaggctcctcatctacggtncatccagccgagggccacgtggcactcccagacagggtttcaggtggcaggtcgggtactaggggaaactcttcacgtctctccatcagcagacgtggacgctagaagtatttgctagtgtattacgtgtacagtctagttagtacggtaactcacctattacctacgtttccggcccgtagggaacctaaggttcgtaattaacgtaccgtaaacgtacgtaggtacgactacg

SEQ ID NO: 181223 - DNA, 559 bp, Homo sapiens
  misc_feature: GYAE6OF02JJ9EF.38.26.C04.1.454.CMB.1.raw
  modified_base (223)..(223): a, c, t, g, unknown or other
  misc_feature (223)..(223): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctccaggggaagagcccacctntcctgcagggccagtcagagtctagcagcagctactagcctggtaccagcagaaacctggccaggcctccaggcctcctcatcgtacgtcgcactccagccagggccacgtggcactcccaagccgaaggttcaggtggacacggtgggtctagggaactactccactctctcactcgacgtcacgtacgtagacgcctaggaatacgtttgacgtagttcgttatacgttactcgagtcgtagttaagtcgtaacctcgactacttacgtcttaccgggcctaacgggtactaaggtgtaacttactacgaaaccgttagtacgtaggtcctacg

SEQ ID NO: 181224 - DNA, 607 bp, Homo sapiens
  misc_feature: GYAE6OF02F2YBI.38.26.C04.1.454.CMB.1.raw
  modified_base (212)..(212): a, c, t, g, unknown or other
  misc_feature (212)..(212): n is a, c, g, or t
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctcaggggaangccacctctcctgcagggccagtcagagtcttagcagcagctacttagcctggtaccagcagaacctggccaggctcccaggcctccnatctacggncatccagcagggccatggcactcccagacaggttcagtgctgtgggtctagggaaatcttcgactcgtctccatcagcagtacgtcggacgtccgtagaagttacgttttacgacgtagttaggttaatttaccgttagtacgtagtacgtaagttaagttacggtaaccttaccgaaccgttactttacctaccggttttacccgggtaccccggttaacgggtaacccgtaaacggttacggtaacttaacgttaaccgtaaaccggttaacgttacgggttacgtaccgtaccgg

SEQ ID NO: 181225 - DNA, 499 bp, Homo sapiens
  misc_feature: GYAE6OF02F3BAA.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaacctggccaggctcccaggctcctcatctacggtgcatccagcagggccactggcatcccagacaggttcagtggcagtgggtctgggaaagacttcactctctccatcagcagactggagcctgaagattttgcagtgtattactgtcagcagtatggtaactcaccattcactttcgcctgggaccaagtgatatcaaacgactgtgctgcacatctgtcttcatccttcccgcactctgacgtgatacg

SEQ ID NO: 181226 - DNA, 550 bp, Homo sapiens
  misc_feature: GYAE6OF02HHCDO.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtccccctgcaaggcttctggaggcaccttcagcacctatactttcagctgggtgcgacaggcccctggacaagggcttgagtggatgggagggatcctcccgatctttggcaaaccacactacgcacacaagttccaggacagactcacgattaccgcggacgaatccacgagcacagtctacatggagatgagtagcctgagatcgtagaccgacgacggccgttgttactttcgtgtgcgaggaggagggggccgaggggcctcgggtacggtaacggttgggtagttcgttttaggagttagttcggtggggtaccg

SEQ ID NO: 181227 - DNA, 525 bp, Homo sapiens
  misc_feature: GYAE6OF02GCFPR.38.26.C04.1.454.CMB.1.raw
  modified_base (282)..(282): a, c, t, g, unknown or other
  misc_feature (282)..(282): n is a, c, g, or t
  modified_base (343)..(343): a, c, t, g, unknown or other
  misc_feature (343)..(343): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctggtgaaggtcccctgcaaggcttctggaggcaccttcagcacctatactttcagctgggtncgacaggcccctggacaagggcttgagtggatgggaggatcctccgatctttggcaaaccncactacgcacacaagttccaggacagactcacgattaccgcggacgaatccacgagcacagtctacatggagatgagtagcctgacgatcgtgacgacacggccgtgtacttctgtgcgagaggaggggcgaggggctcggtggttaacgttaggtgtcgttttgatagtcgtgggtaccgg

SEQ ID NO: 181228 - DNA, 554 bp, Homo sapiens
  misc_feature: GYAE6OF02HRM75.38.26.C04.1.454.CMB.1.raw
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
tcagtcgatcacgtcacgaccggtgctcgatttagtctagcgactttgggtttgggggaagacaatgggtttgatttagattacatgggtgactttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtgcagtggctgggaanctcactctctcatcagcagactggacncctagaacgtatttttcgcgtagtaggttattacgttgtcagcagtatagtaactcgactattctactttcgccgtaggactaaagtgtatagtacaaacgtacgtcgtagacgtcgacacctatcgtcgttccttcgtaaccttccgttcccgtaccctacttccgtacggtaaccgttgacttaccgg

SEQ ID NO: 181229 - DNA, 713 bp, Homo sapiens
  misc_feature: GYAE6OF02JOLD2.38.26.C04.1.454.CMB.1.raw
tcagtcgatcacgtcacgaccggtgctcgatttagtctagcgactttgggtttggggtcgtagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgccaggccagtcaggagtcttagcagcagctacttagcctgctaccagcaagaacctggccaggccctacccacggtctaccctcacgttcctacgggtgccactcccagcagggccacgtggcactcccacgacgtagttcgaggtcgggcctaggggttcggggtaccttacgggggaaaactccgtttaccgaaccttccgtacctcccgtaagttccgaacgccaaggtaccgtacggacgaccccgttaggaacgttacgtttttaggcctaacgggtttagttaacgttttaaccgtccggttacgtacgtaacggttaacgtttacgttacgggtaaaaccttccgtaacccgttcttttacccgttaacccgttttccccggggtaaccccttaaggggtaaaccccgttaaacgggttagtaacgttaacgttaacctaaaacccgggtaccgtttagggtacggttacccg

SEQ ID NO: 181230 - DNA, 176 bp, Homo sapiens; identical to SEQ ID NO: 181015
  misc_feature: GYAE6OF02G5MTB.38.26.C04.1.454.CMB.1.raw
  modified_base (173)..(176): a, c, t, g, unknown or other
  misc_feature (173)..(176): n is a, c, g, or t

SEQ ID NO: 181231 - DNA, 780 bp, Homo sapiens
  misc_feature: GYAE6OF02JK1UI.38.26.C04.1.454.CMB.1.raw
  modified_base (216)..(216): a, c, t, g, unknown or other
  misc_feature (216)..(216): n is a, c, g, or t
  modified_base (323)..(323): a, c, t, g, unknown or other
  misc_feature (323)..(323): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngcccacctctcctgcagggccagtcagagtcttagcagcagctacttagcctggtacagcagaaacctggaccaggcctccccgaggcctccgtcacttctacggtnccatcccagccagggcccacgttggcctactccccgaagacctacgggtttcaaggttcgggacctagggttgggtaccgttaggggaaaaccgtactttcccgtaccgttacccgttccgttaacccgtaacgttcccgtaacgaccgtaacgggtaaccgttacggggaacgtaccccggttaaggttaaacggtttacgtttttacgggaccgttaaagggtttacggtttaaacgtttaacccggttacggttaccgtaaggttacccttaagggtttaacgttacgggtttaaaccttacccgtaaccgttaaccgtttaccgttaacccgttttaccccgggtacccccggtttaagggtaaacccccgttaaaagggttaccggttaacgttaacccgttaaccggtaaaaacccggtaaccgtttacgggtaccggttcttaacccggg

SEQ ID NO: 181232 - DNA, 231 bp, Homo sapiens
  misc_feature: GYAE6OF02F4FXX.38.26.C04.1.454.CMB.1.raw
  modified_base (183)..(231): a, c, t, g, unknown or other
  misc_feature (183)..(231): n is a, c, g, or t
tcagtcgatcacgtcacgaccggtgctcgatttagtctagcgactttgggtttgggggggaaggagggaagacgtggacggtccccccaggagttcgaggtgctgggcacagcggccctgggctgcctcggtcaaggactacttccacgtgatcggactgagcgggctggcaaggcgcatagnnnnnnnnnnnnnnnnnnnnnnnnnnnnnnnnnnnnnnnnnnnnnnnnn

SEQ ID NO: 181233 - DNA, 561 bp, Homo sapiens
  misc_feature: GYAE6OF02GWIB1.38.26.C04.1.454.CMB.1.raw
  modified_base (216)..(216): a, c, t, g, unknown or other
  misc_feature (216)..(216): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtcttagcagcagctacttagcctggtaccagcaagaaacctggccaggcctcccgaggcctcctcatccgtacggtcgacatccgagccagggccacgtggacactcccaagacgtaggtttcacggtggctaggtgggtacgtaggggaaactcttacgactcgtctaccgatcgagcagtacgtggacgctagagttcgttgatagtagttattacgtcgtacagtactagttagtacgtactacaccttattctacgttcggccgtaggaaccgtaagtgtactactacgtaaacgtacgtggttacgctacg

SEQ ID NO: 181234 - DNA, 199 bp, Homo sapiens
  misc_feature: GYAE6OF02FMWQA.38.26.C04.1.454.CMB.1.raw
  modified_base (178)..(199): a, c, t, g, unknown or other
  misc_feature (178)..(199): n is a, c, g, or t
tcagtcgatcacgtcacgaccggtgctcgatttagtctagcgactttgggtttggggggaagaggaagactgaccggtccccccaggagttcaggtgctgggcacagcggccctgggctgcctggtcaaggactacttccacgtgatcgactggagcgggctggctaaggcgcatagnnnnnnnnnnnnnnnnnnnnnn

SEQ ID NO: 181235 - DNA, 582 bp, Homo sapiens
  misc_feature: GYAE6OF02G0HCA.38.26.C04.1.454.CMB.1.raw
tcagtcgatcacgtcacgaccggtgctcgatttagtctagcgactttgggtttgggggtaaggacaactgggtttgagtttagattacatgggtgacttttctgttttatttccaatctcagataccaccggagaaattgtgttgacgcagtctccaggcaccctgtctttgtctccaggggaaagtagccaccctctcctgcagggccagtcagagtcttaggcagcagctacttaggcctggtaccagcagaacctggccaggcctccaggctcctcatctacggtgcatccagcagggccactggcatcccaggacgaggttcaggtggcagtgggtactagggaagcttcacgtctctccatcagcagacgtggacgccgtgaagtacttttcgactagtagtattactgtacagcaagttagtacggtaactcgacctattacctacgtttcgacccgtacgggaccaaaggtacgactacgtacgaaacgacgttgtacgcgtagaccacgtactcgtagttaccttactacttccgtacccgacctactccgtacggaaccgtagtacgtaccgg

SEQ ID NO: 181236 - DNA, 519 bp, Homo sapiens
  misc_feature: GYAE6OF02HWXKV.38.26.C04.1.454.CMB.1.raw
  modified_base (316)..(316): a, c, t, g, unknown or other
  misc_feature (316)..(316): n is a, c, g, or t
  modified_base (515)..(519): a, c, t, g, unknown or other
  misc_feature (515)..(519): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagcccaccctctcctgcagggccagtcagatcttagcagcagctacttagcctggtaccagcagaaacctggccaggctcccaggctcctcatctacggtncatccagcagggccagtggcatcccagacaggttcagtcggcagtggcgtagggaaagcttcactctctccatcagcagactacggagcctagtaagattttgactagtagttaagttacttacgtacgacgcagtatacggtaactacacctattactactttccggtcccgtacggaaccgaaagtacgaatacgtnnnnn

SEQ ID NO: 181237 - DNA, 632 bp, Homo sapiens
  misc_feature: GYAE6OF02JH76Q.38.26.C04.1.454.CMB.1.raw
  modified_base (183)..(183): a, c, t, g, unknown or other
  misc_feature (183)..(183): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
  modified_base (370)..(370): a, c, t, g, unknown or other
  misc_feature (370)..(370): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctacttagcctggtaccagcagaaacctggaccaggctccaggctcctcatcacggtncaccgcngacgcncgcgacncctacgacagtcgtgngcgacgagtggtcgaaggaacgtactcactcgtccactcacgacgacgacgngtagactacgtagaagttcgttcgacgtagttagttacttagtcgagtacgacgtagtagtacgtaaccgtacctacgtacttaccgttaccgttacccggtaccggtaacgggtaaacgtaaacggtcggtaaacttaacgaaccggtaaaccgttacggtcgtcggtactacgtaccgtactacgttacgttaacgttaccttacgaacctttcccgttacccgacgttacttaccggtacgtaccgttacgtacgtcgg

SEQ ID NO: 181238 - DNA, 704 bp, Homo sapiens
  misc_feature: GYAE6OF02JYRTF.38.26.C04.1.454.CMB.1.raw
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
tcagtcgatcacgtcacgaccggtgctcgatttagtctagcgactttggtttggggtcgagagctctggagaagagctgctcagttaggacccagagggaaccatggaaaccccagcgcagcttctcttcctcctgctactctggctcccagatacccaccggagaaattgtgttgacgcagtctccaggccaccctgttctttgtacctccgaggggaaagagcccacccttntcccttgcgaacggggcccagtccagacgttcttagctaggcagtctaccttagccctggtaccagcaagaacctggccagctcccaggcttccncatcctacggtcgctacgtcccaaggtccgaggggaccctaaccgtgggacccaacgttcccccaaggaccgtaagggttttaccccgaggttttcgggacccgttagggttagggggtacccgttagggggaaaaccgtaacgttttccgaacccgtttacgtccgttaccgacctacgtacgacgtaccgacgttacggacgccgttaacgtagtacgttttacgcgtaagttcggttaaatttccgttgttaacgcgtacgtaagttacgtacggtaacctacgtaccgtatttacgttccgtttccggacccggttggtaaccctaggtacgtaagttagaaccgtaaacgtacttaggtacgtactacgg

SEQ ID NO: 181239 - DNA, 666 bp, Homo sapiens
  misc_feature: GYAE6OF02GACO5.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtctagcagcagctactagcctggtaccagcagaacctggccaggcctcccgaggctcctcatcgtacggtgcatccagccgaggggcccacgtcggcacgtccccgagaacctagggtttccaggttcggactagggttcggggtacctaggggaaaacgtcttcgaccttccgtactacccgtagttccaacggtccaacggtacgtgggacgtccgttagaagttagttttcgaccgtaggttacgttaagtttaccgtgttaccgagtacgtaagttacgttacggttaacctccgtaaccgttacgtttacccgtaaccgtttcccgggtaaccccgttacgggtaaaccctaaaggttcggtaacgttaacgttaaccgaaaaccggttaccgttacgggtaccggtacgtaccgg

SEQ ID NO: 181240 - DNA, 521 bp, Homo sapiens
  misc_feature: GYAE6OF02G245F.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcactcccagacaggttcagtggcaggtgggtctgggaaagcttcactctctccatcagcagactggacgcctagaacgtattttcgactagtgtattactgtcagcagtatgtactcacattctacttcgcctgggaacaaggtgatactacaaacgtactgtgctgaccacatctgttcttcacttccttcccgctactcgtagtaacgtgataccgg

SEQ ID NO: 181241 - DNA, 683 bp, Homo sapiens
  misc_feature: GYAE6OF02JDCH3.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaagagcccaccctctcctgcagggccagtcagagtcttagcagcagctacttagcctggtaccagcacgaaacctggcccaggcctcccaggcctcctcactccgtacggtcgctactccagcgtacggggccaacgtcggacctacgtcccagaccgtacggtttccgaagttcgggctagggttcggggtcgtacggggtaaacgtaccgtttaccgacccgttcttaccgtaccctagtacccgtagacgtacggacggttcgggactccgtaaggtaacgttacttttacggcgtacgttagttacgttaccgtcgtacgacgtacgtaaggtttaccgttaacggtaaaccctacgtaacccttacgtttccgtaccggtttacccgggtcccgttaacgggaacccgttaaagggttcgtaacttacgtaacgaaaccggttaacgttcggtacggcttaacccg

SEQ ID NO: 181242 - DNA, 589 bp, Homo sapiens
  misc_feature: GYAE6OF02GOVH5.38.26.C04.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtcttagcagcagctacttagcctggtaccagcagaaacctggccaggcctcccgaggcctcctcattccgtacggtgcatccagcagggccactcggcactacccagacaggtttcaggtcggcaggtcgggtacgtaggggaaactaccgttacaccgttctcctacctatcagccagacgtggacgccgtagaagttagtttgacgtagtacgttagttacgttgttcgtagtctagttaattcggtaaactcgtacctattccgtacgtttccggtcccgtaggtaacccgaaggttacggtaattacgtaacgaaaccggtacgtacggttcggactacgg

SEQ ID NO: 181243 - DNA, 584 bp, Homo sapiens
  misc_feature: GYAE6OF02FSQ4R.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaagagccaccctctcctgcagggccagtcagagtcttagcagcagctacttagcctggtaccagcagaaacctggccaggctcccgaggctcctcatctacggtgcatccagcagggccacgtggcactcccagacaggttcagtggcaggtgggtctagggaatctcactctctcatcagcagacgtggacgtccgtagtaagttacgttttcgcgtaggttcgttaattacgttgttacgtagtcgtaaggttacgttacggtaacctacctaacctacgttaccgttaccgtttaccgggtcccgttacgggaacctaaacggttacggtaagttacgtaccgtaaaccgtacgtggtacggtacgtacg

SEQ ID NO: 181244 - DNA, 647 bp, Homo sapiens
  misc_feature: GYAE6OF02G1OPL.38.26.C04.1.454.CMB.1.raw
  modified_base (356)..(356): a, c, t, g, unknown or other
  misc_feature (356)..(356): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggaccaaggggtcttggagtgggagtggggagggatccgtcccgattcgttggccaaaccncactacgcacacacgtcagacagactcacgacttaccgacggacgaactccacgagccaacgtagtctacagtacggagtagtggacgtacgccgtagagtactcgttacggaaccggaccgaccgggtccgttacggttaacgtttttccgtggttacggcgggtaaggacggggtacggggggtaccggtaaggggggtccggttaccgggggttacgggttaaaccgggttttggggtacggtttcggttttaggtaagtttacggttccggtacggggtaacccggg

SEQ ID NO: 181245 - DNA, 783 bp, Homo sapiens
  misc_feature: GYAE6OF02JOQMQ.38.26.C04.1.454.CMB.1.raw
  modified_base (329)..(329): a, c, t, g, unknown or other
  misc_feature (329)..(329): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctaccgaggggaaagcgccaccctctcctgcgagggccagtcagagtcttagcagcagctactagcctggtaccagcaagaaacctggccaggcctcccgaggcctcccgtcacttccgtacgggtncctactccaagccggacgggccacgtcggacctactccccgaagtaccgtagggtttaccaaggttcgggacctagggtgggtaccgtagggggaaaactccttacgaccttccgttaccctaccgtactaccgaacggtacgtaacgtaacggttacgggacctaccggttaaggtaaacgtttcggttttacggacttaacggggtttactttaacgtttaaccggttgttacccggaaaggttaccgttaacgggtttaacgttaccggggtaaaaccctttcccggtaaccttaacgttttacccgtttaacccgggttttacccggggaaacccggtttaacgggggaaaaccgtttaaaaccgggttacggttaaacccgttaacggttaaacccggtaaaccgggttaaaccggtttcgggtttaaaccgggtccggttaaacccgg

SEQ ID NO: 181246 - DNA, 637 bp, Homo sapiens
  misc_feature: GYAE6OF02GNFYZ.38.26.C04.1.454.CMB.1.raw
  modified_base (340)..(340): a, c, t, g, unknown or other
  misc_feature (340)..(340): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccactggcatcccagacaggttcagtggcaggtgggtctgggaaancttcactctctcatcagcagacgtggacgtcctagtaagtattttgctaggttacgttactttactgtcagtctagttatacggtaacctccaacctatttacctaccgttttccgggacccgttagggaacccgttaaaaggttcggtaaattaccgtaaccgtaaaaccgtaacgttgggtacggtacgtaccgtaccgtaccctagttaccgttcgttaccttttaccgaacgtttccccgttccccgtacctaacgttacccttacgggtaacccgttaggtacttaacccgg

SEQ ID NO: 181247 - DNA, 676 bp, Homo sapiens
  misc_feature: GYAE6OF02GZW6W.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtcttgtctccgaggggaaagagccacctctcctgcagggccagtcagagtcttagcagcagctacttagcctggtaccagcaagaaaccgtggaccagggtcctacccgaggtccttcccgtacacgttccgtacggtcgcctacgtcccgagtccgagggccctacgtcggaccacgtccccgaagtaccgtacggtttccaggttcggactagggtcgggtacgtagggtaaacgtccttacacgttcgtcctaccaagttccgaagtcgtaacgacgtacggtacgtaccgttaggtaagttagttttgacgttagttagttactttacgtcgtacgtacgtcgtaagtacgttacggtaaccttccgtaaccttagttaccgttaccgtttaccgggtcccgttaacgggaaaccgttaacgtacggtaacttaacgtaacgtaaacggttaacggttcggttacggaccgttaccg

SEQ ID NO: 181248 - DNA, 176 bp, Homo sapiens; identical to SEQ ID NO: 181015
  misc_feature: GYAE6OF02GCDTE.38.26.C04.1.454.CMB.1.raw
  modified_base (173)..(176): a, c, t, g, unknown or other
  misc_feature (173)..(176): n is a, c, g, or t

SEQ ID NO: 181249 - DNA, 665 bp, Homo sapiens
  misc_feature: GYAE6OF02H6LJ6.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtcgggtcgtagggaaagacgttcactctccgtccatcagcagactggacgcctagaagtatttttcgactaggttgttattaccgttagtcgaggtactagttaacgtaggttaaacctccgtaacctaactttaccgaaccgttttacccggggacccgttacggggtaaaccctaaaggttacggtaacttaacgtaaccgaaaaccgttaacgtacggtagggtaccttacggacccgtaacctacgttccgttacgtttaccttaccgttacctttacccgttaccccgtcccgtaacttcccgtttaacggtaaccgttcggtaacttacccgg

SEQ ID NO: 181250 - DNA, 650 bp, Homo sapiens
  misc_feature: GYAE6OF02I86BC.38.26.C04.1.454.CMB.1.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagatacccaccggagaaattgtgttgacgcagtctccaggccaccctgtctttgtctccgaggggaaangccaccctctcctgcgagggccagtcagagtcttagcagcagctactgcctggtaccagcagaaacctggccaggcctcccaggcctccncactccgtacggtgcactcccagccgacgggccctacgtcggacactcccgagtaccgtacggttcacggtcggacgtaggtcggggttacgtaggggtaaactcgttaccgaccttccgtaccttccagtccgtaacgccgaggtaccgtacgggacgtaccgtacggtaagtttacgttttgacgtacgttgttaatttacgtcgttacgacgtacgtaggtttacgtaacggtaacctctaaccgttacttacctaccgtttccggacccgttacgggtaacctaaggttacgtaacttacgtaaccgtaaaccgtaccgttacggtacgtacgtaccg

SEQ ID NO: 181251 - DNA, 660 bp, Homo sapiens
  misc_feature: GYAE6OF02I08ZL.38.26.C04.1.454.CMB.1.raw
  modified_base (351)..(351): a, c, t, g, unknown or other
  misc_feature (351)..(351): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagagcctgggtcctcggtgaaggtccccctgcaaggcttctggaggcaccttcagcacctatactttcagctgggtgcgacaggcccctggacaaggggcttggagtggatggggagggactccgtcccgatctttggcaaaccncactacgacacacaagttccaggacagactcaaccgtattacccggacggacgaactacccgacgacgacaaccagtacctacgaagtcgggaagtataggacggttaacgacccttaggacgtacgttacgtacgaaccggaccgtaccggggcccgttagttacttttacgtggttacggacggaggacgggaacgggggggtcccaagggggggtccgttaccgggggttagggttaaacggtttaggggttacggttacgtttttacggaacgtttacggtttaccgggtacggggtaacccggg

SEQ ID NO: 181252 - DNA, 636 bp, Homo sapiens
  misc_feature: GYAE6OF02JCSFA.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacctctcctgcagggcagtcagagtcttagcagctagctacttagcctggtaccagcagaacctggccaggctccgaggctcctcatctacggtgcatccagcagggccacgtggacagtcccagaccaggtttcaggtggtaccaggtcgggttactaggggaaaactcgtttaccaacttcgtccgtaccacgttacacgtcgtacgaccgtaggacgtaccgttagtaacgtacgttttgacgtaggttagttacgttacgtacgttacgtacgtacgtaagttagttaacgggtaactacctaaccttacgtttaccgtaaccgttttcccgggtcccgttacgggtaaccctaaacggttacggtaacttaacgtaccgtaaacgttaacgttacggtacggtacgtaccgg

SEQ ID NO: 181253 - DNA, 685 bp, Homo sapiens
  misc_feature: GYAE6OF02GP7Z6.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggaccaggcctcccgaggcctcctcatctacggtgcatccagcagggccacgtcggcactcccagacctaggttcaggtcggactaggtgggtcgtaggggaaacgtcttacactctaccgtccatcgagcagtacgtggacgtccttaggaagttagttttgacgttaggttacgttaacgtttaccgttggttaccgtaacggtacgttaaggttaacgtttacgggttaaacccttaccgtaacccgttaacgttttacccgttacccggtttttaccccggggtaaccccggtttacgggggtaaaccccttaaaacggggttacgggttaaacgttaacggttaaccggtaaaacccggttaaccgttacgggttacgggtacccttaacccggg

SEQ ID NO: 181254 - DNA, 555 bp, Homo sapiens
  misc_feature: GYAE6OF02FOL3B.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccacctctcctgcagggccagtcagagtcttagcagcagctacttagcctggtaccagcagaaacctggccaggctcccaggctcctcatctacggtgcatccagcaggggccactggcatccagacaggttcagtggcagtgggtctgggaagcttcactcgtctccatcagcagatggagcctaggaagtattttcgctagttgtattacttgtctagtcgtaagttataggtaactcgtaacctatttacctacgtttccggacccgttagggtaacccgtaaaggttcggtaattacgtacgaaaaccggttaacgtcggtacggtactaccgg

SEQ ID NO: 181255 - DNA, 619 bp, Homo sapiens
  misc_feature: GYAE6OF02HL5W5.38.26.C04.1.454.CMB.1.raw
  modified_base (301)..(301): a, c, t, g, unknown or other
  misc_feature (301)..(301): n is a, c, g, or t
  modified_base (484)..(484): a, c, t, g, unknown or other
  misc_feature (484)..(484): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgttctttgtctccgaggggaaagacgccaccctctcctgccgagggccagtcagtagtcttagcagcagtctactagcctggtaccagcacgaaacctggcacggcncccgaggcctctcatctacggtgacactccgagcgacggccacgtgaccactcccagtaccgtaggttcgaggtcgacgtggttgggtacgtagggaactcctacgactccgtctccagtcagtcgaagcgtaggactacgtagtaagttacgtttgacgtagttgtttaacttcgtacgtanacgtagtacttacggtaacttacgaccgttaacttaccgttacccgttcggttacccggtaccggtacggtaaaccgtaaggttacgtaactaaccttaaccggtaaaccgtagttacggttcgacgttaacccg

SEQ ID NO: 181256 - DNA, 621 bp, Homo sapiens
  misc_feature: GYAE6OF02GVPZD.38.26.C04.1.454.CMB.1.raw
  modified_base (213)..(213): a, c, t, g, unknown or other
  misc_feature (213)..(213): n is a, c, g, or t
  modified_base (315)..(315): a, c, t, g, unknown or other
  misc_feature (315)..(315): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtcttgctccaggggaaangccacctctcctgcagggccagtcagagtctagcagcagctactagcctggtaccagcagaaacctggccaggcctacccgaggcctcctcatcgtacggtncactccagcgacgggccacgtcggacactcccgagaccgaggttcacggtggctaggtgggtcgtagggaactacgttcacttcgtctaccatcgagacgtacgacgtcggacgtcgtagaagttagtttcgactaggtagttattacgtgttacgagtcgttaaggttaagttacggttaacctaccgtaaccgttaacgttacccgttacgtttacccggtacccggttaagggtaaacccgtaaaggtccggttaaattaacgtaaccgaaaccgttaaccgtaggtacggtacttaacccgg

SEQ ID NO: 181257 - DNA, 188 bp, Homo sapiens
  misc_feature: GYAE6OF02GJS1R.38.26.C04.1.454.CMB.1.raw
  modified_base (175)..(188): a, c, t, g, unknown or other
  misc_feature (175)..(188): n is a, c, g, or t
tcagtcgatcacgtcacgaccggtgctcgatttagtctagcgactttgggtttggggggaagaggaagactgacggtccccccaggagttcaggtgctgggcacagcggccctgggctgcctggtcaaggactacttccacgtgatcgactgagcgggctggcaaggcgcatagnnnnnnnnnnnnnn

SEQ ID NO: 181258 - DNA, 691 bp, Homo sapiens
  misc_feature: GYAE6OF02G4N6C.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaacctggccaggctcccaggcctcctcatcgtacggtgctatccagcgagggcccacgtcggcactcccgagacaggttcagtggactaggtgggtcgtagggtaacacgttcactcgtctaccactcgtacgcacgtacgtacggacgtcgtagtaacgttagttttcgacgtaggttacgttaacttacgttacgtacgtagtacgtaacgttaagttaacgggttaaaccttacccgtaacccttaacgtttacccgttaacccggtttttaccccgggtaccccgtttaaccggggtaaaccccggttaaaacgggtttaaccggggttaaacgtttaaccggttaacccggttaaaaaccgggttaacccggtttaaccgggttaccgggtaaccgtttaacccggg

SEQ ID NO: 181259 - DNA, 703 bp, Homo sapiens
  misc_feature: GYAE6OF02GZE6N.38.26.C04.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtctagcgactttgggtttgggcagagcggtctggagaagagctgctcaggttaggaccccagacgggaaccatcggaaaccccgagccgcagcttctcttcctcctgctactctggactcccagatacccaccgggacgaaattgtgttcgacgcagtctccaggccacccgtgtcttgtcctccaggggaaanagccacctctcctgcaggccagtcaggacgtctagcagcagtctaacttagccttggtaccagtactaacgaaacctggaccacggcctaccccaggccctaccgtcagttccgtaacggtgcgaactccaaggtccgacggggccctacgtcgggaccacgttacccagacgtaggtttccgaacggtcggacgtacgggttacggggacggttaaacggggaaaccgtttacccgttaccgaccgtttaaccgtcctttacccgtaacgtacgaccgtcgaacggttaccgttacgggacgtacccgtaaggtaacgttacgttttagtactaggtttagtacgtttacgttcgtacgacgtcgtaacggtattacgtactacgtacctacgttcttacgttccggtccgtacgggtaacgtaacgtacgaacttaacgtaccgtaaacgtaccgtacggtacgtcgtaccg

SEQ ID NO: 181260 - DNA, 662 bp, Homo sapiens
  misc_feature: GYAE6OF02IB7CV.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggaccccagagggaaccatggaaaccccagcgcagcttctcttcctcctgctactctggctcccagataccaccggagaaattgtgttgacgcagtctccaggcaccctgtctttgtctccaggggaangccaccctctcctgcagggccagtcagatcttagcagcagctactagcctggtaccagcagaacctggccaggctacccgaggcctcctacgatcctacggtgctactccagccaggggcccagtggacctacgtcccgaagacgtagttacgaggtggcaggtgggtcgtagggaaacgtaccttacaccgtctcctacctatccgaagtccgaagtaccgtagggagtcccgtaggtaacgttagttttcgatacggttagttaacgttttacgtacgttcgtaacgtcgttaaggttaacgttacgggttaaaccctccttaaccgttacgttaccgttaacccggtttttccgggaaccccggttaacgggtaaacccgtaaagggttacggtacgttaacgtaacgtaaaaccggttacgttacggtcgggtacctaaccgg

SEQ ID NO: 181261 - DNA, 790 bp, Homo sapiens
  misc_feature: GYAE6OF02H2PGG.38.26.C04.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcnccctgtctttgtctccgaggggaagagcccacctctcctgcagggccagtcagatctagcagcagctattagcctaggtaccagacaagaaaccgtggaccaaggtcctaccccgaggtcctaccgtcaacgttccgtaacggtcgacctactccgaggcgacggggcctacgtcggacctaacgtcccgaaggtaccgtacgggtttacgacgggtcggtaccgtaagggtttcgggggtaccggtaagggggtaaaaacgttccgtttaccggtaaccgtttcccgttacccgtaccctaacgtaccgaacggtacgtaacggtaaccggtagggtaaccgtaccggttaaggtaaacggtttacgttttacggacgttaacggttacggtttaactttaccggtacggttaccgtaacggttaacgtaacgggtttaacgttaacgggttaaaccctaaccgtaacccgttacgttttacccgttacccggttttacccgggcccggtttaaaccgggtaaccgtaaacgggttacgtaacgttacggttaaacccgtaaaccgttaacggtttacggttaccggtacgttacccgg

SEQ ID NO: 181262 - DNA, 566 bp, Homo sapiens
  misc_feature: GYAE6OF02IZZIN.38.26.C04.1.454.CMB.1.raw
  modified_base (216)..(216): a, c, t, g, unknown or other
  misc_feature (216)..(216): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctcccaggcctcctcatcctacggtgccatccagccaggggcccactggccactcccagacaggttcaggtggcaggtgggtctaggggaaactcttcactctctccatcagcagacgtggacgcctagaagtatttgctagtagttattacgtgtacagctagtagtaggtaactacacctacttactacgtttccggtacccgtagggtaccctaaaggtacggtaagttaacgtaccgtaaaaccggtaacgttacggtacggacgtacgg

SEQ ID NO: 181263 - DNA, 755 bp, Homo sapiens
  misc_feature: GYAE6OF02IUXAX.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccgaggcaccctgtctttggtcctccgaaggggaaagcgccaccctctcctgcgacgggccagtcagagtcttagcagcagtccttacgttacgcccgtaggtaaccccaaggaccgaaacgtaaacccgttcgggacccgtacgggccctaccccgagggtcccttccgtacacgttccgttaacggtcgacctactcccgaaggccgacggggccacgtcggaccacgtcccaaggaccgtaggttcaaggtcgacgtagggtcgggtacgtaaggggaaactccttaccgtaaccttccgtactaccgtaataccggagtaccgaaggtaccgttacgggacccgtacgttaaggttaacggtttacggttttcgaacggttacggttacggtttaacgttacgtcgttaccgaagggttaccgtaaggttaaccgtttaccgggtaaaccctacgtaacccttagtttacccgttaaccggtttccgggtaacccggttaacgggaaacgttaacggtagtaaccgttaacgtaaccgtaaacggtaccgttggtaccggtctaacgg

SEQ ID NO: 181264 - DNA, 595 bp, Homo sapiens
  misc_feature: GYAE6OF02HGGTA.38.26.C04.1.454.CMB.1.raw
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcgggtgaaggtcccctgcaaggcttctggaggcaccttcagcacctatactttcagctgggtncgacaggcccctggacaagggcttgagtggatggggaggatcctcccgatcgttggcaaacncactacgcacacagttccagacagactcacgacttaccgcggacaatccacgagcacagtctacagtaggagatgagtacgccgtagagtactacgtagaaccgtacgacggtaccgttagttacttttcgtcgtcggcgtacggaggacggggggtacccgagggggtaccgttacggggtaggttaaccgggtttagggttcggttacggttttggaacgtttacgttacgggtggggtaacccggg

SEQ ID NO: 181265 - DNA, 719 bp, Homo sapiens
  misc_feature: GYAE6OF02GYBMZ.38.26.C04.1.454.CMB.1.raw
  modified_base (216)..(216): a, c, t, g, unknown or other
  misc_feature (216)..(216): n is a, c, g, or t
  modified_base (245)..(245): a, c, t, g, unknown or other
  misc_feature (245)..(245): n is a, c, g, or t
  modified_base (325)..(325): a, c, t, g, unknown or other
  misc_feature (325)..(325): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggccaccctgtctttgtctccgaggggaangcccaccctctcctgcagggccagtcagngtctagcagcagctacttagcctggtaccagcaagaacctggccaggcctcccgaggcctaccgtcacgtccgtacggtnctactccgaggccgagggcccacgtcggaccactacccgagtactagggtttccaggtcggacgtagggttcggggtaccgtaagggggaaacttacccgttccgtaaccgtttcccgttcctacccgtattccgaacggtactaacggtaccgtacggtaccgtaccgttaaggttaaacgtttacgtttcggacgttaacggtttcgtttaacgtttaccgttacggttactaacggtcgtaagttacgttaacggttaacctacgtaaccgttacgtttaccgttacccggtttacccgggtacccgttaacggggtaaacccttaaagggttacgttaacgttaaccgtaaccggtaaaccggttacggttcggtacggtcgtaacccgg

SEQ ID NO: 181266 - DNA, 567 bp, Homo sapiens
  misc_feature: GYAE6OF02JB8LK.38.26.C04.1.454.CMB.1.raw
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (371)..(371): a, c, t, g, unknown or other
  misc_feature (371)..(371): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggtcactcccagacnggttcagtggcagtgggtctgggaacgcttcactctcncctatcagcagctggacnccgtagtaagtattttgctagtgttatacgtgtctagcagtagtacggtaaccttcactattacctacttccggccctagggaccgtaagtggactacgtactaaacgaactggtacggtctgaccactatcgtcttaccgttaacttcccgttcccgtaccttataccgttacgacggtacgttacgtcgtaacg

SEQ ID NO: 181267 - DNA, 587 bp, Homo sapiens
  misc_feature: GYAE6OF02IANKH.38.26.C04.1.454.CMB.1.raw
  modified_base (217)..(217): a, c, t, g, unknown or other
  misc_feature (217)..(217): n is a, c, g, or t
  modified_base (464)..(464): a, c, t, g, unknown or other
  misc_feature (464)..(464): n is a, c, g, or t
tcagtcgatcacgtcacgaccggtgctcgatttagtctagcgactttgggtttgggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtcttagcagcagctacttagcctggtaccagcagaaacctggcccaaggctcccgaggcctcctcatcgtacggtgctactcccagcgaggggccacgtcggacactcccaggacctagggttccaggtcgggacgtaggttcggggtccgtaggggaaacgtacctttcgacttcgtctccatcagcagactggacgcctgaagtatttgactagtntattctgtcagtctagttagttacggtacttactaccatttaccgtaccgtttcggacccgttacgggtaacctaaaggtacggtaattacgtaaccaaacggtacgtggttacggacttacg

SEQ ID NO: 181268 - DNA, 541 bp, Homo sapiens
  misc_feature: GYAE6OF02JA7SS.38.26.C04.1.454.CMB.1.raw
  modified_base (183)..(183): a, c, t, g, unknown or other
  misc_feature (183)..(183): n is a, c, g, or t
  modified_base (284)..(284): a, c, t, g, unknown or other
  misc_feature (284)..(284): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (381)..(381): a, c, t, g, unknown or other
  misc_feature (381)..(381): n is a, c, g, or t
  modified_base (489)..(489): a, c, t, g, unknown or other
  misc_feature (489)..(489): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctattagcctggtaccagcagaaacctggaccaggcctcccaggctcctcatctacggtncatccagcagggccagtggcactcccagcaggttcagtgcaggtggtcngggaaanctcactcactcatcagccagactggactccgtagaaacgtnttttcgactacgtgtacttacgtcgtcagctagtacgtaggtactcactattacgtacttcggcctggaacaagtggatacgtacaacgtactgtcgctcgacacgtntacgtcgtacctctactcctacccgctacgtccgtaggaccgtagtgtaccg

SEQ ID NO: 181269 - DNA, 632 bp, Homo sapiens
  misc_feature: GYAE6OF02IDAGU.38.26.C04.1.454.CMB.1.raw
  modified_base (183)..(183): a, c, t, g, unknown or other
  misc_feature (183)..(183): n is a, c, g, or t
  modified_base (314)..(314): a, c, t, g, unknown or other
  misc_feature (314)..(314): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctacttagcctggtaccagcagaaacctggccaggctcccaggctcctcatctacggtgcatccagcagggccactggcactcccagacnggtcagtcggcgaggtgggtcgtagggaagacgttcacgtctctccatcagcagacgtaggacgcctgaagtagttttgactagtgttattacgtcgtacagacgtagtactaggttaactacgtacctacttccttaccgtttccggtacccgtacgggaaccgtaaaggttaggtaacttaacgtacgaaacgtaacgttaggtacggtacttacggacctaccgtacgttccgttacgttccgttaccgttaaccttacccgttaccccgtacctaacgttacccgtacggtaaccggttacgtacgttacccgg

SEQ ID NO: 181270 - DNA, 627 bp, Homo sapiens
  misc_feature: GYAE6OF02FP7DX.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcaggccagtcagagtcttagcagcagctacttagcctggtaccagcagaaacctggccaggctccaggctcctcatctacggtgcactccagcagggccacgtggcactcccagacgaggttcaggtggctaggtgggtcgtgggaacgtacttcgactctctccatcacgcagctggacgccgtagaacgtattttgacgtagttagtatttacgtgtcagtactagtacgtacggtaacttcgaacctatttacgtaccgtttccgtaccttccggtacgggtaaccgtaaaggttcggtaacttaacgtaacgtaaaccgtaacgttaggtacggacgtacgtaccgaccgtacgttccttacgttccttacctaccgtttcccgttcccgtaccgttacgttcccgttacgtaccgttacgtaccg

SEQ ID NO: 181271 - DNA, 663 bp, Homo sapiens
  misc_feature: GYAE6OF02I2BE0.38.26.C04.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattggtgttgacgcagtctccaggcacctgtctttgctccaggggaaancgccacctctcctgcagggccaggtcagagtctagcagcagctactagcctggtaccagcaagaaacctggaccaggctcccgaggtcctccgtcatcgtacggtgcatcccgagctaggggccaacgtcggactagtcccagacgtaggttcaaggtcggactaggtcgggtcgtaggggaaactccttcgtacctctcctcctatcacgacaggtacgtacggacgtccgtagaacgttagttttcgacgttaggtacgttaacgttacgttcgtacgtacgtacgtaaggttacgttaacggttaacctaccgtaaccttacgtttaccgtaaccgttttaccgggtaaccccgtttaacggggaaacccgttaaaggttacgggtaactttaacggtaaccgttaaaaaccggtacgttacgggttacggttaccgttaacccgg

SEQ ID NO: 181272 - DNA, 875 bp, Homo sapiens
  misc_feature: GYAE6OF02JIWOC.38.26.C04.1.454.CMB.1.raw
  modified_base (215)..(215): a, c, t, g, unknown or other
  misc_feature (215)..(215): n is a, c, g, or t
  modified_base (315)..(315): a, c, t, g, unknown or other
  misc_feature (315)..(315): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanacgccacctctcctggcagggccagtcagagtctagcagcagctactgcctggtaccagcagaacctggccaggcctcccaggctcctcactctacggtnacactccagcgacgggccacgtggactactcccgagtaccgtacggttacgacggttggaccgaggttcgggggttaccgttagggggaaaaacggttcctttacgtaacccgtttcccgttacccgttacccgtaaacgtaccgtaacgggtaccgaacgggtaaccgttacggggtaaccgtaacccggttaacgggtaaacgggtttaacgttttttaccggacgtttaacggtttacgggtttaaaccgttttaacgttaaccggtttaccggtaaacgggttacccggttaaaacgggtttaaccggtttaacccggggttttaaaacccgttaacccgtaaacccgtttaaccgtttttaccccggttttaaacccggtttttaccccggggttaacccccggggtttttaaacccggggggtaaaacccggttaaaaaccggggtttaacggggtttaaaccgtttaaacccggtttaaaccgggtaaaaaaccccggtttaaaccgggtttacccggggttttaaccggggttaacccgtttaaccccgggg

SEQ ID NO: 181273 - DNA, 671 bp, Homo sapiens
  misc_feature: GYAE6OF02GD8VI.38.26.C04.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgttctttgtctccgaggggaaanacgccaccctctcctgcagggccagtcagagtcttagcagcagctactagcctggtaccagcagaacctggccaggcctacccgaggcctcctcatcgtacggtgctatccagcgaggccacgtcggctactcccagaccgtagggtttccaggttcggcgtagggttcggggtacgtaaggggaaactaccgttccgtaacgttcctacgttacccgattaccgacggaccgtacgtaccggtacgggaccgtacccgttaaggtaacgtttacgttttacggaccgttaggttacgtttaatttaccggtagttaccgagtacgtagttacgttacggttaaacctccgtaacctactttaccgtaccgtttccgggtacccgttacgggtaaccgtaaggttacgtaacgttaactaaccggaaaccgttaggttcgtacggtcgtaaccg

SEQ ID NO: 181274 - DNA, 714 bp, Homo sapiens
  misc_feature: GYAE6OF02H50L9.38.26.C04.1.454.CMB.1.raw
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttctctttgtggtggcagcagctacaggtgtccagtcccaggtgcagttggtgcagtctggggctgaggtgaagagcctgggtcctcggtgaacggtcccctgcaaggcttcnggaggcaccttcacgcacctatacttcagtctgggtncgacacggcccctggacaaggcttggacgtggtagtggggagggtactccgtcccggtattccgtttggacctaaaccactaccgtaccgtacacaacctaacgttaccaaggtacacgtactaccagtaacgttacccgccgggaaccgtaacgtccgaaccggaacgtcaacgtacgttactaaccgaacgttgggaacggaattacggaagttacggcccgttaggagtaacgtacgtacggtaccggaccgaacgggtcccggttaagttaccgttttacgtacggttcggtacgggaggtacggggaacgggggtacccggtaagggggggtccctttacgggggttaacggggttaaccgggtttaaggggttcggtttacggtttttacgaaggtttgtttaccgggtaggggttaacccgggg

SEQ ID NO: 181275 - DNA, 508 bp, Homo sapiens
  misc_feature: GYAE6OF02GV9Z2.38.26.C04.1.454.CMB.1.raw
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (464)..(464): a, c, t, g, unknown or other
  misc_feature (464)..(464): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaagcttcactctctcatcagcagactggancctgaagtnttttgacagtgtattactgtcagcagtatggtaactcacattcacttcgcctgggacctaagtgatatacaacgactgtggctgcactntcgtgtcttcacttccgtcccgctactcctagtacgtgataccg

SEQ ID NO: 181276 - DNA, 178 bp, Homo sapiens
  misc_feature: GYAE6OF02FR4D7.38.26.C04.1.454.CMB.1.raw
  modified_base (174)..(178): a, c, t, g, unknown or other
  misc_feature (174)..(178): n is a, c, g, or t
tcagtcgatcacgtcacgaccggtgctcgatttagtctagcgactttgggtttgggggaagaggaagactgacggtccccccaggagttcaggtgctgggcacagcggccctgggctgcctggtcaaggactacttccacgtgatcgactgagcgggctggcaaggcgcatagnnnnn

SEQ ID NO: 181277 - DNA, 809 bp, Homo sapiens
  misc_feature: GYAE6OF02HUXFY.38.26.C04.1.454.CMB.1.raw
  modified_base (261)..(261): a, c, t, g, unknown or other
  misc_feature (261)..(261): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctcttttgtggtggcagcagctacaggtgtccagtcccaggtgcagttggtgcagtctggggctgaggtgaagagcctgggtcctcggtgaacggtcccctgcaaggcttcgtggaggcaccttnagcacctatactttcgagcgtgggtcgcgacgacggcccctggacaagggcttggagtggagtggggacgggactcccgtacccgtattcgtttacgggacctaaaaccgcctaaccgtaccggaccaaccgtaacgtaaacgtttaccccgaaacgggaaccgaacggtaaccttaccggaaaccggtaaacgtttaaaccccgggaccgggtaaaccgaaaccgttaccccgaaacccggaacggtaacccgaaaccggtaacggttaaccttaaaccgaacgtttacggggaaggtaagttaacggtaacggttaacggcccgttaggaacggtacgttcgttacggaaccggtaccgaacccggggttccggtttaggttaaccgtttttcgtacggttcggtaccgggaagggtacggggacggggggtacccggtaaggggggtcccggttacgggggttaacggggtttaacgggtttaacggggttcgtttacgggttttaggaacggtttaacggttacgggttacggggtaacccggg

SEQ ID NO: 181278 - DNA, 585 bp, Homo sapiens
  misc_feature: GYAE6OF02HAW0A.38.26.C04.1.454.CMB.1.raw
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggcctcctcatctacggtgcatccagcagggccactggcatcccagacaggttcagtggcagtgggtctgggaaagcttcactctctccatcagcagactggacncctagaagtnttttgctagtcgttattactgtcagtcagttagtggtaacctcactacttacaccgtttccggcccgtagggaacctaaaggtacggtactagtaccgtaaacgtaactggtacggcgtacgacctaccgtattcgtcggttaccttctaccgttccctttcccgacccttacttacgttaccggtaacggtcgtacgttaccgg

SEQ ID NO: 181279 - DNA, 1095 bp, Homo sapiens
  misc_feature: GYAE6OF02GE55R.38.26.C04.1.454.CMB.1.raw
  modified_base (220)..(220): a, c, t, g, unknown or other
  misc_feature (220)..(220): n is a, c, g, or t
tcagtcgatcacgtcacgaccggtgctcgatttagtctagcgactttgggtttggggcaggagctctggagaagagctgctcagttaggacccagagggaaccactggaaaccccgaacgcgcagctctctcctcctgctactctggctccagataccacccggagaaattgtgttgacgcagtctccaggcaccctgtcttgtctccgaggggaagtancccacctcgtcctgacgacgggcccgtatcgagacgttccttaacgcgacgaccgtacgacttaaccgttacgccggttaccggttaaccgtaacggaccgtaacgaaaaccccggttcggggtacccccgaacgggtcccgttaacccccggaagggttccccggtaaccccgtttcctaaaccgttaccgggttaaacccgggttacgggtcccaaccggttaacccccgtaagggccccgggttaaaccggggggcccaaaacccgggttttaccggggaacccgtaaaccctttaccccccggaaacgggaaaccccggttaaggggtttttaaccccggtaccgggtaacggggttaccccggaaaggggggtttcccggggtttaaccgggtaaaccgggggttaaaaaccgggtaaccctttccgggtaaacctttaccccgtcccggttttaacccgaaacccgggtacttaacccggggaaaccgtaaaccgggttaccgggtttaaccggggaccgttttaacccggttaacgggtaaaacgttttcccggttttaagtacccgttaaacggttttaaccgggtttaacgtttttaacccggtaaccgggtttaaccgggtaccttaaccggggtaaacctttttaacggggaaacccggttttaaccctaaacccgggttacccttaaccgggtttttaaccccgttaaccggggtttttccccggggtttaacccccgggttaaccgggtaaaaaaccccgggtttaaacgggtttaccgggttaacggttttaacccgttaaaccggtaaaacccccggggttaaggtcccgggggtttttaacggaccgtttaaaccccgg

SEQ ID NO: 181280 - DNA, 598 bp, Homo sapiens
  misc_feature: GYAE6OF02GGCLU.38.26.C04.1.454.CMB.1.raw
  modified_base (321)..(321): a, c, t, g, unknown or other
  misc_feature (321)..(321): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtcttagcagcagctactagcctggtaccagcagaaacctggccaggcctcccgaggcctcctcactcgtacggtncatccagcgaggccacgtggccactcccgaagaccgtagggtttcaggtcggacgtaggttgggtacgtaggggaaactaccttacacgttctctccatcgagcaggactggacgccgtagaacgttagttttgactaggttacgttagttacgtgtacgtaacgtctaaggttagtacggttaactccgtactacgttcctacgtttccggccgttacggaaccgtaaggttacgtaattacgtaacgtaaaccgtaacgtcggtacgtacgtacg

SEQ ID NO: 181281 - DNA, 535 bp, Homo sapiens
  misc_feature: GYAE6OF02IO1LM.38.26.C04.1.454.CMB.1.raw
  modified_base (315)..(315): a, c, t, g, unknown or other
  misc_feature (315)..(315): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcagggccacgtggcacgtcccagacnggttcaggtggcaggtggtctagggaancttcactctcctcatcagcagacgtganctagaagtntttgctagtntatactgtcagtnagtactaggtaacctcactatctacttccgcctaggacaagtcgatatacaacgactggtacgctcgacctactactcgtcttacttactactcccttccgtactacgttctacggtacgtcgtactaccgg

SEQ ID NO: 181282 - DNA, 716 bp, Homo sapiens
  misc_feature: GYAE6OF02JC9YV.38.26.C04.1.454.CMB.1.raw
  modified_base (182)..(182): a, c, t, g, unknown or other
  misc_feature (182)..(182): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaanagccaccctctcctgcagggccagtcagagtcttagcagcagctacttagcctggtaccagcagaacctgccaggctccaggctcctcatctacggtgcatccagcagggccactggcactcccgagactaggttcaggtcggcaggtcgggtcgtagggaaacgacttcgactctctccatcagacagactaggacgtccgtaggaagttagttttcgacgtaggttacgttaactttacgtacgtacgacgtacgtaaggttaagttacggttaaaccttaccgaaccgttacgtttacccgttaaccggttttcccgggtaccccggttaacggggtaaaccgttaaaacgggtacggttaacgttaacgttaaaccgtaaaccgttaaaccggttacgggtaccggtaccgttacggaccctacccttaacgttccgtttaaccggtttcctttacccgttaaccttaccccgtttaccccgaccttacgtttacccgttacggtaaccggttacgttaccgtaacccgg

SEQ ID NO: 181283 - DNA, 705 bp, Homo sapiens
  misc_feature: GYAE6OF02I0H8P.38.26.C04.1.454.CMB.1.raw
  modified_base (218)..(218): a, c, t, g, unknown or other
  misc_feature (218)..(218): n is a, c, g, or t
  modified_base (336)..(336): a, c, t, g, unknown or other
  misc_feature (336)..(336): n is a, c, g, or t
  modified_base (672)..(672): a, c, t, g, unknown or other
  misc_feature (672)..(672): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctacctgctactctggctacccagatacccaccggagaaattgtgttgacgcagtctccaggccacctgtcttgtcctcgagggaaagncccacctctctgctagggcccagtcagactctagcagcagctactgccttggtaccagtccaggtaaacctggccaggcctaccccagggcctcccgtacacgttccgtaaccgggtntccgaacttccgaacgtccggtacggggaccctaacgtgggaccctaacgttaccccaagaccgtaacgggtttcacgggtttgaccgtacggtagggtctaagggggtaaactccgttcgaaccttccggtactaccccgtaagtccgtaacggtaccgtacggtaccgttaggggacctaccggttacgtaaacgggtttctttaaacggtccggttaaacgtagggttttacttaaacgttccggttacgaccgtaagtacggttagttaccggtaactaccgtacgtactttacgtaccgttacggtcccgtacgggtaactaagttcgtanaacgttacaacggtaccgtagtacggtctaacg

SEQ ID NO: 181284 - DNA, 626 bp, Homo sapiens
  misc_feature: GYAE6OF02F8XVW.38.26.C04.1.454.CMB.1.raw
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (399)..(399): a, c, t, g, unknown or other
  misc_feature (399)..(399): n is a, c, g, or t
  modified_base (418)..(418): a, c, t, g, unknown or other
  misc_feature (418)..(418): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcaggccagtcagagtcttagcagcagctacttagcctggtaccagcacgaaacctggccaggcctccaggcctcctcatcgtacggtgcatccagcgacgggccacgtggcactccccaagacaggttcaggtcggacaggtgggtcgtagggaaaanacttcactctctccatcancgaagacgtggacgcctagaacttntttgcagttatatttacgngtacacgtcaagttacgacgtaacctcaacctatttaccgaccgttttccgggccctacggggtaaacctaaaggttcggaattaacgtacgaaaaccgtacgtaggtcgacgttacgacctacctagttccgttgttaccgtttaccaccgtttacccgttccccgaccttacgttcgtaccggttaacggtcggtaattacccggg

SEQ ID NO: 181285 - DNA, 569 bp, Homo sapiens
  misc_feature: GYAE6OF02FTDGP.38.26.C04.1.454.CMB.1.raw
  modified_base (282)..(282): a, c, t, g, unknown or other
  misc_feature (282)..(282): n is a, c, g, or t
  modified_base (412)..(412): a, c, t, g, unknown or other
  misc_feature (412)..(412): n is a, c, g, or t
  modified_base (450)..(450): a, c, t, g, unknown or other
  misc_feature (450)..(450): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggngcgacacggcccctggacgaagggcttggagtggagtggggagggactccgtcccgattcgtttggccaaaccacactacgcacacaagtccaggacacgactcacgattaccgcgacgaactccagacncacagtctacagtggagatgagtacgcctagagatcgngacgaccgacggtccgttgttactttcgtgtcgcgagagggacggggcgtaggggccgttacgggtaggttaacggttggttcgttcgttttagacgttacgtacggtcgggtaaccgg

SEQ ID NO: 181286 - DNA, 588 bp, Homo sapiens
  misc_feature: GYAE6OF02JBOAA.38.26.C04.1.454.CMB.1.raw
  modified_base (212)..(212): a, c, t, g, unknown or other
  misc_feature (212)..(212): n is a, c, g, or t
  modified_base (315)..(315): a, c, t, g, unknown or other
  misc_feature (315)..(315): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcacctgtctttgctccaggggaangccacctctcctgcagggccagtcagagtcttagcagcagctacttagcctggtaccagcagaacctggaccaggcctcccgaggcctcctcatcgtacggtncatccagcgacgggccacgtcggcacgtccagactaggttcagtcggctaggtggtcgtaaggggaactcttacacgtctcctacctactacgacgacaggtacgtcggactccgtagtaacgttctttgacgttagtacgttaattcgttgtacgtagtacgtagttagttacggtaactacgactacttccgtacgtttccggaccgttacggtaaccgtaaaggttcggtaattaacgtaacctaaacggtatcgggttacgacgtacgg

SEQ ID NO: 181287 - DNA, 637 bp, Homo sapiens
  misc_feature: GYAE6OF02JEOGQ.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatttcagataccaccggagaaattgtgttgacgcagtctccaggcaccctgtctttgtctccaggggaagagccaccctctcctgcagggccagtcagagtcttagcagcagctacttagcctggtaccagcaagaaacctggccaggcctacccgaggtcctcctcatcctacggtgcatccagcagggccacgtggcactcccagacaggttcaggtggcaggtgggtctagggaaatcttcactctctcatcagcagactggacgcctagaacgttatttcgactagttgttacttactgtaccgaagtctaagttagtaggtaacctcctaaccgtacttacctacgtttcccggacccgttacgggaacctaaggttcgtaacgttaactaaccggaaaacgtaccgttaggtcgtacttacgacctaccgtacttcgtacgttccttactacgttaccccttcccggacccttacgttaccgttaaccggtaaccggttagtaccgtaccggttaaccgg

SEQ ID NO: 181288 - DNA, 575 bp, Homo sapiens
  misc_feature: GYAE6OF02G5BC9.38.26.C04.1.454.CMB.1.raw
  modified_base (274)..(274): a, c, t, g, unknown or other
  misc_feature (274)..(274): n is a, c, g, or t
  modified_base (315)..(315): a, c, t, g, unknown or other
  misc_feature (315)..(315): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtcttagcagcagctactgcctggtaccngcagaactggccaggcctcccgaggctcctcatctacggtncatcccagcgagggccacgtggaccatcccagactaggtttcagtggacaggtggtcagggaactcttcactctctacactcgagcgagacgtggacgccgtagaacgtatttgcgtagtgttacttacttgtcagtatagttacgtacggtaacctctaaccgtattaccgtaacgtttccgggaacccgttagggtaaacctaaaggttacgtaagttaacgtaacgtaaaccggtacgttcggtacggtactaccgg

SEQ ID NO: 181289 - DNA, 602 bp, Homo sapiens
  misc_feature: GYAE6OF02H3IKP.38.26.C04.1.454.CMB.1.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (347)..(347): a, c, t, g, unknown or other
  misc_feature (347)..(347): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccagggaangccaccctntcctgcagggccagtcagagtcttagcagcagctacttagcctggtaccagcagaacctggccaggctcccaggctccgtcatctacggcgctatccagcgaggccacgtggcactcccgagacnggtttacagtgcgaggtcgggtactaggggaaatccgttcacttcgtctaccgatcgtagcagacgtaggacgtcctaggtaagttacttttgactagtacgttaactttacgtgtacgtacgacgtagttacgttcggtaaacttcgtaacctattaccgttaccgtttccggtacccgttaccgggtaaactaacgggttacgtacgttaacgtaccggtaaaacgttaccgtaggttccggtacgttaccgg

SEQ ID NO: 181290 - DNA, 180 bp, Homo sapiens
  misc_feature: GYAE6OF02JWABH.38.26.C04.1.454.CMB.1.raw
  modified_base (174)..(180): a, c, t, g, unknown or other
  misc_feature (174)..(180): n is a, c, g, or t
tcagtcgatcacgtcacgaccggtgctcgatttagtctagcgactttgggtttgggggaagaggaagactgacggtccccccaggagttcaggtgctgggcacagcggccctgggctgcctggtcaaggactacttccacgtgatcgactgagcgggctggcaaggcgcatagnnnnnnn

SEQ ID NO: 181291 - DNA, 762 bp, Homo sapiens
  misc_feature: GYAE6OF02HZM7Q.38.26.C04.1.454.CMB.1.raw
  modified_base (216)..(216): a, c, t, g, unknown or other
  misc_feature (216)..(216): n is a, c, g, or t
  modified_base (246)..(246): a, c, t, g, unknown or other
  misc_feature (246)..(246): n is a, c, g, or t
tcagtcgatcacgtcacgaccggtgctcgatttagtctagcgactttgggtttgggcagagctctggagaagagctgctcagttaggacccagagggaaccatggaaaccccagcgcagcttctcttcctcctgctactctggcctcccagactaccaccggagaaattgtgttgacgcagtctccaggcaccctgtctttgtctcgaagggaacncgcccacctctcctgcgagggccagtcagngtcttagcagcagtctacgtacgcctggtaccagtcaacgtaaccgtggaccacggcctacccgaggtcccttaccgtctacgttccgtacggtcgaccttacgtcccaggccgacggggtcccaacggtcggacctaccgtacccgaggtaccgtacgggtttacagggtcggtacgtagggttcggggtacgtaacggggtaaacttccgtttaccgactttccgtacgtaccctacgtccggacgtccgtaacggtacggtcggacgttcccgtaaggtaacgtttacgtttacgacgttaacggttactttaacgtttaccgttacggttaccgtaagtaccgttaaggttacgttaccggttaaacctacgttacccttacgtttacccgtttacccggtttacccggggtacccggtaaccgggttaaacgtaaccggttaacggtaactttaaccgtaacccggttaaaaccggttacggtttacgggttacccggtaccgttacccgg

SEQ ID NO: 181292 - DNA, 578 bp, Homo sapiens
  misc_feature: GYAE6OF02IZTPD.38.26.C04.1.454.CMB.1.raw
  modified_base (384)..(384): a, c, t, g, unknown or other
  misc_feature (384)..(384): n is a, c, g, or t
  modified_base (434)..(434): a, c, t, g, unknown or other
  misc_feature (434)..(434): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggtcttcgtggaggcaccttcagcacctatacttcagcgtggtgcgacaggcccctggacgaagggcttggagtaggagtggggaggactccgtcccgatcgtttggacaaaccacactacgacacacaagttccaggacanactacacgacttacccggcgacgaactccaccgagacacgagtacactanaggagtagtagagtacgccgtagagatcgtagaccgtacgaccggtccgtgttatttcgtgtcgcgagaggacggggcggaggggtcgtcgggttacggttacggttaggttcgtcgttttgagtttagtacggtggtaaccgg

SEQ ID NO: 181293 - DNA, 760 bp, Homo sapiens
  misc_feature: GYAE6OF02IPKA9.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagcccaccctctcctgcagggccagtcagagtcttagcagcagctacttagcctggtaccagcaagaaacctggccaggcctccgaggcctcctcatccgtacggtgcatccagcagggccacgtggcactcccagacgtaggttcaggtgcgtaggtgggtcgtagggaacgtcttacacgtctctaccatccagtacgacgtacgtaggacgaccgttagaaacgttagtttttacgacgtacggttagttaactttacgttgtacgtacggtaccgtaaggttaagttacgggttaaaccgtaccgtaaaccccgtttaacgtttacccggtttaacccggtttttcccccgggaaccccggtttaccgggggtaaaccgttaaaacgggttcggttaaacgtttaaccgttaaaccggaaaacccggttaacgttacgggttaccggtaccgttaccgtaacccgtaccgttacgttccgttaacgtttacccgttacttaccgtttaccccgtttaccccggtaccgttactcccggtttaacggtaacccggttacgtaacccgttaccggg

SEQ ID NO: 181294 - DNA, 777 bp, Homo sapiens
  misc_feature: GYAE6OF02GAUO3.38.26.C04.1.454.CMB.1.raw
  modified_base (215)..(215): a, c, t, g, unknown or other
  misc_feature (215)..(215): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaanagcccaccctctcctgcagggccagtcagagtcttagcagcagctacttagcctggtaccagcaagaaacctggccaggcctcccaggcctcctcacgtcctacggtgcatcccagcacgggcccacgtcggcactcccgagtacgagggtttcaaggttcgggaccgtagggttcggggttaccgtaagggggaaaaccgtacctttaccgtaccctttacccgttacccgttacccgaacgtttacccggaaccggttaccgaaacgggttaacccggttcggggaaccggtacccggtttaaacggtaaaggtttaccgttttttacggaacgttacgggttttaagtttaaaccgttttacccgttagggttacccgtaagggttaccgttaagggtttaacgtttaacgggttaaaccctacccgtaaccttaacgttttcccgtaaccggttttacccgggccccggtttaacgggtaaaccgttaaagggttccggtaaattaccggttaaacccgttaaaccggtacgttcgggttaccggtacgttaacccgg

SEQ ID NO: 181295 - DNA, 616 bp, Homo sapiens
  misc_feature: GYAE6OF02ILU1P.38.26.C04.1.454.CMB.1.raw
  modified_base (217)..(217): a, c, t, g, unknown or other
  misc_feature (217)..(217): n is a, c, g, or t
  modified_base (278)..(278): a, c, t, g, unknown or other
  misc_feature (278)..(278): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagataccaccggagaaattgtgttgacgcagtctccaggcaccctgtctttgtctccgaggggaaanacgccaccctctcctgcagggccagtcagagtcttagcagcagctacttagcctggtaccngcagaacctggccaggctccaggcctcctnatcacgtgacntccagcgacgggccacgtcggcactccgagactaggttccaggttcggactaggttcgggtcgagggaaatccttacacgttctcctcctactcgagtcgacgacgtggacgtcgtagtaagttagtttagcgtagtagttattacgtgtacagtactagttactacggttaacctcgtaaccttacgttaccgttaccggttttacccggcccggttaacgggtaaccgtaacggttacggtaacttacggtaaccgtaaaaccggttaaccggttacggttccggtacgtaccgg

SEQ ID NO: 181296 - DNA, 658 bp, Homo sapiens
  misc_feature: GYAE6OF02IWHFG.38.26.C04.1.454.CMB.1.raw
  modified_base (215)..(215): a, c, t, g, unknown or other
  misc_feature (215)..(215): n is a, c, g, or t
  modified_base (323)..(323): a, c, t, g, unknown or other
  misc_feature (323)..(323): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgccagggccagtcagagtcttagcagcagctacttagcctggaccagcaagaaacctggccaggcctcccaaggtcctcctcacttctaccggtnctactccagcgagggccacgtggccactcccagacgtacgggttcaggtcggacgaggttcgggtctaaggggaaaacgtcctttacgacttcctcctaccgtacgtacgacgtactacggtacgtcggacgccgttagtaagttacttttcgacgtacggtgttaacttaccgttaggtacctaacggacgttaacgttacgttacggttaaaccttaccctaaccgttacttaccgttaaccgttttcccgggtaccccgttaccggggtaacctaaacggttacggtaacttacgtaacgtaaaccggtaacgttcggtacggtcctaccgg

SEQ ID NO: 181297 - DNA, 177 bp, Homo sapiens
  misc_feature: GYAE6OF02GBV6T.38.26.C04.1.454.CMB.1.raw
  modified_base (174)..(177): a, c, t, g, unknown or other
  misc_feature (174)..(177): n is a, c, g, or t
tcagtcgatcacgtcacgaccggtgctcgatttagtctagcgactttgggtttgggggaagaggaagactgacggtccccccaggagttcaggtgctgggcacagcggccctgggctgcctggtcaaggactacttccacgtgatcgactgagcgggctggcaaggcgcatagnnnn

SEQ ID NO: 181298 - DNA, 731 bp, Homo sapiens
  misc_feature: GYAE6OF02G31XU.38.26.C04.1.454.CMB.1.raw
  modified_base (183)..(183): a, c, t, g, unknown or other
  misc_feature (183)..(183): n is a, c, g, or t
tcagtcgatcacgtcacgaccggtgctcgatttagtctagcgactttgggtttgggggaagacaatgggtttgattttagattacatgggtgacttttctgttttatttccaatctcagataccaccggagaaattgtgttgacgcagtctccaggcaccctgtctttgtctccaggggaaanagccaccctctcctgcagggccagtcagagtctagcagcagctactagcctggtaccagcagaaacctggccaggcctccaggcctccgtcatcgtacggtgcactccagccagggccctactcggacacgtcccgagaccgtaggttcacggtggcctaggtcgggtacgtaggggaaacgtaccttacgaccttccgtccgtaccactcgacgccaagtaccgtaggacgtaccgttaaggaaacggtttagtttttacgacgtaggttagtttaactttacgttacggtacgtaacgtacgtaacgttacgttacggttaaaccttccgtaacccgttacctttaccgtttacccgtttccggtaccccggttacgggtaacccgttaaagggtacgggtaacttaaaccgtaccgaaacgttacgttacgtacggtacgttaccgacctacccgtattacccggtacgtttaccttactaaccgtttccccgttaccccgtacgttaccttaccggttacgtaccggttacgaccttaaccggg

SEQ ID NO: 181299 - DNA, 778 bp, Homo sapiens
  misc_feature: GYAE6OF02HO13T.38.26.C04.1.454.CMB.1.raw
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctcaggggaaagagccaccctctcctgcagggccagtcagagtcttagcagcagctacttagcctggtaccagcagaaacctggccaggctccaggctcctcatctacggtgcatccagcgagggccactcggcatcccagacaggttcaggtggcaggtgggtcgtagggaagacttcacgtctctacatcagctacgactcggacgtcctaggaacgtagttttcgacgtagttacggttaactttacgttacgtccgtacggtaacgtacggtttaacggttaacggggttaaccttacccgtaacccgttaactttacccgtttaaccggttttacccgggtccccggttaaacgggggtaaaccccttaaaacggggtacgggttaacgttaaccggttaaaccgtaaaacccggtttaaccgttaccgggttacgggtaaccggttaccggtaacccgtacccgggttaacctttacccggttttacggtttaccccggttttaccgttaacccgttttcccccggtttacccccgttaaccccgttaaccgttcccggtttaacggttaaacccgggttaccggttaccctttaacccgggg

SEQ ID NO: 181300 - DNA, 822 bp, Homo sapiens
  misc_feature: GYAE6OF02H0ANB.38.26.C04.1.454.CMB.1.raw
  modified_base (367)..(367): a, c, t, g, unknown or other
  misc_feature (367)..(367): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctccaggctcctcatctacggtgcatccagcgacgggccacgtcggacactaccccgaagaccgaggtttccaggtcgggcgaggttcggggtacgtaggggaaaacnccgtttacgaccttcctccgtacccgtaagttccgacgaccgaacgtacgtacgggacgtaccgttaaggtaaacgtttacgttttacggacgttaacggttaggtttaacgtttacgttacggttaccgtaaggtaccgtaaaggttacgttaaccgggttaaaccttaccgtaacccgttaacgttttacccgttaaacccggttttacccggggtacccccgggttaacggggtaaaccccgttaaaagggttccggggttaaaacgttaacccgtaaaccggtaaaaccccggtaacgtttacgggttaccggaccgttaacggtacccgttaaccgtaacgttccgttaacggtttcccgtttaaccggtaccctttaccccgttaaccccgtaccgttaccgttacccggttaaccggtaaccggtttaccgtaccggttaaccccggg

SEQ ID NO: 181301 - DNA, 553 bp, Homo sapiens
  misc_feature: GYAE6OF02HJ46N.38.26.C04.1.454.CMB.1.raw
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (343)..(343): a, c, t, g, unknown or other
  misc_feature (343)..(343): n is a, c, g, or t
tcagtcgatcacgtcacgaccggtgctcgatttagtctagcgactttgggttttgggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtncatccagcaggccactgcancccanactaggttcagtgcagtgggtctagggaaagcttcactctctccatcagcagactggagcctagaagtatttgacgtagtgttattactgtacagcagttagtagtaactaccactattacgtacgttttaccggtcccgttacgggtaaccctaaaggttcggtaacttagttaacctaaacgtaacgtacggtacgggtacgtaccgg

SEQ ID NO: 181302 - DNA, 700 bp, Homo sapiens
  misc_feature: GYAE6OF02G6337.38.26.C04.1.454.CMB.1.raw
  modified_base (248)..(248): a, c, t, g, unknown or other
  misc_feature (248)..(248): n is a, c, g, or t
  modified_base (329)..(329): a, c, t, g, unknown or other
  misc_feature (329)..(329): n is a, c, g, or t
tcagtcgatcacgtcacgaccggtgctcgatttagtctagcgactttggggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcgacgggccagtcagngtctagcagcagctactagcctggtaccagcaacgaaaccgtggaccacggcctcccgaggcctcctcactcgtacggtcncactccagcgacgggccacgtgcactcccgagaccgtaggttaccgaggtcggacgtagggttacggggtccgtaaggggtaaacgtacccgtttacgtaccgttccttcccgtacctacgtacgacggactacggtaaccgtggggacctaccgttagtaaggtttacgtttacggacttagggtttacttaagttaccgttaggtaccgtaggtaccgtaaggtttacgtttaacggtaaacctcccgttaacgttactttacccgttaccggttttcccgggacccggttaacgggaacccgttaaagggttcgtaacttaaccgtaacggtaaaacccggttacgttacgggtacggtcctaaccgg

SEQ ID NO: 181303 - DNA, 688 bp, Homo sapiens
  misc_feature: GYAE6OF02I54TH.38.26.C04.1.454.CMB.1.raw
  modified_base (225)..(225): a, c, t, g, unknown or other
  misc_feature (225)..(225): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (393)..(393): a, c, t, g, unknown or other
  misc_feature (393)..(393): n is a, c, g, or t
  modified_base (679)..(679): a, c, t, g, unknown or other
  misc_feature (679)..(679): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgcctactctggcctcccagatacccaccggagaaattgtgttagacgcagtctccaggccaccctgttctttgtcctaccgagggggaaanacgcccacccttctcccgtgacgagggcccagtccagtacgtcttagctagccagtcttacttagccctaggtaccaggccaagaaaccgtggcccaaggtccctacccgaggcctaccctnacgttcacgggtcnctaactccagccaagggccacgtcggcctacncccgagtaccgtgttaccgaggtggcgtaggtcgggtacgtaagggaacttccactctaccgtctacgctacgagccaagtaaccgtggtaccgttcctaaggtacgtttacgttttgaacttacggttagttaacgttacgttacgttacgacgttctaaaggtttcgtaaccggttactaaccttaactacggtttaccttaccggtttacccggtaaccgttaacgggtaacctaagggtacgttaacgtaacgttaaactaacgggtactacgggttaccgngttaacccg

SEQ ID NO: 181304 - DNA, 567 bp, Homo sapiens
  misc_feature: GYAE6OF02INYWP.38.26.C04.1.454.CMB.1.raw
  modified_base (390)..(390): a, c, t, g, unknown or other
  misc_feature (390)..(390): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccagggggaaagagccaccctctcctgcagggccagtcagagtcttagcagcagctacttagcctggtaccagcagaaacctggccaggctcccaggcctcctcatctacggtgcatcccagccagggccactggacactcccagacaggttcagtcggctaggtgggtcgtagggaaagtcttcactctctccatcagcagactggacgctagaagtntttgctagtgtattacgtgtcagatagtagtaggtaacctcctaacctatttcctaccgtttcggcccgtagggacctaaggtagatacgtacgaaacgtactggtcgcgtagccgactactccgtgttccttactcttcccttccgacctactcgtaacgtacggtctacgtacgg

SEQ ID NO: 181305 - DNA, 652 bp, Homo sapiens
  misc_feature: GYAE6OF02HC2A2.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagactaccaccggagaaattgtgttgacgcagtctccaggcacctgtcttgtctccgagggaagacgccacctctcctcgcgacggccagtcaggacgtcttagcagcagtcctagtacgcctaggtaccagaccaagtaacccgtggaccacggacctcccgacggtcctccctacacgtacgtacggtcaccgtactcccgagaccggacggaccctacgtacggcctaactacccgaagtaaccgtagggtttccaggtcggtcgacgggttcggtacgggtaacggaaacgttcctcgtacttccgtactccacgtcaacgcgtaagccggtaggacgtccgtaataaggtttacttcgagtacgttcttagtcgacgtcgacgtcgtaacgtacgttacgaaacctgtaaccttcgttaccgtcggttccggtacccgttaaggaaccgtaaggttctaacggtcctaaaccgaacggtacctggtaccgtcgtacg

SEQ ID NO: 181306 - DNA, 757 bp, Homo sapiens
  misc_feature: GYAE6OF02G6IIB.38.26.C04.1.454.CMB.1.raw
  modified_base (222)..(222): a, c, t, g, unknown or other
  misc_feature (222)..(222): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccgaggggaaagagccaccctctcctgcagggccagtcagagtcttagacngcagctacttagcctggtaccagcaagaaacctggccaggcctaccccgaggcctcctacatcgtacggtgcactccagcgacgggccacgtcggccactcccgagacgtacggttcgaggtcggacgtaggtcggggtacgtaggggaaacgtaccgttacctaccgttccgtccgtaccgtacttccgaacgaccgtaacggtacgttacggggaccgtacccgttagggtaaagtttacgtttttacggaccgttaggtttacggtttaacgtttaaccgttcggtacgtaggtaccgttaaggttacggttaacggttaacctacctaacctttacctttacccgttaccggtttacccggtcccggttaacggggtaacccgttaaacgggttacggtaacttaccgtaaccggaaaccgtaccgttacgggtacggtccgtacgaccgtacgtccttcgttcgttccttacgttaccttaccccgttccgtacctacgttaccgtacggttaaccgttggtactaccgg

SEQ ID NO: 181307 - DNA, 563 bp, Homo sapiens
  misc_feature: GYAE6OF02FVGRP.38.26.C04.1.454.CMB.1.raw
  modified_base (284)..(284): a, c, t, g, unknown or other
  misc_feature (284)..(284): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtccccctgcaaggcttctggaggcaccttcagcacctatactttcagctgggtncgacaggcccctggacaagggcttgagtggatgggagggatcctcccgatctttggcaaaccacactacgcacacaagttccaggacagactnacgattaccgngaccgatccacgagcacagtctacatggagatagagtagcctgagtactcgtagaccgacgaccggtccgtgttactttcgtgttgacggtagaggacggggggccaaggggggctcggggtaggtaacggtttaggtaggtcgttttaggagttagttccggttagggacccgg

SEQ ID NO: 181308 - DNA, 653 bp, Homo sapiens
  misc_feature: GYAE6OF02HA3WD.38.26.C04.1.454.CMB.1.raw
  modified_base (214)..(214): a, c, t, g, unknown or other
  misc_feature (214)..(214): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaanagccaccctctcctgcagggccagtcagagtcttagcagcagctacttagcctggtaccagcagaacctggccaggcctcccgaggcctcctcactccgtacggtgacctatcccaggcctaggggcccagtcggacactcccgagtaccaggtttcgaggtgggcctagggttcggggtacgtaggggaaactcctttaccgacttccgtccttcctaactccagtcacggtacgtggacgtccgtaggtaaagttcgttttggacgttagttacggtttaattacgttacgttacgagtcgtaagttagttacggttaaacctaccgtaaccttatttaccgttaccggttttccggtaacccgttacgggtaaccgtaaacggttacggtaattaacgttaaccgaaaccgttacgtacggttacggtacgtaccg

SEQ ID NO: 181309 - DNA, 664 bp, Homo sapiens
  misc_feature: GYAE6OF02IVOQD.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagcctgggtcctcggtgaaggtcccctgcaaggcttcgtggaggcaccttcagcacctatactttcagctgggtcgcgacgacggcccctggacaacgggcttggaggtggagtgggagggactccgtcccgatcgtttggacaaaccacaactaccgacacacaacgttccgaaggacacgacctcgaacgtacgtacccggcggaaccgaactacccgaacgaacgaccaacgacgtaccgtaacgtagtacggaagagttacggaaggtacgcccgttagaacggtacgtcgtacggaaccgacgtaccgggtccgttagttactttcggtacgtcggacggtagggacgggacgggggaccggtaggggggtccgttacgggggtagggtttaaaccgggtttgggttacgttcggttttagagtttacggtcgggttacggggtaaccgg

SEQ ID NO: 181310 - DNA, 662 bp, Homo sapiens
  misc_feature: GYAE6OF02JWRB1.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagataccaccggagaaattgtgttgacgcagtctccaggccacctgttctttgtctccgaggggaagacgccacctctcctgcagggccagtcagagtctagcagcagtactactagccgtggtaccagacacgaacctcggcacggtcctccgacggtcctccgtactactcgtacggtcgctactcacgccgacgggcctacgtcggcctactacccgaagtaccgtaggttcgacggtcggtacgtacgggttcggtacgggtagggaaacgtccgttactacgttctacccgtactcgtccgtaagacggacgtacgtcgggacgtacctaacggttaagtttacgttacgacttaggttacgtatttaccggtcgtacgagtacgtacggttacgtaacggttaacgtcccgttaactacgttcccgttaccggttccgggtaccgtaacgggtaactaacgggttacgtatacgtaccgtaaacggtacgtcggtagtacctaccg

SEQ ID NO: 181311 - DNA, 696 bp, Homo sapiens
  misc_feature: GYAE6OF02FULSN.38.26.C04.1.454.CMB.1.raw
  modified_base (218)..(218): a, c, t, g, unknown or other
  misc_feature (218)..(218): n is a, c, g, or t
  modified_base (337)..(337): a, c, t, g, unknown or other
  misc_feature (337)..(337): n is a, c, g, or t
tcagtcgatcacgtcacgaccggtgctcgatttagtctagcgactttgggtttgggggcagagctctggagaagagctgctcagttaggacccagagggaaccatggaaaccccagcgcagcttctcttcctcctgctactctggcctcccagataccaccggagaaattgtgttgacgcagtctccaggccaccctgtctttgtctacgaggggaanagccaccctctcctgcgaggccagtcagagttctagcagctacgcttactagccgtggtaccagcaacgaacctggaccaggcctcccgaggtcctcctcacgttcgtacggtcgctanccgaacgccgacggccctacgtcggacaccgtacccgagtaccggtaggttccaggtcggacgtacggttcggggtactaacgggggaaactccgttacaccgttacgtcccgtaccgtacgtaccgacgtacgaacggtaccgtcggtaacgtccgttaaggtaacgtttagtttacgacgttacgtttacgttaacgtttcgtacgttacgtagtacgtaagtttaacggttacgtaacctaccttaaccgtactttacccgttaccggttacccgggttacccggtaacggtaacccgttaaggtacgttaacgttaacctaacgtaaacggttacggtcggttacggactaccgg

SEQ ID NO: 181312 - DNA, 671 bp, Homo sapiens
  misc_feature: GYAE6OF02IWRAA.38.26.C04.1.454.CMB.1.raw
  modified_base (140)..(140): a, c, t, g, unknown or other
  misc_feature (140)..(140): n is a, c, g, or t
  modified_base (197)..(197): a, c, t, g, unknown or other
  misc_feature (197)..(197): n is a, c, g, or t
  modified_base (482)..(482): a, c, t, g, unknown or other
  misc_feature (482)..(482): n is a, c, g, or t
  modified_base (606)..(606): a, c, t, g, unknown or other
  misc_feature (606)..(606): n is a, c, g, or t
  modified_base (614)..(614): a, c, t, g, unknown or other
  misc_feature (614)..(614): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgtnacgcagtctccaggcaccctgtcttgtctccagggaaagagtccaccctctcctgcngggccagtcagagtcttagcagcagctacttagcctggtacccagccagaaaacctggcccaggcctccgaggcctcctcatcgtacggtgccatcccgagcagggcccacgtcggcactccccgagtaccgaggttaccaaggtcggactaggtcgggtacgtagggtaaactacttccgaacgttcctacgtccctaatccgaacgccaaggtaccgtacgggacgacccgttaggaaacgttgttttcgaccgtagttacgttattaacgtcgtataacgtntaaagtacgttacgtaaacctccttaacgtaatttaccgtacccgtttacccgaccgttacggtaaccgtaaaggttacgacttaacgtaccgaaacgtactggtacggtcacgtactaccgtnttaccgtnttaccttacgtactaccgttcccgtacctagttccgtagaccgttagtcgtaaccgg

SEQ ID NO: 181313 - DNA, 598 bp, Homo sapiens
  misc_feature: GYAE6OF02GN8EZ.38.26.C04.1.454.CMB.1.raw
  modified_base (218)..(218): a, c, t, g, unknown or other
  misc_feature (218)..(218): n is a, c, g, or t
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagatacccaccggagaaattgtgttgacgcagtctccaggcaccctgtctttgtctccgaggggaaancgccaccctctcctgccagggccagtcagacgtcttagcagcagctactagcctggtaccngacagaacctggccaggcctcccgaggcctccacgtatccgtacgtncctactccgagccgacggcctacgtcggcactccagcctaggtcaggtgacagggtggtacgtaggtaactctacgactcgtcctacagtcagcgagtcgtaggacgctaggaagtttattcgagtagttacgttaacgttacgtgtactaagtcgtaacgttactaacgtaccttacacttacgtttccgtacgtttcccggtaaccgttacggtaactaaggtacgttaacgtaacgtacgtaaccgtaaggtcggtacggtacctacgg

SEQ ID NO: 181314 - DNA, 638 bp, Homo sapiens
  misc_feature: GYAE6OF02FP5EP.38.26.C04.1.454.CMB.1.raw
  modified_base (215)..(215): a, c, t, g, unknown or other
  misc_feature (215)..(215): n is a, c, g, or t
  modified_base (291)..(291): a, c, t, g, unknown or other
  misc_feature (291)..(291): n is a, c, g, or t
  modified_base (454)..(454): a, c, t, g, unknown or other
  misc_feature (454)..(454): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtagttggacgcagtctccaggcaccctgtctttgctccaggggaanagccacctctcctgcagggcccagtcagagtcttacgcagcagctactagcctggtaccagcagaacctggtaccnggcctcccaggcctccgtccatccgtaccggttgccaactcccgtagaccgtacggggccctacgtacggggcctatccccagaccagggttacagtcggactaggtcggggtactgggggaaacgacgttcctacgtctacctacctagtctagccagtacnggacgtccgtgaagttacgtttgactaggtcgttagttatcgttagacgtccgtaagttagtaccgttaactaccttacccgtactttacacccgtttccgggtccccttaacggggtaaccccgtaaggtcggtaacgttaacgtaccgtaaaaccggttaccgtaggttacggtattaccgg

SEQ ID NO: 181315 - DNA, 729 bp, Homo sapiens
  misc_feature: GYAE6OF02IXC4B.38.26.C04.1.454.CMB.1.raw
  modified_base (163)..(163): a, c, t, g, unknown or other
  misc_feature (163)..(163): n is a, c, g, or t
  modified_base (217)..(217): a, c, t, g, unknown or other
  misc_feature (217)..(217): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccgganaaattgtgttgacgcagtcctccaggccacctgtctttgtctccgaggggaaancgcccaccctctcctgccgagggccagtcagtacgttcgttagccagccagtaccttacgttaccgccgttaggtaaccccgagaccctaacggtaaaacccgtcgggacccgaacggtccctaccccggaggtcccttccctacgaccttccggtacggtcgacctacgtccgaggaccgacggggtaccctacgttacggcctactacccgaacggtaccgttacgggtttccgagggttcggacgtacgggttcgggtagtacggggaaccttccgttaccgacgtttccgaccgttaccagtccacgccgtaagtccggtcggaacgtccgtaaacgttaagttcgtttacgacttaggtttaccgtttacttaaccgtgtaccgtaggtacttaaggtttacgtaacggtacctcctaacgtactttccgtaccggtttacccggacggttacggaaacctaaggtacgtataaccgtaaccgtaagtcgtacggttcgacttaccg

SEQ ID NO: 181316 - DNA, 739 bp, Homo sapiens
  misc_feature: GYAE6OF02GE9UB.38.26.C04.1.454.CMB.1.raw
tcagtcgatcacgtcacgaccggtgctcgatttagtctagcgactttgggtttgggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagacgccacccctctcctgcagggccagtcagagtcttagcagcagctacttagcctggtaccaggcagaaacctggccacggcctcccgaggcctcctcactcgacggtgcactccacgccgacgggccacgtcggaccactacccgagtaacgtacggttcgaggtcgggacgtagggttcgggtacggtaacgggaaacgtccgttacgtaccgttaccctaccgtaccctaagtaccgacggtacgtaacggtaccggtagggaccgtaccgttaacggaaagttttcgtttacggacgttaaggtttagttaacgttacgttacggtactagtacgttaacggtttaggttaacggaaacccttaccgttaaaccttacgtttacccgttaacccggttttaccccgggacccggtttaaccggggtaaacccgttaaacgggttcggtttaaacgttaacccgttaaacggtaaaaaccggttaccggtttaacgggtttaccggtaccttaacccgg

SEQ ID NO: 181317 - DNA, 760 bp, Homo sapiens
  misc_feature: GYAE6OF02H37B3.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggccacctgtctttgtctcgaggggaacgcgccacctctcctgccgacgggccagtcagtacgtcttagcagctagctacttacgccgtaggtaccagcaacgaaccgtggaccgaggcctccccgaaggtcccttaccgtactaacgttcccgttaacggtcgaccgtacctacccgaacggtacccgaacggggaccccacggttcggaaccctaccgtacccgaaggtaccgtacggtttacgacggtacgggtccggtaagggttcggggttaccggtaaggggtaaaccgttaccctttaccgtaccgttccgttacccgtccgtaacgtccggaacgtaccgaaggtaccgtgggtaaccgtaccgttaggtaaacgtttcgttacggtacgtaagttacgtttaacgttaccgtacgtcgtaacgtacgtacggtttaacgtaacggtaacctaccgttaaccgttacgtttaccgtccgttttacccggcccggttaaccggtaaccgtaacggttacgtaacgtaccgttaacgaaacggttacggtcgttaccggactaaccgg

SEQ ID NO: 181318 - DNA, 669 bp, Homo sapiens
  misc_feature: GYAE6OF02GMB98.38.26.C04.1.454.CMB.1.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (322)..(322): a, c, t, g, unknown or other
  misc_feature (322)..(322): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgttctttgtctccgaggggaaangccaccctctcctgcagggccagtcagagtcttagcagcagctacttagctggtaccngcagaaacctggaccaggcctcccgaggcctcctcatccgtacggtncntccaggcaggcccatcggcacgtcccaggaccaggttcaggtcggntaggtgggtacgtagggaaacgtcgttacacgtctcctaccactcagcgtacgacgtaggacgtccgttaagaacgttcttttacggacttaggttagttaacgtttacgttacgttacgtaacgttctaacgggtttacgttaacgttaaccgtaacctacccgttaacgtttaccgttacccggtttttaccccgggaacccggttaccgggtaaacccgttaaagggttacggtaaacgtttaacgtaaccggtaaaaaccgttaccggttacgggttaccggtacgttaacccgg

SEQ ID NO: 181319 - DNA, 861 bp, Homo sapiens
  misc_feature: GYAE6OF02H4CM7.38.26.C04.1.454.CMB.1.raw
tcagtcgatcacgtcacgaccggtgctcgatttagtctagcgacttttggggtttgggggaagacaatgggtttgatttagattacatgggtgacttttctgttttattccaatctcagataccaccggagaaattgtgttgacgcagtctccaggcaccctgtctttgtctccaggggaagagccaccctctcctgcgagggccagtcagagtcttagcagcagctactagcctgtaccagcagaaaccgtcggccaggcctcccgaggccttccgtaccacgtccgtacggtcgacactaccgagtccgacggggccccactcggacctaccgttaccccgaacggtaaccgtaggggtttaccgaacgggttcggggaccgttacggggttacggggttaccggttaagggggtaaaaccgttacccgtttaccgtaaccccgtttccgtttaccccgtaaccctaccgtacccgaaacggttacccggaacgggtaacccggttaacggggtacgttaaccccggttaggttaaacggtttacgttttttacgggacgtttacgggtttacggtttaacttttaacggttaggtaccggtaacggttactaagggttacgttaccggttaaccctacgtaaccctttacgttaccgttaccgtttccggggtacccgtaacggggtaaccgtaaacgggtacgttaaagtacccgttaaacggtaaaccgtacgttaacgggttaccgacgtacggtaacctaccgttaacgttccgttaaccggttttccctacgtttacccttaccccttccgtaacgtacttacggtaaccggtacgtacggtacgtacccggg

SEQ ID NO: 181320 - DNA, 809 bp, Homo sapiens
  misc_feature: GYAE6OF02GN8MH.38.26.C04.1.454.CMB.1.raw
tcagtcgatcacgtcacgaccggtgctcgatttagtctagcgacttttgggtttggggcagagctctggagaagagctgctcagttaggacccagagggaaccatggaaacccagcgcagcttctcttcctcctgctactctggctccagactaccaccggagaaattgtagttgacgcagtctcaggcacctgtctttgtctcgagggaacgacgccacctctccgtcgcgaggccagtcgagtacgttcttagcagcagtacttacttacgccgttacggtaccagtacgaagaaccgtcggaccacgggcctacccgacggtcctaccgtcctacgttaccgtaccggtacgacctacgtaccgacggaccggtaccggacccgtaacggtcggaccctaaccgtaccccgaagggtaccgttaacgggtttaccgacgggttacgggtacggtacgggttcggggttaccggtaaggggtaaaccgttacccggtttaccgttacccgtttaccggttacccttaccgtaacgtttacccgaacggtaccgtaacgggtaccggtaacggtacgtacccgggttaggtaactttacggtttacgtacgttaagtttacgtttacgttaacggttacgttacgtaaggttacgttaagttacgtttaaaccggttaccttaaccgtacgttacctttacgttacccggttttaccggtaaccggttaaacgggtaccggtaaaggttacggtaacgttaaccggtaaaccggttaacgtaaccggttcggtacggtaccgttaccg

SEQ ID NO: 181321 - DNA, 652 bp, Homo sapiens
  misc_feature: GYAE6OF02FWXM1.38.26.C04.1.454.CMB.1.raw
  modified_base (245)..(245): a, c, t, g, unknown or other
  misc_feature (245)..(245): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagngtcttagcagcagctacttagcctggtaccagcagaacctggccaggcctcccaggcctccncatcgtacggtncatccagcagggccagtcgacancccagacacggttcaggtggcctaggtcggggtactagggtaaactcgttcacgtccgtactccatacgagcacgacgtggacgtccgtagtaacgtattttcgacgtaggttacgttaagtttaccgttagtacgtacgtacgtaaggtttacgttaacggttaaaccctaccgtaaccgttactttaccgttacccggtttaccggtaccccgggttaacgggtaacccggtaaacgggttacgtaaacgtttaaccgtaaaccgtaaaaccgggttaccgttacggttaccgggtaccgttaaccgg

SEQ ID NO: 181322 - DNA, 862 bp, Homo sapiens
  misc_feature: GYAE6OF02HJQ6N.38.26.C04.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
tcagtcgatcacgtcacgaccggtgctcgatttagtctagcgactttgggtttgggggaagacgaatgggtttgatttagattacatgggtgacttttctgttttatttccaatctcagatacccaccggagaaattgtgttgacgcagtctccaggcaccctgtctttgtctccgagggaaagacgcccaccctctcctgcgacgggccaggtcaggagtcttagnagcagctacttagcccttggtaacccagaccgaaagtaaacccgtgggaccacgggtcctcccgaggtcctcctactacttaccgtacgggacncacgtaccgaacgccgaacggggccccacggtaccggacctaccgttacccgaggtaccgttaggtactagggtccggagttacgggtcggggttacgtaaggggaaaacgttccgttactaaccgttccttacccgttaccaagttccgaaacgggtaccgtaaacggtcggtaccggtaccggttaccgtaagggtaaacgtttgttttaccggagttacggtttaacgttaccggtttaacgttaggacgtaggtaccgtaaagggtttaaccgtaacggttaaaccctaccgtaaacctttaagtttaacccggttccgttttacccgggacccgttacgggtaaacccgttaaggtaaccgttaacgtaaacgttaaccggaaaccgttacggtacgggtaactaccgggttaccgtaaccgaccgtttacgtttaccgtacgttccggtttaaacctccgtttaccccggttaacccgttacgtttaaccgttcccggaaccggtttaaccggaccggttaaccgttaacccggg

SEQ ID NO: 181323 - DNA, 688 bp, Homo sapiens
  misc_feature: GYAE6OF02JA9KD.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggccaccctgtctttgtctccgaggggaaagagcccaccctctcctgcacgggccagtccagagtcttagcagcagctacttagcctggtaccagaccaagaaacccgtcggccacggcctaccccgaggccttcctacgtacgtctacggtgcactccagcgacggccacgtcggcacgtcccgaagacgtacggttcgaggtcggacgtaggtcgggtacggtaagggtaacgtacgttcacgttcttacctacgtactacgacgacgacgtacgtacgggacgtaccgttaggaacgtttagtttacggacgttaggttacgtttaacgtttacggtcggttaccgtaggtaaccgttaggttaagttaccggttaaaccctacctaaccgttacgtttacccttaccggtttacccgggtcccggttaacgggtaacctaacggttacgtaacttaacgttaaccggtaaaccgtacgtcggttacggtccgtaacgg

SEQ ID NO: 181324 - DNA, 584 bp, Homo sapiens
  misc_feature: GYAE6OF02F9G9P.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgaggtgaagaagccgtgggtcctcggtgaacggtcccctgcaaggcttctggaggcaccttcagcacctatactttcagctgggtgcgacacggcccctggacagggcttggagtggagtgggaggactccgtccgattcgttcggacaaaccacactacgcacacaacgttccaggacagactacacgacgttaccgacggacgtaactccgaacgagaccacacgtacctaacgagtcggagataggagtacgcctgacgatcgtgaacgacgacggtccgtagttactttcgtgtgacgaggacggcggggaccgcggggtacgttggggtacggttaacggttgggtgttcgtttagacgttcgttacggtgggtaaccgg

SEQ ID NO: 181325 - DNA, 603 bp, Homo sapiens
  misc_feature: GYAE6OF02IRY0E.38.26.C04.1.454.CMB.1.raw
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
  modified_base (522)..(522): a, c, t, g, unknown or other
  misc_feature (522)..(522): n is a, c, g, or t
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtctggggctgagtgagagcctgggtcctcggtgaaggtcccctgcaaggccttatcggaggcaccgttcagcacctatactttcagctgggtncgacgaggccctggacaggctgagngagcgggaggactccgcgtacttcggtcgtaaccacaacctacgctaacgactaacgtaccgtacgacgacgacgtcacgacgtaccgtacggacgtagacctaccgacgcactacgactacatgaacgataggagttacgaccttcgagacttacgtacgacgaccgacggtacccgttacgtagtttaccgttgtaccggtgacgtaacggngggggacggtacggggtacggttacggtgggttaacggttacggtgttcgttacgtagtagtcgtacgggacgtaacgggg

SEQ ID NO: 181326 - DNA, 529 bp, Homo sapiens
  misc_feature: GYAE6OF02I2EZ5.38.26.C04.1.454.CMB.1.raw
  modified_base (183)..(183): a, c, t, g, unknown or other
  misc_feature (183)..(183): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
  modified_base (456)..(456): a, c, t, g, unknown or other
  misc_feature (456)..(456): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccaggggaaagngccaccctctcctgcagggccagtcagagtcttagcagcagctactagcctggtaccagcagaacctggccaggctccaggctcctcatctacggtgcatccagcgaggccacgtggcatcccagacaggttcaggtcgctagtgggactggaagctgactcactcatcagcagctggtacncgtanaacgtnttagcttacgtactacttactgtacgacgtanagtacttgaactctacctagttacncgtcgaccgacgacgaagtgtanactacgaacgacgtgcgctcactctntcgtnttcctctaccgtccttccgactctccgtagacgtctacgtcg

SEQ ID NO: 181327 - DNA, 762 bp, Homo sapiens
  misc_feature: GYAE6OF02HGGPV.38.26.C04.1.454.CMB.1.raw
  modified_base (136)..(136): a, c, t, g, unknown or other
  misc_feature (136)..(136): n is a, c, g, or t
tcagtcgatcacgtcacgaccggtgctcgatttagtctagcgactttgggtttggggatcacataacaaccacattcctcctctaaagaagcccctgggagcacagctcatcaccatgactggactggagttcctntttgtggtggcagcagctacaggtgtccagtcccaggtgcgagttggtgcagtcgtggggctggaggtgaagaaggccgtgggtcctcggtgaacggtcccctgcgaaggcttcgtggaggccaccttcagcacctatactttcagtcgtgggtgcgacacggccccgtaggacgaagggcttaggacggtgggagtgggggacgggtacgtcccgtacccggtacttcgtttacggaccgaaaaccaccgtacctaaccggcaacctaaccgtaaacgtttacccgaacggaaccgtaacgtacccgttacaaccgtaacgttacccgggaccggaaccgtaacgtccccgaacggtacgacccgtaacgaaccgttactaaccgtacgtacgggaagtaaggacggtaacggtaccggtccgttaggaacggtacgttacgtcggtaaaccggaccgtacccggggtccgtttacgttttaactttccggtcggtacggttaccgggaagggaccggggtaggggggaccccggtacggggtaccggtccgggttaagggttacccggtttagggttcgttacggttttaggagtttacggttacccgggtgggttaacccggg

SEQ ID NO: 181328 - DNA, 721 bp, Homo sapiens
  misc_feature: GYAE6OF02JJNFZ.38.26.C04.1.454.CMB.1.raw
  modified_base (379)..(379): a, c, t, g, unknown or other
  misc_feature (379)..(379): n is a, c, g, or t
  modified_base (498)..(498): a, c, t, g, unknown or other
  misc_feature (498)..(498): n is a, c, g, or t
  modified_base (538)..(538): a, c, t, g, unknown or other
  misc_feature (538)..(538): n is a, c, g, or t
tcagtcgatcacgtcacgaccggtgctcgatttagtctagcgactttgggtttggggcgagagctctggagaagagctgctcagttaggacccagagggaaccagtcggaaaccccagcgcagcttctcttccgtcctgctactctggacctcccgagactaccgacggagaaattgtgttgacgcagtcctccgaggctacccgtggttcctttagtctccgaaggggaaagcgccctaccctctccgtgccgagggtccagtcagcgttctagcagccagtctacgtagccctaggtaccagccgaacgaaaccgttgggacccgacgggtccctaccccggaggtcccttaccgtacgttagtacccgttccgganccctaacgtaccccgaaggccgttaacggccctagtccggactaccgtaccggacgtacgtggtttacgcgtcggctagggttcggtacggaggaactttccagctacgtcctcgtacncgagctacgtcggagaccgacgtaagtacgttctttacgngttacgtcgttaacgttcgtacgttacgacgaccggttaagttacgtaccgggttaactaccggttaaccttaccgttaccggttaacccgtttccgggaacccggttaggaaacccggttacggtacgttacgtaacccgttaccgaaacggtttccggtaacgggttcgtaccctaaccgg

SEQ ID NO: 181329 - DNA, 765 bp, Homo sapiens
  misc_feature: GYAE6OF02JQUNI.38.26.C04.1.454.CMB.1.raw
  modified_base (130)..(130): a, c, t, g, unknown or other
  misc_feature (130)..(130): n is a, c, g, or t
  modified_base (177)..(177): a, c, t, g, unknown or other
  misc_feature (177)..(177): n is a, c, g, or t
  modified_base (193)..(193): a, c, t, g, unknown or other
  misc_feature (193)..(193): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccgganaaattgtgttgacgcagtctccaggcacctgtcttgctcgagggaancgccacctctcctgcnggccagtcagtgtctagcagcagctacgtacgccgtggtaaccagcgaaagaaccgtcggccacgggtcctcccgaggtcctcctacacgtcgtacggtgcacgtccagcgacgggcctacgtcggactacctccgaggtaccgtggttaccagggtcgacggagggttcggtaacggttaggggaacgttaacccgttcgtacccttcgttacccgtcccaagttaccgacggacgttaacggacgtacggggtacctacgtaggtaacggttacgttttacacgtagttacgtttacgttacgtacgtaacgtcgtactaaggttaccgttaacgtaccgtaccgtaccgtaacgttttccgacccgtttacggtacccgggtaacgtaaaccgggttacgtaacgttacgtaactaaaccggtaaaccgtacgtacggttacgacgtaccgtacccggtaccgtaacgtttccggtttaccgttacccgtttacggttacccgttaccccggttaaccctaggtttacccgaacgttaccggtttacccggtacgttacccggtaacgg

SEQ ID NO: 181330 - DNA, 799 bp, Homo sapiens
  misc_feature: GYAE6OF02INJ75.38.26.C04.1.454.CMB.1.raw
  modified_base (290)..(290): a, c, t, g, unknown or other
  misc_feature (290)..(290): n is a, c, g, or t
tcagtcgatcacgtcacgaccggtgctcgatttagtctagcgactttgggtttggggggaagacaatgggtttgatttagattacatgggtgacttttctgttttatttccaatctcagataccaccggagaaattgtgttgacgcagtctccaggcaccctgtcttgtctccaggggaaagagccaccctctcctgcagggccagtcagagtcttagcagcagctacttagccttggtaccagactagaaacctggaccaggctcccaggtctcctctatctaccggtnctactccgagtccgaacgggcccacgtacggcctaacctcccgaacggactaacgggtactagggtaggactaacgggttggggtacctagggggtaaaacgtcctttaaccgtaccgttccttacccgtaacctaacttccgtaaacgccgaaacggtaaccgtcggggtaaaccggtcccttaaacgggaaacgtttacggttttttaccggaaccgtttaacggtttacgtttaaccgtttaaccggtttacgtaaccgaacgtacccggttaaaggttacgggttaaaccggttaaaccttacccgttaacttaaacctttaccgttaaccgttttacccgggtacccgttaacgggaaacccgttaaaacggtacggtaaacttacgtaaaaccggtaacggtaaacccgtgggtaacgtaacgtacgtacctaccgacgttactgttacctacgtaacttcccgtaccctacgttacgtaccgtacgtaacggtctagtccgg

SEQ ID NO: 181331 - DNA, 639 bp, Homo sapiens
  misc_feature: GYAE6OF02HDDSU.38.26.C04.1.454.CMB.1.raw
tcagtcgatcacgtcacgaccggtgctcgatttagtctagcgactttgggtttggggatcacataacaaccacattcctcctctaaagaagcccctgggagcacagctcatcaccatggactggacctggaggttcctctttgtggtggcagcagctacaggtgtccagtcccaggtgcagttggtgcagtcgtggggctgaggtgaagaacgccgtgggtcctcgggtgaacggtcccctgcgaaggtcttcgtggaggcaccttcagccacctatactttcacgtctgggtgcgacacggccctgacgaggtcttgagtggagtgggagggactccgtaccgtattcgtttacggaccaaaccacacctacgacaacgtaacaacgttccgaggacacgactacacgacgttaccggacgacgtaacgtaccgacgaacgacactaacgtctacgagtaggaacgtgtagacgtacgaccgtagacgtgtaccgtggaaccgacgtaccggtccgttagttacgtttcgtgtcggagtaggacgggcggggaccggcggggtaccggtacgggttacggtttaacggttgggttacgttacggtttaggtacgttaggttccggtacgggtaaccgg

SEQ ID NO: 181332 - DNA, 649 bp, Homo sapiens
  misc_feature: GYAE6OF02HLTBJ.38.26.C04.1.454.CMB.1.raw
  modified_base (337)..(337): a, c, t, g, unknown or other
  misc_feature (337)..(337): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgaggggaagacgccaccctctcctgcagggccagtcagagtcttagcagcagctacttgcctggtaccagcaacgaaaccgtggcccacgggtcctaccccgaggccttccctctacgttcgtaccgggtncctactccgagccgacgggccacgtggccactcccgaagacgtacggttcaggtcggactaggtcgggtctagggaaatccttacactcgtcctcactcagcacgacgtggacgcgtagtagttagtttcgacgtagttacgttacgttacgtcgtacgacgtactaagttacgttaacggttaaccttaccgtaaccttacgtttaccgttaccggttttcccgggtacccggttaaccgggtaaaccgtaaacgggttcgtaacgttaaccgtaaccgtaaaccgttaacggttcggtacggtcgtaccg

SEQ ID NO: 181333 - DNA, 716 bp, Homo sapiens
  misc_feature: GYAE6OF02GWLKD.38.26.C04.1.454.CMB.1.raw
  modified_base (267)..(267): a, c, t, g, unknown or other
  misc_feature (267)..(267): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctccagataccaccggagaaattgtgttgacgcagtctccaggcaccctgtctttgcctcgaggggaaagcgcccaccctctccgtcgcacgggccagtccaggtagttacttagctagccnggtaccttacttagccttggtaccagtccaacggtaaaccctgggccctaagggcctacccccggagggtccttaccgtaccattacccggtaccgggtcgacctacgttacccgaggtccgaacgggggaccctaacggtcggtccgaacctaccccggtaagtaccgtccggggtttcgaaggttcggacgtagggttcgggtaccggaagggtaaaccgtccgttcgacttacccgtcctacgtaactccgacgtacacgtacgtaggacgtactaggtacttacgtttacggactagttagtaccttcgtagtactggtaacgttagttaagttacggtaccttaccgaacctatttcctaaccggtttccgtaccggtaagggtaacctaagggttacgtacgttaacgtaccggaacggttacctagggtacgtacggtaccg

SEQ ID NO: 181334 - DNA, 706 bp, Homo sapiens
  misc_feature: GYAE6OF02I5W8O.38.26.C04.1.454.CMB.1.raw
  modified_base (184)..(184): a, c, t, g, unknown or other
  misc_feature (184)..(184): n is a, c, g, or t
tcagtcgatcacgtcacgaccggtgctcgatttagtctagcgactttgggtttgggggaagacaatgggtttgatttagattacatgggtgacttttctgttttatttccaatctcagataccaccggagaaattgtgttgacgcagtctccaggcaccctgtctttgtctccgaggggaaagngccaccctctcctgcagggccagtcagagtcttagcagcagctacttagcctggtaccagcaagaaccctggccaggcctcccaggctcctcatctacggtgcatccagcgacgggccagtggacatccccagacaggttcaggtcggacaggtgggtactagggaaactctcacgtctaccgtcagtcagcaacgtcgtaggacgtaccgtaggtaacgttagttttacggcgttagggtacgttaactttaccgtcggtacaaggtaccgtaaggtttacgttaacgggttaacctaccggttaaccttaacgtttacccgttaaccggtttacccgggaccccgttacgggaaacccgtaaaggttacggaaacgtaccgttaaaccgtaaaccgggtaacgttcgggtaccggtaccgttacggaccctaccgtagttccgtcggtttaccttcgtaaccttccccgttaccccgtactacgttcccgtaacgggtaacgttaccggtacctaccggg

SEQ ID NO: 181335 - DNA, 735 bp, Homo sapiens
  misc_feature: GYAE6OF02HCUEI.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggccaccctgtctttgtctccgaggggaaagcgcccaccctctcctgcgacgggccagtcagacgtcttagcagcagctactagcctgtaccagcaagaacctcggaccaggtcctacccgacggtccttcctctacgtccgtacggtcgtaccactccgacgtccgacggggccctaacgtcggacctacgtacccgaaggaccgtaggtttcgaggtggacgtacgggtcggggttacggtaaggggtaaacgtccgttaccgaccgtttccgtccgtaccaacttccgaacgtacgtacggtaacggtcgggaaccgtaccgttaaggtaaagtttcgttttacgaccgtttaaggtttacggttaacgtttacgttacggtaccgagttaccgtagtttaagttaaccggttaaccttacctaacgtttcttacccgttacccggtttaccgggtaccccggttaacgggtaaaccgtaaacggttcggtaaacttacccggttaaaccgaaacggttaaccggttcggttacggcccgttaacg

SEQ ID NO: 181336 - DNA, 710 bp, Homo sapiens
  misc_feature: GYAE6OF02G62NX.38.26.C04.1.454.CMB.1.raw
tcagtcgatcacgtcacgaccggtgctcgatttagtctagcgactttgggtttgggggaagacaatgggtttgatttagattacatggggtgacttttctgttttatttccaatctcagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgccatccagcagggccacgtcggcatcccagaccaggttccaggtcggcgagtgggtcgtaggggaaatacttcacgtctcctaccgtatcgacgcacgaacgtggacgccctaggacgtaacgttttcgacgtaggttagtacgttaacttaggtctaacggacgtaaacgtacgttaacggtaaccctaccgttaacccgtacgtttacccgttaccggttttacccgggtaccccgttaacggggtaaaccccgtaaaagggttaccggttaacgtaacttaaaccgaaaaccggtaaaccttcggttacggtaccgttaacgaccctaacccgttataccgtttcgtttaccgttaaaccttcccgttaccgtaccctacgttaccgttaacgtaccgttacggttaccgtccgttaaccggg

SEQ ID NO: 181337 - DNA, 673 bp, Homo sapiens
  misc_feature: GYAE6OF02FSBV0.38.26.C04.1.454.CMB.1.raw
  modified_base (128)..(128): a, c, t, g, unknown or other
  misc_feature (128)..(128): n is a, c, g, or t
  modified_base (180)..(180): a, c, t, g, unknown or other
  misc_feature (180)..(180): n is a, c, g, or t
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (318)..(318): a, c, t, g, unknown or other
  misc_feature (318)..(318): n is a, c, g, or t
  modified_base (573)..(573): a, c, t, g, unknown or other
  misc_feature (573)..(573): n is a, c, g, or t
  modified_base (601)..(601): a, c, t, g, unknown or other
  misc_feature (601)..(601): n is a, c, g, or t
  modified_base (638)..(638): a, c, t, g, unknown or other
  misc_feature (638)..(638): n is a, c, g, or t
  modified_base (664)..(664): a, c, t, g, unknown or other
  misc_feature (664)..(664): n is a, c, g, or t
tcagtcgatcacgtcacgaccggtgctcgatttagtctagcgactttgggtttgggggaagacaatgggtttgatttagattacatgggtgacttttctgttttattccaatctcagataccacgganaaattgtgttgacgcagtctccaggcaccctgtctttgtctccaggggaaancgccaccctctcctgcagggccagtcagagtctancagcagctactagcctggtaccagcagaacctggccaggcctccgaggctcctcngtacctacgggtaccgtactccgagtccgagggtccctacgtggaccnccgtaccccgagtaccgtaggttccgaggttcggacgtagggtcgggtacgtaggggaaacttaccttcgacttcctacctccgtaatccgaagtcaggtacgtcggaacgtccgtaagaaggtttctttcgactaggttactattacgtggacgtacgtagaagttacgtagtaacctccgtaagttaccgttccttacggtttaccgacccggtacggtaacttaggtagttacctaacgacgtaaacccgtnttacggtcgtaccgtactaccgaacgtntaccggttctacttccgtaaccttcccgtacccgttntacgtttaccgtacggtacttacggnggttaccgg

SEQ ID NO: 181338 - DNA, 747 bp, Homo sapiens
  misc_feature: GYAE6OF02HQHM4.38.26.C04.1.454.CMB.1.raw
  modified_base (150)..(150): a, c, t, g, unknown or other
  misc_feature (150)..(150): n is a, c, g, or t
  modified_base (232)..(232): a, c, t, g, unknown or other
  misc_feature (232)..(232): n is a, c, g, or t
  modified_base (270)..(270): a, c, t, g, unknown or other
  misc_feature (270)..(270): n is a, c, g, or t
  modified_base (514)..(514): a, c, t, g, unknown or other
  misc_feature (514)..(514): n is a, c, g, or t
tcagtcgatcacgtcacgaccggtgctcgatttagtctagcgactttgggtttggggcagagctctggagaagagctgctcagttaggacccagagggaaccatcggaaaccccagcgcagcttctccttcctcctgctactctcggccncccagactacccgaccggagtaaattgtgttcgacgcagtcctccaggcctaccctgttcttcgttcaccggaagggaagcncctacctctctgcgacggccagtcaagtacgttctagngacgtcacgtacctagttacgccgtacggaccacggacaacgtaaaccgcggacctacggaccctacccgaggtcccttacctactaactccggttaaccggtcaccaacgttaccgaaccggccggtaccgggtacccacggtacgaccttaaccgtacccgaaggtaacccgtaggttaccgaggtccggaggtaggtaccgggtagtaacgggaactccgttactacgttacctccgtacncgtacagacgtaacggtacgtggacctacgtagtaagttgtttaccgaacgtgttaacgtttacgttacgtacgtaccgtagtaacgtacgtaacgttaaccgttacaacccgtaccttacgttaccgtttaccggttaccggtacccggtaaaggtaaaccgggtaacgttaaacggttacaaaccttacggtaaaaacccgtttggtacggttaccggcccgttaaaccgg

SEQ ID NO: 181339 - DNA, 777 bp, Homo sapiens
  misc_feature: GYAE6OF02H38D6.38.26.C04.1.454.CMB.1.raw
  modified_base (195)..(195): a, c, t, g, unknown or other
  misc_feature (195)..(195): n is a, c, g, or t
  modified_base (619)..(619): a, c, t, g, unknown or other
  misc_feature (619)..(619): n is a, c, g, or t
tcagtcgatcacgtcacgaccggtgctcgatttagtctagcgactttgggtttggggatcacataacaaccacattcctcctctaaagaagcccctgggagcacagctcatcaccagtggactggacctggacggttcctctttgtggtggcagcagctacaggtgtccacgtcccaggtgcgaggttggtgcgngtcgtggggcgtaggagggtgaaagaacgccgtagggtccgtcggtacggtaacggtcccctgacgaaggtcttcggtcgggacggcctaccttcacggtactaccgttacttaacgtttccgaggtcggtgggggtcgaccggtaccggtacccgggtaccccgttaggggaaccggtaacggggtccgttttacggggaaggttcgggggacggtacgggggtaacggggttactccccggttaccgggtaactttcggttaccggaaaccgtaaaccgtaaccaccgtaacggacctaacctaacgtaaccggttaccgaacggtaacaacgacgtacccgaacgtacgtaaccggcggaaccgtacgtacccgaacgtacgaacctactacggtaactacgagtacggaactaggtacgngtaacgagtacgagacgtactacggaccggtaaccgacgggtcgttacgttaacgttcgagtcgacggaggacgggtcggggacgtacgggtcgttagggtaacggttacggtttaggtcgtttacgttagtcggttaagtcccgggtaggtaaccgg

SEQ ID NO: 181340 - DNA, 697 bp, Homo sapiens
  misc_feature: GYAE6OF02JYXJT.38.26.C04.1.454.CMB.1.raw
  modified_base (152)..(152): a, c, t, g, unknown or other
  misc_feature (152)..(152): n is a, c, g, or t
  modified_base (227)..(227): a, c, t, g, unknown or other
  misc_feature (227)..(227): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagntaccaccggagaaattgtgttgacgcagtctccaggcaccctgtctttgtctccgaggggaaacagcccaccctntcctgccagggccagtcagacgtcttaagcacgtcaggctacttagccttaggtaccagctacgaaactggaccaggtccacccgagggcctccgtccaattcgtacggtagcctacgtccacggactaccggggcctacgtcgggactaacgtcccgaaggaccctagggtttcgaacggttggacctaggggtcggtcggtaaggggaactcctttacacgtctaccgttacattcgacgagtactacggtaggaccgtaccgtacgaaggttagtttacgcgtaaagttgttacttaacgttggtactcggtaacgacgttaacgttaggtaaccctaacgtaccgtaaccgttcgtaccggttttaccggcccggttaacggtaacccggttaacggtaacgggtaacccttaacgggtaacccttaaacccggtaacgtttacgggttacgtcccgttaaaccgg

SEQ ID NO: 181341 - DNA, 761 bp, Homo sapiens
  misc_feature: GYAE6OF02IU23Z.38.26.C04.1.454.CMB.1.raw
  modified_base (223)..(223): a, c, t, g, unknown or other
  misc_feature (223)..(223): n is a, c, g, or t
  modified_base (517)..(517): a, c, t, g, unknown or other
  misc_feature (517)..(517): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggcctcccagactaccaccggaagtaaattgtgttgacgcagtcctccaggccaccctgttctttgtctccgaaggggaancgccctaccctctccgtgcgacgggccagtccagtagtcttagcagcagtccttacttacgccttaggtacccagaccgaaacgtaacccgtcggacccgtacggtccctaccccggaggtacccttccgttcacgtttccgtaacggtcgacctacgtacccgaggacccggacgggaccctacgtcggacctacgtccccgaagtacggttaccgttacgagggtcgacgttaggggtacggttacggtaagggtaacttccgtactccgttactaccacgtcttaaccggnaacgtacgtacgtggaccgttacgtaggtaactttcgtttcggaaccgttagttacgtttaacgttaaccggttcgaacgtacgttacgttaacgtttaacggttcgttaaaccttccgtaaccgtttacgtttacccgttaacccggttttccccgggaaccgttaacgggtaaacttaacgggttaccttaagtttaacccgaaccggttaaaccggtacgttcggttaccggacttacccg

SEQ ID NO: 181342 - DNA, 697 bp, Homo sapiens
  misc_feature: GYAE6OF02F7DVL.38.26.C04.1.454.CMB.1.raw
  modified_base (114)..(114): a, c, t, g, unknown or other
  misc_feature (114)..(114): n is a, c, g, or t
  modified_base (217)..(217): a, c, t, g, unknown or other
  misc_feature (217)..(217): n is a, c, g, or t
  modified_base (314)..(314): a, c, t, g, unknown or other
  misc_feature (314)..(314): n is a, c, g, or t
  modified_base (326)..(326): a, c, t, g, unknown or other
  misc_feature (326)..(326): n is a, c, g, or t
tcagtcgatcacgtcacgaccggtgctcgatttagtctagcgactttgggtttggggcagagctctggagaagagctgctcagttaggacccagagggaaccatggaaaccccngcgcagcttctcttcctcctgctactctggcctcccagataccaccggagaaattgtgttgacgcagtctccaggcacccgtgtcttgtctccgagggtaaancgccacctctcctgcacggcagtcagagtcgtagcagcagctacgtagcctaggtaccagcaagaacctggacctaggcctaccgaggcctccgtanatccgtacggtnactaatcccgagtcgacggcctacgtcggacctacgtcccgagacctaggttaccaggtcggactaaggtacgggtaccgtaacggggtaaactccgtttacgtaccgttccgttaaccgttacccgaagtaccgaacgtaccgtaaccgggtacgttaccgggaacgttccgttaacggtaacgtttaacgttttcgaaccgtttaggtacgtttaaacgttccgttaggtaccgtaagtcggttaacgttacgttacgtaaaccgttacaacgttacgttacctaccggtttacggacccgtaacggtaaccgaacggttacgtaacgttacgaaccgtaaacgtaacgtcggtaccggacctaaccgg

SEQ ID NO: 181343 - DNA, 764 bp, Homo sapiens
  misc_feature: GYAE6OF02HPB0X.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgctccagggaaagacgccacctctcctgcaggtccagtcagagtctagcagcagctactagcctggtaccagcaagtaaacctggaccaggcctacccgaggtcctccgtacagttccttaacgggtcgaccactcccgaagtccgaacggggtccctaagtccgggactaccgtacccaaggacgtaagggtttccaaggttcggacgtaagggttcggggtactaaggggtaaaactccgtttaccgtaacgttccgttaccttacccgaacgttaccgaagtaccgaacgtaccgtacgggaccggtaccgtaaggtaaacgttagttttacgacgtaagtacgtttaaacgttacgttacgtacgtaacgtaccgtaaggttaacgttacgggttaaaaccttaccgtaacccgttacttttacccggttaaccgttttaccccgggtaacccggttaaccggggtaaaccccggtaaaagggtttacggtaaccgtttaaacgtaacccggttaaaaaccgttaaccgtttaacgggttacccggtaaccgttacccgg

SEQ ID NO: 181344 - DNA, 616 bp, Homo sapiens
  misc_feature: GYAE6OF02IU696.38.26.C04.1.454.CMB.1.raw
  modified_base (286)..(286): a, c, t, g, unknown or other
  misc_feature (286)..(286): n is a, c, g, or t
  modified_base (321)..(321): a, c, t, g, unknown or other
  misc_feature (321)..(321): n is a, c, g, or t
  modified_base (402)..(402): a, c, t, g, unknown or other
  misc_feature (402)..(402): n is a, c, g, or t
tcagtcgatcacgtcacgaccggtgctcgatttagtctagcgactttgggtttgggggatcacataaacaaccacattcctcctctaaagaagcccctgggagcacagctcatcaccatggactggacctggaggttcctctttgtggtggcagcagctacaggtgtccagtcccaggtgcagttggtgcagtctggggctgaggtggaagaacgcctgggtcctcggtgaaggtcccctgcaaggctctggaggccaccttcagcacctattactttcagctggngcgacaggcccctggacaagggcttggagtggagnggggaagggctcctccccgattcgttaggccaaaccaccactaacgcaacacaagttcagtacagactcgacattacccgnggacaacgtacctacgacgacaacgagtactacagtaggacgaagtgtacgtagactagacgtatacgtgaacggtaccacgggccgttaggttacttttacgtgtacggtacgagggacggtaagggggaccgtagggggtcgtacgggtagggttaacggtttagggttacgtcgtttttaggaacttaggttaccggtaggggtaaccggg

SEQ ID NO: 181345 - DNA, 936 bp, Homo sapiens
  misc_feature: GYAE6OF02IU2LX.38.26.C04.1.454.CMB.1.raw
tcagtcgatcacgtcacgaccggtgctcgatttagtctagcgactttgggtttggggatcacataacaacacattcctcctctaaagaagcccctgggagcacagctcatcacatggactggacctggaggttcctctttggtggtggcagtcagtctacgtaggttgtccaagttcccgaggttcgacgtaggtttgggtgcgtaggttcggtgggggtcgttagggagggttaggaaacggtaacggtcccgttggggttcccgttcgggtacggtaacccggttccccgtaggaccgtaacggttcctttccggtagggacggtcctaccgttcgacggacctaaccttacttccttacgtaggtcggttacggggcgtaccggaaccgtccgggtacccgttacggggaacggtaacgggggtcgtttacggggagggtacgggtacgggtacggggtacggtaccttaccccgtaccggttacttaccgggtttacgaaccaaaccgtacctaacgtaaccgactaaccgtaacgtacgtaaccgacgtaacgtacgtaaccgtacgaaccggttacgtacccggacggttaaccgaaccggttacccgaaggaaccgtaccgtaaccgttaagtaccgttaaacgtacggaaggttaaccgagttacgggtaacgtacgacgtagtacgacgtaacggacggaaccgtaccgggtaccgttacggtttacttttaacgggttcgtacggtagggtacggggtaacgggttacgggggaacccgggggttcgggtaacgggggttttaccgggttaacggggttttaccgggggtttaaaccgggttttacgggggttaaccgtttttaccgggtttaaggttacccgggttaacggggttttcccgggggtaaacgggggttaacccggg

SEQ ID NO: 181346 - DNA, 777 bp, Homo sapiens
  misc_feature: GYAE6OF02JZI9X.38.26.C04.1.454.CMB.1.raw
  modified_base (236)..(236): a, c, t, g, unknown or other
  misc_feature (236)..(236): n is a, c, g, or t
  modified_base (588)..(588): a, c, t, g, unknown or other
  misc_feature (588)..(588): n is a, c, g, or t
  modified_base (705)..(705): a, c, t, g, unknown or other
  misc_feature (705)..(705): n is a, c, g, or t
tcagtcgatcacgtcacgaccggtgctcgatttagtctagcgactttgggtttggggcagagctctggagaagagctgctcagttaggacccagagggaaccatcggaaaccccagcgcagcttctcttcctctgctactctggcctcccagactaccgaccggagtaattgtgttcgacgcacgtcctccgagcctacccttgttccgttttacgtcctaccggaaggggaaacnccgcccctaaccccttcctcccgtcggaccgtacggggaccctaggtaccgacggtaacgtttaccgttacggacctaacggtcaacgtaccgttaaccttacggtcccgtacggtaaccagaaccgaacgaaccggtcggaccgacgtccgtacccgcggtacctcctacacgttccgtacggtcactactcgaacgccgacggtccacggtcacctaccgaccgagtacgtacgtcgacggtcggtacgtacgggtcgggtaacgtaacggaacgttcctacgtacctactaccgtactacgtcgacgtacgtacgtacgacggtacgtacgtacgttaagttccgttanacggttacgttagttacgttaacgtccgtaaggtaccgttaagttacgttaacgtttaccaccggtttacctaacgtttccctttaacggtcccggttaaccggtacccgggttaanaaccggttacggttaacgtaacggttaacctaaacggtaccggttacgtaccgggttacgtccttaacccgg

SEQ ID NO: 181347 - DNA, 673 bp, Homo sapiens
  misc_feature: GYAE6OF02JCQ6L.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctaccgaggggaagacgcccaccctctcctgcgacgggccagtcagagtcttagcagcagctacttagcctggtaccagacaacgaacctggaccacggcctcccgacggcctccgtcacttccgacggtcgaccactcccaggccgacgggtcccaacggtcggacctacgtaccccgaagtaccggtacggttccgaaggttcggaccgtaggggttcgggttaccggtaagggggtaaaaccgtaccgtttaccgtaaccgtttcccttacccgtacccgtaacgttccgacgtaccgaacggttccggtacggaccggtaccgttaggtaaggttactttcgacgttagtgtttaacttacgtcgtacgagtacgtagttacgttacgtacctacgacttcttaccttacgttccggccgttaaggtaccgtaagtcgtaatactaacgtaacgagtcgtagctacg

SEQ ID NO: 181348 - DNA, 638 bp, Homo sapiens
  misc_feature: GYAE6OF02II5LZ.38.26.C04.1.454.CMB.1.raw
  modified_base (285)..(285): a, c, t, g, unknown or other
  misc_feature (285)..(285): n is a, c, g, or t
  modified_base (373)..(373): a, c, t, g, unknown or other
  misc_feature (373)..(373): n is a, c, g, or t
  modified_base (432)..(432): a, c, t, g, unknown or other
  misc_feature (432)..(432): n is a, c, g, or t
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagataccaccggagaaattgtgttgacgcagtctccaggcaccctgtctttgtctccgagggaaagacgcccaccctctcctgccgagggccagtccagtacgtcttagcagcagtctacttagccgtggtaaccngacaagaaacctggaccaggcctcccgaggcctcctctatcgtacggcgctactccagaccgacggtccagtcggctactccgagacnggttacaggtggcgtaggtggttacgtagggaactcgttactacgttctctacactcgngacgagtacgtggatccgtagacgttagtttacacgtagtcgttaacgttacgtcgtagtacgtacgttagtaacgttacgtaaacgtacctaacctagtttacccttccggtttccggacccggttaacggtaaccggtaaacggttacggtaatttaaccgaaccggttaaaccggtaaccgttcggtaccggtaccgtaaccg

SEQ ID NO: 181349 - DNA, 736 bp, Homo sapiens
  misc_feature: GYAE6OF02JRV82.38.26.C04.1.454.CMB.1.raw
  modified_base (294)..(294): a, c, t, g, unknown or other
  misc_feature (294)..(294): n is a, c, g, or t
tcagtcgatcacgtcacgaccggtgctcgatttagtctagcgactttgggtttgggggaagacaatgggtttgatttagattacatgggtgacttttctgttttatttccaatctcagataccacggagaaattgtgttgacgcagtctcaggcacctgtctttgtctccgaggggaaagagccaccctctcctgcgaggccagtcagagtcttagcagcagctacttagcctggtaccagcaacggtaaacctggccaggcctacccgaggcctcctctactcgtaccgggtnccgtaactcccgaggtaccgacggggacccacgttcggcctaacgtccccaagacgtaacgggttccaaggtcggacgtagggttcgggttacgtaacggggaaataccgttccgtaaccttcctacgtaccctagtaccgaggccaacggtacgttaggggccacggtaggtaattcgtttcgacgttagtacgtttaactcgtacgtacgtacgtagtacgttaagttacgtaaacctctaacgttcttaccgttacgttccggtacccggtacgggtaaacgtaacgggtacgtaacttaacgtaaaccgtaacgtaccgttcggtacggtacgtaccgtaccgtacgtacgtttacgttcgttaacccttactaacccgtttccgttaacccgttcttaaccgttcggttaaacgtaacggttcgtaccgttaaccgg

SEQ ID NO: 181350 - DNA, 1074 bp, Homo sapiens
  misc_feature: GYAE6OF02G5XIS.38.26.C04.1.454.CMB.1.raw
tcagtcgatcacgtcacgaccggtgctcgatttagtctagcgactttgggtttggggcagagctctggagaagagctgctcagttaggacccagagggaaccatggaaaccccagcgcagcttctcttcctcctgctactctggctcccagactaccgaccggagtaaattgtgttagacgctagtcctccgaggccacccttgttctttacgtcctaccgaaggggaaacacgccgaccctctacctgaccgacggaccagtccgagtacgtacttagcctagaccaggtcttaacgtacgaccgtacgtaccagaccgaacgtaaaccgtcggaccgacggtacccgttacccgaacgggtcccttacccgtacgtaccgttaccggtaacgggttccgaccgtaaccgttacccggacggacccggtaaccggggtaacccctaacggtaccggaccctaaccggtaccccgtaaacggtaaccggttacggtttacggacgggtttaccgggacggttacggggttaccggggttaaccgggtaaacgggggttaaaacccgtttacccgtttacccggtaaccctttcccgtttacccgtaaccgtaaccgtttaacccggaaccgggtaacccgttaaacgggttaacccggttaacggggtaaccccggttaacgggtttaaaccgggtttaaaacggttttacccggtttttacggggaaacccggttttaaagggtttttaacccggtttaacgggtttaaacccggtttacccgggttaacggtaaacccgggtttaacgttaaaccgggttttaaacggtttaacccgggttaaacccttaaccgtttaaacccccggttttaaccggttttttaccccgttaacccgggggtttttaaccccgggaaacccccgggggttttaaacccggggttaaaaacgggtttaaacccgggtttacccgggtttaaaaaacgttttaccgggttaaaaacccccgttaaaacgggggttttaaccccggtttaaccggggttacccggtaacccggttttaaccccgg

SEQ ID NO: 181351 - DNA, 537 bp, Homo sapiens
  misc_feature: GYAE6OF02FUE2B.38.26.C04.1.454.CMB.1.raw
  modified_base (214)..(214): a, c, t, g, unknown or other
  misc_feature (214)..(214): n is a, c, g, or t
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
tcagtcgatcacgtcacgaccggtgctcgatttagtctagcgactttgggtttgggggcagagctctggagaagagctgctcagttaggacccagagggaaccatggaaaccccagcgcagcttctcttcctcctgctactctggctcccagataccaccggagaaattgtgttgacgcagtctccaggcacctgtctttgtctccaggggaanagccacctctcctgcaggccagtcagagtcttagcagcagctactagcctggtacagcagaacctggccaggcctcccaggctcctnatctacggtgcatccagcaggccagtggcagtcccagacctaggttcagtggcaggtcgggtcgtagggaaanccgttcgacttctctcatcagcagactggacnccgtagaatntttgctagttcgtattactgtactagactagttacgtagtaactcgaactacttaccgaccgtttcggcctacgggaacctaaggtcgaacttagtaccgtaaacgtactcggtagctacg

SEQ ID NO: 181352 - DNA, 776 bp, Homo sapiens
  misc_feature: GYAE6OF02IZ3F0.38.26.C04.1.454.CMB.1.raw
tcagtcgatcacgtcacgaccggtgctcgatttagtctagcgactttgggtttggggcagagctctggagaagagctgctcagttaggacccagagggaaccatggaaacccccagcgcagcttctcttcctcctgctactctggcctcccagactaccaccggagtaaattgtgttgacgcagtctccgaggccaccgtgttctttgtcctaccgaggggaaacgacgcccacccgtcctacctgccgacgggtcccagtctaagtacgttcgttacgacagcagtcctactaggtccgtacggtaccgagtaccaacgtaaacccggtggacccgacggtcccgtacccgtaccggtccgttcccctacgtaaccgttccggtaaccggggttcaacccgttaacgtaccccgtaggaccgggaacccgggtccgtaacggtccgggtaccctaaccgtcccgtaacggtaacccgttaggttaccgtaggggtccggtacgtacggggttacgggttacggtaacggggtaaccgttacccttcgtaacccgttcttcccgtacgttaaccgtctacgtaacgtcggtacggtacggtacgtcccgttaagtaacgtttcgtttaccgtgttaacgtcgtttacgttaacgttcgtacgtcgagtacggttacgtacgtaccgtactacgttctaccgtccgttaccgggtacccgaggtaaccgtagtaccgtagtacctaaacggtacgtcggtaacgtcggtaccgtacg

SEQ ID NO: 181353 - DNA, 954 bp, Homo sapiens
  misc_feature: GYAE6OF02I3JHM.38.26.C04.1.454.CMB.1.raw
  modified_base (106)..(106): a, c, t, g, unknown or other
  misc_feature (106)..(106): n is a, c, g, or t
  modified_base (650)..(650): a, c, t, g, unknown or other
  misc_feature (650)..(650): n is a, c, g, or t
tcagtcgatcacgtcacgaccggtgctcgatttagtctagcgactttgggtttggggatcacataacaaccacattcctcctctaaagaagcccctgggagcacanctcatcaccatggactggacctggaggttcctctttgtggtggcagcagctacgaggtcgtccaacgtccacggtgcgtaaggttggtgctacggtcgtggggctggagggtaggaagaggtcccgttacggggtccttacgggttcggaaccgggtccccccttaggccgtaaacgggttcccttcggtagggtccgggtacctaaccccgtttcgacggtcctacccttaacttaccttttaccagtcggttggtccgggtacgaaccgtacccggggccccttaacggggaaccggtaacgggtaccgttggggtaagggtcgggtaagggtaggggtaccggggttacgtccccgtaccggttcgttccgttaccggtaacccgtaacaacccgtacccgtaacgacctaaacctaaccgtaaccggtttccaacgggtaaacaaggtaccctacgaaccgttaaccgttacccggggaacccggttaacgtaacgtaccctacggaccgtacgtaacgtaaccgtacgaacgtaagggngtacggtaacggtacgtaacggttacggtacttcggacgtaacgttcggtaaggaccggtaacccggtaccgggggttacccgtttagggtttaccgtttaccggttaccggttaccgggttacggtaaccgggggtaacgggggtaccgggggtcccggggggtcggggttttaaccggggttacgggggtttaaaccggggttttaaccggttttacggggtttttacgggtttagtttttaaccggggtttaccgggttacccgggttttaccggggtaaccgggggttaaaacccggggg

SEQ ID NO: 181354 - DNA, 505 bp, Homo sapiens
  misc_feature: GYAE6OF01DWJDA.41.6.A06.1.454.CMB.1.raw
  modified_base (486)..(486): a, c, t, g, unknown or other
  misc_feature (486)..(486): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgcagttgtattactgtcagcagtatggtagctcaccgatccaccgttcggccaagggacacgacgtggagacttaaccgactgnggctcgcaccatctgtctc

SEQ ID NO: 181355 - DNA, 499 bp, Homo sapiens
  misc_feature: GYAE6OF01D0EX5.41.6.A06.1.454.CMB.1.raw
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtggtctgggacagacttcactctcaccgtcagcagactggaccctagaagtntttgctagtgtattactgtcagcagtatggtanctcaccgtatcaccgttcgccgaaggacacgatggagacttaaccgactgngcngcacatctgtctac

SEQ ID NO: 181356 - DNA, 499 bp, Homo sapiens
  misc_feature: GYAE6OF01DPF5M.41.6.A06.1.454.CMB.1.raw
  modified_base (297)..(297): a, c, t, g, unknown or other
  misc_feature (297)..(297): n is a, c, g, or t
  modified_base (426)..(426): a, c, t, g, unknown or other
  misc_feature (426)..(426): n is a, c, g, or t
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctccagctctcatcaggtncatccagcagggccatggcatcccagacaggttcagtggcagtggtctgggacagacttcactctcacgtcagcagactcggaccctagaagtatttgcgtagtgtattactgtcagctagtatggtanctcacgactcaccgttcgaccaagggacacgctaggacgtacgttaacgatgngcngacacatctgtcgttac

SEQ ID NO: 181357 - DNA, 545 bp, Homo sapiens
  misc_feature: GYAE6OF01CUMPI.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttgccaacgactacttagcctggtaccatcagaacctggccaggctcccaggctcctcatctacggtgcatccagcgagggccacgtggcactcccagacaggttcaggtggcaggtgggtctgggacagactttcacttctcaccgtcagcagacgtcggaccctagaagtattttgctagtgttattacgtgtcagctagtagtggtacgctcgaccgactcctaccgttcggaccgaacgggacacgacgtaggacgtaagttaaccggtacgtggtcggcgtacgacctaccgtacttcgtcgttcc

SEQ ID NO: 181358 - DNA, 519 bp, Homo sapiens
  misc_feature: GYAE6OF01B5CRL.41.6.A06.1.454.CMB.1.raw
  modified_base (202)..(202): a, c, t, g, unknown or other
  misc_feature (202)..(202): n is a, c, g, or t
  modified_base (416)..(416): a, c, t, g, unknown or other
  misc_feature (416)..(416): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctccaggctcctcatctacggtgcatccagcagggccactggcatcccagacaggttcagtggcagtgggctgggacagcttcactctcaccgtcagcagactggaccctgaagtatttgctagtgtattactgtcngcagtatggtagctcgaccgtatccaccgttcggaccaacgggacacggactagggacgtacgttaaccgaactcggtcggctgaccaccatctgttcttacg

SEQ ID NO: 181359 - DNA, 532 bp, Homo sapiens
  misc_feature: GYAE6OF01A6RH9.41.6.A06.1.454.CMB.1.raw
  modified_base (304)..(304): a, c, t, g, unknown or other
  misc_feature (304)..(304): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggcctcccaggctcctcatctacggtncatccagcagggccactggcatcccagacaggttcagtggcaggtgggtctgggacagtacttcactctcaccgtcagcagactcggaccctgaagtatttgctagtgtattacgtgtcagctagtagtggtagctacacgtactccaccttacggaccgaagggacacgacgtaggacgtacgttaaccgagtcgtcggtctcggaccacctatctcgttcttaccg

SEQ ID NO: 181360 - DNA, 545 bp, Homo sapiens
  misc_feature: GYAE6OF01B1IJP.41.6.A06.1.454.CMB.1.raw
  modified_base (202)..(202): a, c, t, g, unknown or other
  misc_feature (202)..(202): n is a, c, g, or t
  modified_base (431)..(431): a, c, t, g, unknown or other
  misc_feature (431)..(431): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctccaggctcctcatctacggtgcatccagcagggccactggcatcccagacaggttcagtgcagtggtctgggacagacttcactctcgacgtcagcagactgaccctgaacgtatttgactagtgtattactgtacagctagtatggtancttacgaccgtatccgtaccttacggacctaacgggactacggacgtaggacgtaacgttaaccggaacttcggtacggtcttacgtactaaccgtattccgtgttccttaccg

SEQ ID NO: 181361 - DNA, 517 bp, Homo sapiens
  misc_feature: GYAE6OF01DT29K.41.6.A06.1.454.CMB.1.raw
  modified_base (203)..(203): a, c, t, g, unknown or other
  misc_feature (203)..(203): n is a, c, g, or t
  modified_base (299)..(299): a, c, t, g, unknown or other
  misc_feature (299)..(299): n is a, c, g, or t
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgaggggaagngccaccttctcctgcaggtccagtcagagtcttaccaacgactacttagcctggtaccatcagaacctgccaggctccagcctctcatctacggtncatccagcacgggccacgtggcatcccagacaggttcagtggcaggtgggtcngggacagtacttcactctcaccgtnagcagacgtcggacctaggaagtgtttgctagttgttattactgtacagctagtatggtagctacgaccgtatctaccgttcggccaaggacacgacgtgacgtaacttaacgactggtcgctgaccactatctgtctcg

SEQ ID NO: 181362 - DNA, 545 bp, Homo sapiens
  misc_feature: GYAE6OF01B6808.41.6.A06.1.454.CMB.1.raw
  modified_base (379)..(379): a, c, t, g, unknown or other
  misc_feature (379)..(379): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctcccaggctcctcatctacggtgcatccagcacgggccactggcatcccagacaggttcagtggctaggtgggtctgggacagacttcactctcaccgtnagcagactcggacctagaagtatttgctagtgtattacgtgtcagtctagtagtcggtagtctaccgaccgtatcctaccgttcggaccgaacgggacgacgtacgtagggaacgtaacgttaaccgaacgttggtcggctacgtcaccgactcgtgttcttaccg

SEQ ID NO: 181363 - DNA, 550 bp, Homo sapiens
  misc_feature: GYAE6OF01EGJIV.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaangccaccttctcctgcaggtccagtcagagtcttaccaacgctacttagcctggtaccatcagaaacctggccaggcctccaggctcctcatctacggtgcatccagcacgggccactggcactcccagactagggttcaggtggcaggtcgggtctgggacaggacttcactctcaccgtcacgcagactcggaccctgaagtatttgcgtagttgttattactgtcagctagtagtggtagtcctacgaccgtatacctaccgtcggaccgaacgggacacggactaggaacgtaacgttaaccgaacgttggtacgtcgtacgtccacctatcgtcgttcttaccg

SEQ ID NO: 181364 - DNA, 557 bp, Homo sapiens
  misc_feature: GYAE6OF01DR7PZ.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatcgtacggtgcatccagcagggccacgtggcactcccagacgtaggttcaggtggcgaggttgggtctgggacacggtacttcactctccaccgtcagcagactcggacctagaagtagtttgactagtgttattactgtcagtactagtagtggtactctcgaccgtactaccgtaccgttcggaccgaacgggtacacggacgtaggaacgtacgttaaccgacgtggtacggtctacgactaccgtattcttgtcttaccg

SEQ ID NO: 181365 - DNA, 579 bp, Homo sapiens
  misc_feature: GYAE6OF01DHNTW.41.6.A06.1.454.CMB.1.raw
  modified_base (204)..(204): a, c, t, g, unknown or other
  misc_feature (204)..(204): n is a, c, g, or t
  modified_base (391)..(391): a, c, t, g, unknown or other
  misc_feature (391)..(391): n is a, c, g, or t
  modified_base (403)..(403): a, c, t, g, unknown or other
  misc_feature (403)..(403): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccggagaaattgtgttgacgcagtctccagacaccctgttctttgtctccgaggggaaanacgccaccttctcctgcaggtccagtcagagtctacaacgactacttacgcctggtaccatcaacgaacctggccaggcctcccgaggcctcctcacttctacggtcgctactccgagcgacgggccacgtgcactcccagacaggttcagtcgcgtaggtcggtctgggacagtacttcactcacnccgtcagcagcncgtacctagagtatttgctagtgtattactgtcagtctagtagtggtcgctcaccgtataccgacgttaccggacgaacgggacctacggtacgtagggtaacgtaacgttaaccggaacgttcgggtacggtacgtaccggtacctacccgtagtttcgttccgttcgttacccg

SEQ ID NO: 181366 - DNA, 519 bp, Homo sapiens
  misc_feature: GYAE6OF01A4V9Z.41.6.A06.1.454.CMB.1.raw
  modified_base (301)..(301): a, c, t, g, unknown or other
  misc_feature (301)..(301): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatcacggtncatccagcagggccatggcatcccagacaggttcagtggcaggtggtctgggacagcttcactctcaccgtcagcagactcggaccctgaagtattttgctagtgtattactgttcagcagtatggtagctcaccgatcctaccgttcgaccgaagggaccacgtacgtaggacgtacgttaaccgaacgtcggtacggctgaccacatctgtcttcg

SEQ ID NO: 181367 - DNA, 545 bp, Homo sapiens
  misc_feature: GYAE6OF01EZYM1.41.6.A06.1.454.CMB.1.raw
  modified_base (292)..(292): a, c, t, g, unknown or other
  misc_feature (292)..(292): n is a, c, g, or t
  modified_base (376)..(376): a, c, t, g, unknown or other
  misc_feature (376)..(376): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctnatctacggtgcatccagccagggccactggcatcccagacaggttcagtgcaggtggtctgggacagacttcactctcaccgtnagcagactcggaccctgaagttatttgctagtgttacttactgtcagctagtatggtacgtctaccgaccgtactcctaccgttcggaccgtaacgggacacggacgtacgggaagtaacgttaaccgacgtggtcggcttacgacctaccgtattccttgtcttaccg

SEQ ID NO: 181368 - DNA, 685 bp, Homo sapiens
  misc_feature: GYAE6OF01DRIHQ.41.6.A06.1.454.CMB.1.raw
  modified_base (201)..(201): a, c, t, g, unknown or other
  misc_feature (201)..(201): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccggagaaattgtgttgacgcagtctccagacaccctgtctttgtctccagggaaanagccaccttctcctgcaggtccagtcagagtcttaccaacgactacttagcctggtaccatcaagaacctgccaggcctccaggctcctcatcgtacggtgctatccagcgagggccacgtggacactcccagacaggttcaggtggactaggtggtcgtagggactacggtaacttccgacttccgtacctaaccggttcaacggtaccacggtaaccggttaccgggtaacccccgttaagggtaaacggtttaacgttttttacggaccgttaaggtttacggtttaactttaacgttacggttacgtaacggtacgtaagtttacgttgggttaacgtccgttaccgaacccggtactacccgttaacccgttacgggtaccgaaacgggtaaccacggtaccgtagggaaacgtacgttaaaacccggagttcggacgggtcctacgtccgaacctagtttacctcgttactttacccg

SEQ ID NO: 181369 - DNA, 684 bp, Homo sapiens
  misc_feature: GYAE6OF01CV85Z.41.6.A06.1.454.CMB.1.raw
  modified_base (317)..(317): a, c, t, g, unknown or other
  misc_feature (317)..(317): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgcccccggagaaattgtgttgacgcagtctccagacaccctgttctttgtctccgaaggggaaagacgcctaccttctcctgcaggtccagtcagacgtcttaaccaacgtactacttagcctggtaccatcaagaaccgtggccaggcctccgaggcctcctacagtctacggtncactccagccgacggccacgtggcctactccccgaagtaccgtaggtttaccgaggtcggaccgtaggggttcgggtacgtaggggaacctaacggttaccctttaccgaccttccgtaccgacccgtcgacgtaccgaacggtaccgttacggtacccctaggtaaacgtttagttttcgacgttagttacgttagtttacgtcgtacgagtacgtaagttagttacggtacgtaccgtaccgtaaccgtacgttacccgtaccgtttaccgggaccgtaaacgggacctaaccggacgtaggtaacgtaaccgttaaccggtacgtggtacgtcgtacgaccacgttacttcgtcgttcttaccg

SEQ ID NO: 181370 - DNA, 534 bp, Homo sapiens
  misc_feature: GYAE6OF01EY8M0.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagccagggccagtgcatcccagacaggttcagtggcaggtcggtctgggacagacttcactctcacgtcagcagactcggaccctgaagtatttgctagtgtattacgtgtacgagctagtagtgtacgtactaccaccgtatcctaccgttcggaccgaagggaccacgtacgtaggacgtaacgttaaccgaacttggcggctcgaccactattctgtcttaccg

SEQ ID NO: 181371 - DNA, 562 bp, Homo sapiens
  misc_feature: GYAE6OF01EHPN1.41.6.A06.1.454.CMB.1.raw
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctccctgcaggtccagtcagagtcttaccaacgactacttagcctggtaccatcagaaacctggccaggctccagctcctcatctacggtgcatccagcaggccagtggcatcccagacaggttcagtgcagtggtctgggacagacttcactcncaccgtnagcagactcgacctagaagtagtttgctacgttgttaacttacgtgtactagctagtatggtacgtctaccacgtattccgaccgttaccggaccgaacgggaacctacggtacgtacggggtaacttaaacccggagttcgggtggaccgtcgaccctaacctacgttccgttcgttccgttctaccg

SEQ ID NO: 181372 - DNA, 858 bp, Homo sapiens
  misc_feature: GYAE6OF01DCTMP.41.6.A06.1.454.CMB.1.raw
  modified_base (204)..(204): a, c, t, g, unknown or other
  misc_feature (204)..(204): n is a, c, g, or t
  modified_base (307)..(307): a, c, t, g, unknown or other
  misc_feature (307)..(307): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgcccccggagaaattgtgttgacgcagtctccagacaccctgtctttgtctccgaggggaaanagccaccttctcctgcaggtccagtcagagtcttaccaacgactacttagcctggtaccatcaagaacctggccaggcctcccaggctcctcatcgtacggtncatccagcgacgggccacgtcggccactccccgaagacgtaggttaccaaggttcggacgtagggtcgggtacgtacggggaactaggtacctttccgaaccgttccgtacccgtaacccgttaccgaacggtaccgtaacggtaccgttaccggggtaacccccgttagggtaaacggtttacgtttttacgggaccgtttaaggtttacggtttaacgttttaaccgttacggttaccgtaacggtaccgttaagggtttaacggttacggggtttaaccgtacccgttacccggtaaaccccggttaccgttaaccccggttaaccccggttttacccggggaaacccggtaaaaccgggggtaaccccgtaaaccgggtaaaccggtaaccggggtaaacggtttaaaacccggttttaaaaccccgggtaaaaccggtttccggggttacccgggttacccggtttaacccgggtaacccccgttaaaccccggtttaaaccgttttccccggttttaaccgggtttcccctttttaaacccccgg

SEQ ID NO: 181373 - DNA, 692 bp, Homo sapiens
  misc_feature: GYAE6OF01CMXLY.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctccagatcgcccccggagaaattgtgttgacgcagtctccagacaccctgtctttgtctccgaggggaaagacgccaccttctcctgcaggtccagtcagagtcttaccaacgactactagctgtacatcaagaacctgccaggcctccaggctccgtcatcctacggtgcactccacgcgacggccacgtcggcactcccgaagacctaggttccaaggttcggacgtagggtcgggtcgtacgggacaggtactttaccgacttccgtacacccgtcacgacgacgtaccgtacggacccgtagtaaacgttacgtttttacggacgttaaggttacgttaacgtttaacgttacggtaccgtaacgtaccgtaagttacgttacgggttacgtaccgttacccgaaccgtacgttacccgttaccggttaccgggaccgtaaacgggaaccgtaaccggtaacgttacgggtaacggtaaaccgtttaaacccggaacgttcgggttacgaccggttacgtacccgtaacttacgttccgttcgttaccgtttaccg

SEQ ID NO: 181374 - DNA, 543 bp, Homo sapiens
  misc_feature: GYAE6OF01CTNUH.41.6.A06.1.454.CMB.1.raw
  modified_base (202)..(202): a, c, t, g, unknown or other
  misc_feature (202)..(202): n is a, c, g, or t
  modified_base (302)..(302): a, c, t, g, unknown or other
  misc_feature (302)..(302): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctccaggctcctcatctacggtncatccagcagggccactggcatcccagacaggttccaggtcggcaggtcgggtctggggacaggtacttcacgtctcaccgtcagcagactgaccctgaagtatttgctagtgtattactgtcatcagtatggtagctacaccgtatacctacccgttcggaccgaacgggtacacggtacgtggaacgtaacgtaaccgaacgtggtacgactcgtaccacgtattcctgttccttaccg

SEQ ID NO: 181375 - DNA, 749 bp, Homo sapiens
  misc_feature: GYAE6OF01EDPC9.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccggagaaattgtgttgacgcagtctccagacacctgtctttgtctccgaaggggaaagcgcctaccttctcctgcgacggtccagtcagtacgtcttaaccaacgacttacgttacgccgtcggtaacctactacgaacgaaaccgtcggacccgaacggtccctacccgaacggtcctcctacaacgttccgtacggttcgacctactacccgagccgacgggcccacgtacggaccaccgtcccgaacggtaccgtacgggttacgagggtcggacgtaggggttcgggttacggtacgggtaaacctacgtacccgtttacgaacccttccgtacccgaaccggttaccgacggaccgtaacggtaacccgtcgggttaaccccgtaagggttaaacggtttcttttaacgggacttaacggttagtttaaacgtttacgttacggtactaggtacttagggtacgttgggtaacttacctaccggaaccgttacctcccgtaccggttacggaacggaacggtaccacggtacggtaggaacgttaacgttaaccggtagtcggcgttacgaccgctacccgttatccgtgttcctaacg

SEQ ID NO: 181376 - DNA, 567 bp, Homo sapiens
  misc_feature: GYAE6OF01BU8T7.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtccttaccaacgactacttagcctggtaccatcagaaacctggccaggcctccaggctcctcatctacggtgcatccagcgaggccactggcactcccgagactaggtcagtggcaggtggtcgtgggacagacttcacttctcaccgtcagacacgtaccgtcgaccctagaacgtagtttcgactaggttattacttacgtgtacgagtcgtaagtagtaggtacgcctaccgaaccgtacttccgtaccgttacggaccgaacgggactacgacgtaggtacgtaacttaaccggactggtacgtctcgacaccctattcgtcgtcttaccg

SEQ ID NO: 181377 - DNA, 561 bp, Homo sapiens
  misc_feature: GYAE6OF01CK2AJ.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactactagcctggtaccatcagaacctggccaggctccagctcctcatcgtacggtgcactccagccgagggccacgtggcactcccagacaggttcaggtggcgaggtggtactgggactaggtacttcactctcgaccgtcagcagacgtcggaccctgaatagtttgctagtgtacttactgtcgagcgtagtagtggtacgccgttacaccgtatcctaccgttccggaccgaaacgggactacggacgtaggtaacgtaacgttaaccggaacgttggtacggctcggacctacctagtccttcgttcttccg

SEQ ID NO: 181378 - DNA, 562 bp, Homo sapiens
  misc_feature: GYAE6OF01C207U.41.6.A06.1.454.CMB.1.raw
  modified_base (413)..(413): a, c, t, g, unknown or other
  misc_feature (413)..(413): n is a, c, g, or t
  modified_base (425)..(425): a, c, t, g, unknown or other
  misc_feature (425)..(425): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgaggggaaagagccaccttctcctgcaggtccagtcagagtcttaccaacgactacttagcctggtaccatcaagaacctggccaggcctccaggcctcctcatctacggtgcactccagcgacgggccacgtggcactcccagacaggttcaggtggcaggtcgggtctgggacagtaccttcactctcaccgtcagcagctacggaccctagaagttntttgactagttntattactgcagtctagtatggtaanctacaccgtntccgtaccgttcggaccgaagggaccacgtacgtaggaacgtaacgttaaccggacgttcggtcggtactcggtacctaaccgtattccgtcgttcttaccg

SEQ ID NO: 181379 - DNA, 506 bp, Homo sapiens
  misc_feature: GYAE6OF01AUPOO.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctcccaggctcctcatctacggtgcatccagcagggccactggcatcccagacaggttcagtggcagtggtctgggacagacttcactctcacgtcagcagacgtgacctgaagtatttgcagtgtattactgtcagctagtatggtacgctcgacgtatcaccgttcggcaacgggacacgacgtggagacgttaaccgacgtgtacgcgtcgacacatctgtctcg

SEQ ID NO: 181380 - DNA, 584 bp, Homo sapiens
  misc_feature: GYAE6OF01BXP4K.41.6.A06.1.454.CMB.1.raw
  modified_base (203)..(203): a, c, t, g, unknown or other
  misc_feature (203)..(203): n is a, c, g, or t
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
  modified_base (446)..(446): a, c, t, g, unknown or other
  misc_feature (446)..(446): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgagggaaagngccaccttctcctgcagtccagtcagagtctacacgactactagctggtaccatcaagaaacctggccaggcctccaggctcctcatcgtacggtgctatccagccagggccacgtggcacgtcccagcaggttcagtggctaggtggtctagggaccagtacgttctacgtctccgaccgtcgagcgagtacgtcgacctagagtntttgctgtagtattactgtacngctagtagtggtanctcgaccgtactcctaaccgttccggaccgtaacggaccgacggtacgtacgggtaacgtaccgtttaaacccggaacgttcgggtacggtacgtaccggtacctacccgtaatttccgttaccggttccctttaccg

SEQ ID NO: 181381 - DNA, 737 bp, Homo sapiens
  misc_feature: GYAE6OF01CCF1K.41.6.A06.1.454.CMB.1.raw
  modified_base (203)..(203): a, c, t, g, unknown or other
  misc_feature (203)..(203): n is a, c, g, or t
  modified_base (305)..(305): a, c, t, g, unknown or other
  misc_feature (305)..(305): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctcagacaccctgtctttgtctccgaaggggaaanagcctaccttctcctgcaggtccagtcagagtcttaccaacgactactagctggtacatacagaaacctggccaggcctccgaggctcctcatcgtacggtnacactccagcgacggccacgtggaccacgtacccagtaaccgtaggttcgaaggtcggactagggttcgggtcgtaggggaactaggtacttaccgacttacctaccgacccgttagacggacgtaaggtaccgtacggtaacccgttaaggtaaacgttacgtttttacggaccttaaggtttaccggttaaacttttaccgtacggtacgtaacgggttactaacgggttaaggttagggttaaccggtaccttaaccccgtaaccggttaacttacccggtttaaccccggttaccggggaaccgttaaagggacccctaaacggtaccgggtaaaggtaacggttaaaccggttttaaaccgaacggtttgggtacccgtacgttaacggtaccctaacgttagtttccccgttggttcttaacccgg

SEQ ID NO: 181382 - DNA, 627 bp, Homo sapiens
  misc_feature: GYAE6OF01AR0DO.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggcctcccgaggctcctcatctacggtgcatccagcacgggccacgtggccactacccgagtaccgtgtcgaggtcggacgtagggtcggtcggacggaacgacgtacctctaccttacctaccgaccgtacgacgacgacgaccgtccgtaaccgtagtaacgttagtttcgacgttaacggtagtttaacttacgtcgtacgacgtacgaagttacgtaggtaccgtctacccgtacgtaccgttaccgtccggttacccggaacgaacggtaacgacgtacgtaaggacgtaaccgtaacgtacgtcggtacgcgttacgacctactccgttcgttcgttcttaccg

SEQ ID NO: 181383 - DNA, 831 bp, Homo sapiens
  misc_feature: GYAE6OF01D0V05.41.6.A06.1.454.CMB.1.raw
tcagtctatactatcacgaccggtgctcgatttagatctactgacagggtgtctggagactgcgtcaacacaatttctccgagggaaccatggaaacccagcgcagcttctcttcctcctgctactctggcctccagactcgcccggagtaattgtgttcgacgctagtctccacgacctaccgtgttctttcgtctaccggaaggggaaacgaccggtcctaccttcctccgtcgacgtacggtcctaacgtcgtaagtacgttacctaacccgtaacgtaccgttaccgttacgtccgtacggtaacctactacgtaaacgaaccgtcggaccgtaacggtcctaccgacggttccctacctcgtaacgttaccggtaccggtcgtaccgtaccgtaccgacggccggtaaccgggaccgtaacgtcggtaaccctacccggtaacccaacggttaccggtacggttaacggtacgggttacggtacggttacggggttacgggttacgtacggggaaacctacggtacctttacccgtaccgttccgtaccgtaccgtaccgaacggtcgtaaccggtacccggtaccggtacgtaagttacggttagttacgacggttaacgtttagttacgttacctaggtacggtctacggttacttacgggtaacggttcaaccggttccaacccgggttacgtaacccttacgggtaacccgaacgggtaacgaaccgtacggtaggtaaaccgaagggtttaaccctaacgggcggttaacgggacgtcgtaaccgtccgtagtacccttacgtttaccggtcttaccccgg

SEQ ID NO: 181384 - DNA, 649 bp, Homo sapiens
  misc_feature: GYAE6OF01AFGA7.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattcgtgttgacgcagtctccagacaccctgtctttgtctccgaggggtaaagagccaccgttctaccgtgcaggtccagtcagagtcttaccaacgactactagcctgtaccatcacgaaccgtggccaaggcctccacggtctcctcactcgtacgggtcgccacgtccagtccgacgggccctacgtcggccacgtaccccgaagtaccgtacgggttcagggtacggccgtaggtcggggtacgtaggggaccagtacttccgaccttctcgaccgtcagacgacgacgtcggacctagaacgttagtttcgacgtagttacttattaacgtcgtaacgacgtcgtaagttacgtaggtacgtccgtaccgtacggtactacccggtaccgttaccggaccggtaacgggaccacggtacggtaggaacgtaacgttaaccgaacggttgggaccgtcgtacgtacccaacttactcgttcgtccgtttaccg

SEQ ID NO: 181385 - DNA, 695 bp, Homo sapiens
  misc_feature: GYAE6OF01EGWY4.41.6.A06.1.454.CMB.1.raw
  modified_base (203)..(203): a, c, t, g, unknown or other
  misc_feature (203)..(203): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccggagaattgtgttgacgcagtctccagacaccctgttctttgtctccgaggggaaancgcctaccttctcctgcacggtccagtcagagttcctaccaacgtactacttacgcctaggtaccatacgaacgaaaccgtcggaccgacggcctcccgacggtcctccctactacttacgtacgggtcgacctactcccgaaggccgaccggggaccctacgtcggacctaacgtaccccgaaggtaccgtacggttccgaaggtcggacgtagggttcgggtcgtacggggactacggtaccttccaccgtccgtaccgacccgtacgtacgacgaacgtaccgtaccggtaccccgttaggtaacgttacgtttacgtacgttagttagtttactttacgttcgtactacgtcgtaggttagtcgtacgtacctaccgtaccgtctacccgtaccgtacggacccggaaggacgaccgtacgtacggtaacgtaacgttaaccggtacgtggtacgcgtacgtaccgtactattcttcgttcgttaccg

SEQ ID NO: 181386 - DNA, 707 bp, Homo sapiens
  misc_feature: GYAE6OF01DVCSK.41.6.A06.1.454.CMB.1.raw
  modified_base (336)..(336): a, c, t, g, unknown or other
  misc_feature (336)..(336): n is a, c, g, or t
tcagtctatactatcacgaccggtgctcgatttagatctactgacagggtgtctggagactgcgtcaacacaatttctccgagggaaccatggaaacccagcgcagcttctcttcctcctgctactctggctcccagactcgaccccggagtaaagttgtgttgacgcagtctccacgacacctgttctttgtctacgaaggggaaacgacgcctaccgtttcacctgcgtacgtccagtcagacgtacttaaccaacgacttacgtacgctagtaccatacaacgaaccgtcggaccgacggcctaccgacgcctccactacgttcgtacggtcnctacgccgagccgacggacacgtcgactacgtccgaacggtacgtaggttacgacggtcggacggtacggttcgggttacggtacgggaactcgtaacctttcgacctttaccgtccgaaccgtcgacgtacgaagtaccggttcgtaccgtaaggtaacgtttcgtttacggaaccttagtttacgttaacgttacgtcgtacgtacgaacgttaaggttcgtaagggtcctaccgtaccgtaaccggttctacccgttaaccgtaccgggtaacgaaaccgggtacaacgggttaccggagtaaaaccgtacggtttaaaccggacgttggaccgtacgacgtactactgtttacttccgtacttcccg

SEQ ID NO: 181387 - DNA, 924 bp, Homo sapiens
  misc_feature: GYAE6OF01CT52F.41.6.A06.1.454.CMB.1.raw
tcagtctatactatcacgaccggtgctcgatttagatctactgacagggtgtctggagactgcgtcaacacaatttctccgaggaaccatggaaaccccagcgcagcttctcttcctcctgctactctggcctcccagatcgccccggagaattgtgttgacgcagtctccagaccacctgtctttgtcctccgaaggggaaacgcgaccaccttcctccgtgctacgggtccagttccgagtacgttaccttaacccaaacgtaaccttaaccgttacggcccgttacggtaacctacgtaccgtaacggtaaaacccgtcgggcccgaacgggtcccttacccggaggtccccttacctaccgtaacgtttccgttaaccgggtcgtaccctaacgttcccgaacgggacccggaaccgggggtaccctaccgggttacggaccctaaccgtaccccgaaacggtaaccggttaacgggtttccgaagggtcgggaccggtaggggttcgggttacgtagggggaaacctaccggttaaccttcccgtaacgttccccgtacccgtaaccccggttacgaacgtacccgtaacgggtaccggtaaccgggttaaccccggttaacggttaaaacggtttacgttttacggaacggtttacggtttacgtttaacgtttaccggttaccggttaccggtaacgttaccggttaacggtttacgggttcgggtaacccgtcgttaaccccggtaacccgtaccggttaccccgttacccgggttacccggtaccggtaaaccgggtaaccgaaccggttaacggtaccggtaaaccggttaaaccggttaaacccggtacggtcggttacggtccggtaccgtaccgttaccgttagttacccgtttcgtttcccgttaacccg

SEQ ID NO: 181388 - DNA, 724 bp, Homo sapiens
  misc_feature: GYAE6OF01DLHPF.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgaggggaagagcctaccttctccctgcacggtccagtcagagtcttaaccgaacgaccttacttagccgtcggtaccatcaagaaaccgtcggaccgaaggcccttacccgacgggtcctcccgtacctacttccgttaaccggtgcctactccgaggccgaacggggcctaaccgtgggaccactccccaaggacgtacggttacgaggtggcgtaggtggtctagggacagtaccttccgacttcctacgacccgtacgacgtaccgacggtacccgttacggtaccccgtaaggtaacgtttacgttttaccggtaacgttacggtttacgttaaaccgtttttaccgtacgttaaccgtaacgtaccgtagttaaggttacggttaagtcccgttaccgaccgtcgttaacccgtcccgtttaccggaccgtaacggtaccgtacggaccgttaggaacggtaacgtaaacccggtacttacgggcgtacgaccgtaccctacgttactccgttgttcccttaccgg

SEQ ID NO: 181389 - DNA, 559 bp, Homo sapiens
  misc_feature: GYAE6OF01CBAPV.41.6.A06.1.454.CMB.1.raw
  modified_base (201)..(201): a, c, t, g, unknown or other
  misc_feature (201)..(201): n is a, c, g, or t
  modified_base (533)..(533): a, c, t, g, unknown or other
  misc_feature (533)..(533): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgccccggagaaattgtgttgacgcagtctcagacaccctgtctttgtctccgaggggaaangccaccttctcctgcaggtccagtcagagtcttaccaacgactacttagcctggtaccatcagaaacctggccaggcctccgaggctcctcatcgtacggtgcactccagccgagggccacgtggcactcccagactaggttcaggtcggcgtaggtggtcgtgggacagtactttcaccttctcgaccgtcagcagtaccgtcgaccctagaagtctttgctagtcgttattactgtacgagtactagttatgggtactctaccaccgtataccgtaccgtaccggacgaacggacacggacgtaggacgtaacgttaacgacgttgcgtntcgtacactattcgtcgttcttaccg

SEQ ID NO: 181390 - DNA, 824 bp, Homo sapiens
  misc_feature: GYAE6OF01CHYKC.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctccttcctcctgctactctggcctcccagatcgcccccggagaaattgtgttgacgcagtctccagacaccctgtctttgtcctaccgaagggaaagcgccctaccttcctccgtgcgacggtccaagtcgagacgttccttaaccaacgtaccttaacgttacgtccgttacggtaacctactaccgaaacggtaaacccgtcggaccgaccgggtccctacccggtacggtccttcccgtacacgttccggttaacggtcgacctaacgtaccgacggacccggacgggtaccctaaccggttcggaccctaccgtaccccgaaggtaaccgtacgggtttaccgaacgggttcggacgtaggggttcgggtacgtacgggaactacggtaccttccgtacttaccgtccgtacccggtacgacggaccgtaacggtacccgttaccggggtaacccttaaggttaaacgtttacgttttcggaacgtttacggtttagttaacgtttacgttacgacgtaacgtcgttaaggttacggttacggtacgccttaacccggaaccttaccggttacccgtaaccggttccgggtaaccggaaacggtacccgacggtaccgggttaacgtaaccgttaaacgttaaaccgtacggttacgggtacgccttaacgacccttaaccggtatttcccgttacgttcccgttaccg

SEQ ID NO: 181391 - DNA, 640 bp, Homo sapiens
  misc_feature: GYAE6OF01B16JS.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgccccggagaaattgtgttgacgcagtctccagacaccctgtctttgtctccgaggggaaanagccaccttctcctgcaggtccagtcagagtccttaccaacgactacttagcctggtaccatcagaacctggccaggctccaggctctcatctacggtgcatccagccgacgggcccacgtcgggccacgtccccagaccgtaggttccaggttggcgtaggtgggtctcgggaactagtacttccacgttcctaccgaccgtcacgcagacctcggaccctagtaacgtactttgacgtagttcgttactttacgtacggtctacggtactacgttaacgtggttaacgtccttaccgaccgtaccttacccgtacccggtttaccgggaccggtaaacgggtaccgaacggtaccgtaacgggtaacgtaaccgtttaaaccggacgttcgggttacggcggttacgaccgtactagtttcttcggttcttacccg

SEQ ID NO: 181392 - DNA, 739 bp, Homo sapiens
  misc_feature: GYAE6OF01CYB65.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctccagactcgccccggagtaattgtgtgacgctagtctcagacacctgtctttcgtctccgaagggaagacgcctaccttcgtcgtcgcgacggtacgacgtacgaagtacgtaccttaaccgaaacgtactaacgtacggtacctacggttacctatacgaacgtaaaccgcggaccgtaacgggtcccttaccggacggtacctcccgttacgtacgtaccgtacgggttacacttaaccgtaccgaacggtccggaacggaccttacggtacggtaccaaccgttacgaacggtaaccggtacggtaccggtaaggtccggacgtaacgggttcgggttaaccggaggtacgaacgtccgttacgaccttaccgacctccggtaacgcgtaacctcgtaaacgcggtacctaacggtaacgttacgttcggtactagggttactacgttactacggtactacggtaactggtaaacgtcgggttaacacgtaccgtaccgtactaccgtccggtacgtaacccggagtacgaccgtagtaacggtaacgtaacgtaccgtaggtccgtacgtacggtctaccacgttacgacttgcttacccgg

SEQ ID NO: 181393 - DNA, 561 bp, Homo sapiens
  misc_feature: GYAE6OF01DY5ZH.41.6.A06.1.454.CMB.1.raw
  modified_base (308)..(308): a, c, t, g, unknown or other
  misc_feature (308)..(308): n is a, c, g, or t
  modified_base (437)..(437): a, c, t, g, unknown or other
  misc_feature (437)..(437): n is a, c, g, or t
  modified_base (458)..(458): a, c, t, g, unknown or other
  misc_feature (458)..(458): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgccccggagaaattgtgttgacgcagtctccagacacctgtctttgtctcgagggaaagacgccaccttctcctgcgaggtccagtcagagtcttaaccaacgtactacttagcctacggtacatacaagaaccgtgccaggcctccgaggctcctcatctacggtcncactccagccgacggccagtcgcactccgagcgtaggtcagtgcgaggtcggtcgtggacagtactcactccgtacaccgtacagcagactccggacctagaacttgttcgacgtagttgtacttacgntacgtagctaggtatcggtanccgtacacgtctaccgtacggtcgaccggaaggccacggatacgggattaaacggttaacgaggttcgcggtctacgtctaactnttccgtnttcccgtttac

SEQ ID NO: 181394 - DNA, 742 bp, Homo sapiens
  misc_feature: GYAE6OF01D9SVD.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctccttcctcctgctactctggctcccagactcgccccggagaattgtgttcgacgcagtcctccagacacccttgttctttcgtcgtaccggagggaaagacgaccacctttctccctggactacggttaccacgttacagtacgttctaaccgaacactacttacgccttacggtaaccactacgaacgtaaaaccgtcggaccacggtcctaccgaggtacctcctacacgttcgtaacggtcacctactaccggagaccgacgggaccctacgacggtaccacgtcccgacggacgtacggttacacgggtcggacgtacgggttcgggtacggtgggaacctacggtaccttccaaccgtccttaacccgtaccgggttacacgtacggtaaccgtaccggttaaccgggtaacccgttaggaaaacggtttcgtttttacgaaccgtaaggtttacgtttaacgtttaaccgttcggaccgttaacggtcgttaaccggttaggttacgggtaacgtacgttacgaaaccgttcgtaacgtcccggttacggaccggaaggactaacggccgtaggaacgtaacgttaccgcgttggacgtcacgtcaacctgtctccgttcttcc

SEQ ID NO: 181395 - DNA, 742 bp, Homo sapiens
  misc_feature: GYAE6OF01AB9IT.41.6.A06.1.454.CMB.1.raw
  modified_base (150)..(150): a, c, t, g, unknown or other
  misc_feature (150)..(150): n is a, c, g, or t
  modified_base (657)..(657): a, c, t, g, unknown or other
  misc_feature (657)..(657): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccgganaattgtgttgacgcagtctccagacctacctgttctttgtcctaccgaaggggaaagcgcctaccttctcctgcgtacggtccagtcagtacgtaccttaaccaacgacttacgttacgtccgttacggtaaccagtacaacggtaaacccgtcggcctaacgggccctaccgacggtccctcccgtactacttccggtaacggtcgactactaccgacgccggacggtacccacgtacggcctaaccgtacccgaaggtacgtacggttacgacggtcggacgtagggttcgggtccgtacgggtactacggttaccttacccgtacttcccgtaaccgtaccggtacaacggtcgtaacgacccgtaccgggtacctagggttaacgttacgtttacgagttacgtttagttacttacggtcgtacagtacgtagttacgtacggtcctaccgttccgaacgttaccgtaccgtacccggttacggacccggtaacggaccggtntaaccgggtggtaaaccttaacggtaccggttaggcgtacgggtacttcgacccgtttaagtccttttccggtctttcccgtacg

SEQ ID NO: 181396 - DNA, 630 bp, Homo sapiens
  misc_feature: GYAE6OF01BDQGJ.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctccagatgcccccggagaaattgtgttgacgcagtctccagacaccctgtctttgtctccgaggggaaanagccaccttctcctgcaggtccagtcagacgtcttaaccaacgactacttagcctggtaccatcaagaacctggccacggctccgaggctccgtcactactacggtcgacactccagacgacgggccactggacactccagagtacgtcgagtggcaggttggtctgggactagtacctttcaacttcttaccgaccgttacaggacacgtacgtaccggtacccgtagtaaagttcgtttacgacgtaggttacttacgtttacgtgtacaacggtctaagttacgttacggtactccgtaccgtaccgtacttaccgtaccgttacggaccggaacggaccgacgtacgtagggtaacgttaacgtaacccggtagttcgggtcgtacgaccggtacctaccgtattccgttacgtcctttacccg

SEQ ID NO: 181397 - DNA, 717 bp, Homo sapiens
  misc_feature: GYAE6OF01BT80B.41.6.A06.1.454.CMB.1.raw
  modified_base (200)..(200): a, c, t, g, unknown or other
  misc_feature (200)..(200): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctccagatcgccccggagaattgtgtgacgcagtctccagaccaccctgtctttgtctccgagggaaancgcctaccttctcctgcgaggtccagtcagacttaccgttaacccaacgtactacgttacgccttacgggtaaccatacgaacggtaaacccgtcggaccgtacgggaccctaccgacggtcctccttaccacttcggtacggtcgacctacgacctaggacgacggggaccctacgtacgggtcccactaccccgaagaccgttaagggtccaggttcggacggtagggttcggggtacgtacgggaacctacgtacgtccgtaccgtccgtacaccggtcaccgtacgacggtacccgtacggaccttaaggtacgtttaagttcgacctaaggtttacgttcgtttaactgtaccaggtactaggtacgttaggtcctaacgccgaccgtactccggttaccgtcggaacccggaagaccgtaacggactaagggtaaccgtaacgtaaaccggtacggttcggtaccgtcgtaccgtacctaacgttacacccgtttggttaccccgttaccg

SEQ ID NO: 181398 - DNA, 735 bp, Homo sapiens
  misc_feature: GYAE6OF01A2LL4.41.6.A06.1.454.CMB.1.raw
  modified_base (205)..(205): a, c, t, g, unknown or other
  misc_feature (205)..(205): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgcccccggagaaattgtgttgacgcagtctccagaccaccctgtctttgtctccgaggggaaanacgccctaccttctcctgcacggtccagtcgagtacgttccttaaccgaacgtacttacttacgccgtaggtaccatacgaacgaaaccgtcggaccacggtcctacccgaggtcctccctctacgtccgtacggtcactactccgacgccggaacgggccctacgtcggaccaccgtaccccgaaggacctaacgggttccgaggtcggacgtagggttcgggtcgtcgggaactacggtaccttaccgaccttccgtaccgtaaccgtcgaagtccgtaaggtaccgtaccgggacccttagtaacgtttacgtttgacgttagttacgttactttacgtacggtacacggtacgttaaggttacggtacggtaacgtaccttccggaaccgttacttacccggtacccggttaccgggtaaccgaacgggtaacctacgggtaaccggtaggtaaaccgttaaaccggttaaaccgtacggtgggtccgtacttacgaacctacgtaccttcgttcgttccgttacc

SEQ ID NO: 181399 - DNA, 553 bp, Homo sapiens
  misc_feature: GYAE6OF01ECSPZ.41.6.A06.1.454.CMB.1.raw
  modified_base (202)..(202): a, c, t, g, unknown or other
  misc_feature (202)..(202): n is a, c, g, or t
  modified_base (379)..(379): a, c, t, g, unknown or other
  misc_feature (379)..(379): n is a, c, g, or t
  modified_base (387)..(387): a, c, t, g, unknown or other
  misc_feature (387)..(387): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcaagaaacctggccaggctcccaggcctcctcatctacggtgacatccagcgagggccacgtggcacgtcccaagacaggttcaggtgacaggtggtctgggacagtctcacttcncgaccgtnagcagactcgaccgtagaagtatttgactagttgtacttacgtgtacacgtctagttagtggtaacgtctacgaccgtatccaccgttcggaccaagggacaacgacgtaggaacgtaacttaaaccggacttgtacggctacgcctaacattcgttgttcttacg

SEQ ID NO: 181400 - DNA, 580 bp, Homo sapiens
  misc_feature: GYAE6OF01BY794.41.6.A06.1.454.CMB.1.raw
  modified_base (201)..(201): a, c, t, g, unknown or other
  misc_feature (201)..(201): n is a, c, g, or t
  modified_base (324)..(324): a, c, t, g, unknown or other
  misc_feature (324)..(324): n is a, c, g, or t
  modified_base (573)..(573): a, c, t, g, unknown or other
  misc_feature (573)..(573): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgccccggagaaattgtgttgacgcagtctcagacaccctgtctttgtctcacgggaaagngccacttctcctgcaggtctagtcagagtcttaaccaacgacttactagcctagtacatacagaaacctggctagctccaggctctcatcgacgtgcatccagcaggccatggcactcccganacgtagttcgagtggcgtaggtggtctagggacagtacgttcaccgtctaccgtactcgagacgtaacgtacgtcggtaccctagtaaagttacgtttagagtagttagttattaacgtgtacgacgagtaaggtacgtaggttaacgccttaccgaactacgtactacccgttacgaccgaaacggaccaaacgtgtagaacgtaacgtaaaccgactcggtgacgtacgtaccacgtattctcgttnttacccg

SEQ ID NO: 181401 - DNA, 813 bp, Homo sapiens
  misc_feature: GYAE6OF01B7QX1.41.6.A06.1.454.CMB.1.raw
tcagtctatactatcacgaccggtgctcgatttagatctactgacagggtgtctggagactgcgtcaacacaatttctccgagggaaccatcggaaacccagcgcagcttctcttcctcctgctactctggctccagactcggccccggagtaattgtgtgacgcagttcaccagtaccacccttgttctttcgcgtaccggaagggaaacgcgcctaccttcctaccgtgacgtacgtccgagtacctagtacgttaccgtaaccaacgtacttacgtacgcctacggtacacttacgacgaaccgttgaccgtacgtccgtaccgacggccttacctacgtaacgtttacggtaccggtactacgtcggtaacccacggaccggaccggtacccgtacgttaccggaccctaacccggtacccgaagggttaacccgttagggtttaccaagggtcggaaccggttggggtttacggacggttaacgggaaccttaacggttccgttaaccgtaccgtttaccgtacccggacccgttaacgaccggtaaccgtaacgggtaccggttaaccgtaacccggtagttaacggttacgtttagaccggtttaagtaccgtttactaccggttagtaactcggtaacgtagttacgtacggtccgtaacgttaccggtaaaccggtcttaacccggttggttaacccggaccggtaacggccgttaacggtaccggtaaggtaacccgttaacggtaacccggtatcgggtacgtccgtacgtaccggacttacgtacgttaccttcgtacccg

SEQ ID NO: 181402 - DNA, 789 bp, Homo sapiens
  misc_feature: GYAE6OF01E2XVO.41.6.A06.1.454.CMB.1.raw
tcagtctatactatcacgaccggtgctcgattttagatctactgacagggtgtctggagactgcgtcaacacaactttctccgagggaaccatggaaacccccagcgcagcctttctctttcctcctgctactctggcctcccagatcgccccgagaaattgtgttgacgcagtctccagacacccttgttctttgtcctccgaagggggaaacgacgtccctaccctttccgtcctgacctacggtccagttcaggacttaccttaacccgaaaccgtacttacgttacgccgttaggtacccatacaacgaaacccgtcggacctacggccctccgacggtacccttcctacacttccgttaacgggtcgcctaacgtccgacgtaccggaccgggtaccacgtacggactaccgtacccgaagtacgtacggttcgaacggtcggactaggggtcgggtacgtacgggactacgtcttacacccttcgtacccgaccgttacacggacctaacggtaacccgttaccgggaacccttaggttaagtttacttttacgggatttacggtttagttactttaccgttcgtacgacttacgtaacggttagtagggtttacctacccggttaacgaccccgtttaagtacccccggttaccgggttaacccggaaccgggtaaaccgggaccttaaccgggagttaacggtaaccgttaacgtaaaccggttacgtcggcggttacacccgtaacctaccgtaacgttttcgtaccgtccgtttaaccc

SEQ ID NO: 181403 - DNA, 662 bp, Homo sapiens
  misc_feature: GYAE6OF01B5MQY.41.6.A06.1.454.CMB.1.raw
  modified_base (204)..(204): a, c, t, g, unknown or other
  misc_feature (204)..(204): n is a, c, g, or t
  modified_base (550)..(550): a, c, t, g, unknown or other
  misc_feature (550)..(550): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctccagactcgccccggagaattgtgttgacgcagtctccagactacctgtctttgtctaccgaaggggaaancgcctaccttctcctgcgagtccgagtcgagtacgtccttaaccaacgtacttactacgccgtaggtaccatacgaacgaaaccgtggaccaggcctacccgaggtcctccgtctactcgtacggtcgcaactccgagcgacggtccacgtcgacacgtacccagtaccgtagttcgacggtggacgtagggtacggtccgtagggaactacgtaccttaccgaccgtttacctccgtaaccgttacgacggaccgtagtaccggtaccggtacctaggtaaactttgtttacggaccgttagttcgttaacgttcgtagtacgtagtacgttagtacgtggtacncgtacgacgtctacgtccgtacggacgtacgacgtacgtacgtacggtaacgttaacctacgggtactcgaccggtctaccggactaccggtatttccgttcgtcttacccg

SEQ ID NO: 181404 - DNA, 743 bp, Homo sapiens
  misc_feature: GYAE6OF01EKIFK.41.6.A06.1.454.CMB.1.raw
tcagtctatactatcacgaccggtgctcgatttagatctactgacagggtgtctggagactgcgtcaacacaatttctccgagggaaccatcggaaaccccagcgcagcttctcttcctcctgctactctggctcccagatcgccccggagaattgtgttcgacgcagtctccagacacctgtctttgtctaccgaggggaagacgcctaccttctccgtcgcgtacggtccaagttcagtaacgtccttaaccaacgtactacttacgcctcggtaacctattacaacgaaaccgtgaccgtaggcctccgtaacggccttccgtacacctttacgacggtagaccgactacccgaacgtccgtaacgggtacccaacgttcgggccaacggttcccgaacggtaccgtacggtttaccgaggtctaccggacggttacggtccggtaggaaacgtaccgttaccttaccgtacgtaccgtaaccgtaccgttaccgagggtactaacgaccggtttaccgaacttaacgttaacggtttctttaggacctaggttacgttaactgtaacttggactaacgtagttagtgggtaccgtactaccgtaactcgtttaccgtacccggttaacggaccgaaaacgggtacaacccgggttatacggtaaggttaaccgtaacggtaaacgtcggtaacggctaacgttcccggaacttacggttcctagttaccgtttaacccg

SEQ ID NO: 181405 - DNA, 808 bp, Homo sapiens
  misc_feature: GYAE6OF01DGAO4.41.6.A06.1.454.CMB.1.raw
  modified_base (152)..(152): a, c, t, g, unknown or other
  misc_feature (152)..(152): n is a, c, g, or t
  modified_base (347)..(347): a, c, t, g, unknown or other
  misc_feature (347)..(347): n is a, c, g, or t
  modified_base (367)..(367): a, c, t, g, unknown or other
  misc_feature (367)..(367): n is a, c, g, or t
  modified_base (388)..(388): a, c, t, g, unknown or other
  misc_feature (388)..(388): n is a, c, g, or t
  modified_base (438)..(438): a, c, t, g, unknown or other
  misc_feature (438)..(438): n is a, c, g, or t
tcagtctatactatcacgaccggtgctcgatttagatctactgactagggtgtctggagactgcgtcaacacaattctccgagggaaccatggaaaccccagtcgcagcttctcttcctcctgctactctggctcccgagatcgccccgganaattgtgttgacgctagtctccagacacccgtgttcgtttcgtcctccgaaggggaaacacgtccctaaccgttcctcccgttgaccgtacgggttcccgtaagttaccgaaggtacgttacccttaaacccgaaacggttacccttaacgtttacggcccgttagggtaaccacgtaccgaaacggttaaaccncggtaccaggtccctaccgngtcctactcatcgtacggacncacgtccagccgacggccagtacgccacgtcccgaagtacgtcgttacgnggttcggacgttaggtccgggtactcgggaacgtctaaccgtcgtaacgtccgtaaccgtccgacgacgtaccgtaccgtaacccgttacggtaccctaaggtaacgtttacgttaacgacgttaacgttacgtttaactaccggtagtccgtaagggttcctaacggtttagtacggtaaccgttcctaaccgtaaccggttactacccgttaaccggttaccggaccggtaaacggtaccccgtaacggtaaccggttagggaaaccgttaaaacccgttaacgggtaacgttcggggtaacccgtagtaaaccccggttcctaaaaccctttgtttaaaccccccggtgtttacccggtttaacccg

SEQ ID NO: 181406 - DNA, 511 bp, Homo sapiens
  misc_feature: GYAE6OF02GKS2R.41.6.A06.1.454.CMB.1.raw
  modified_base (202)..(202): a, c, t, g, unknown or other
  misc_feature (202)..(202): n is a, c, g, or t
  modified_base (359)..(359): a, c, t, g, unknown or other
  misc_feature (359)..(359): n is a, c, g, or t
  modified_base (377)..(377): a, c, t, g, unknown or other
  misc_feature (377)..(377): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacngacttcactctcaccgtnagcagactggaccctgaagattttgctagtgttaattactgtcagctagtatggtagctcaccgatcctaccttcggaccaagggacacgactggagtattaaccgaactgtagctgccaccatcgtgtcttac

SEQ ID NO: 181407 - DNA, 507 bp, Homo sapiens
  misc_feature: GYAE6OF02G3OWK.41.6.A06.1.454.CMB.1.raw
  modified_base (201)..(201): a, c, t, g, unknown or other
  misc_feature (201)..(201): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaanagccaccttctcctgcaggtccagtcagagtcttaccaacgactacttagcctggtaccatcagaaacctggccaggctcccaggctcctcatctacggtgcatccagcaggccactggcatcccagacaggttcagtggcagtgggtctgggacagacttcactctcaccgtcagcagactggaccctgaagtattttgctagtgttattactgttcagcagtatggtagctcaccgatcaccttcggccaagggacacgactggagacttaaccgaactgtcggctcgcaccatcttgtcttac

SEQ ID NO: 181408 - DNA, 487 bp, Homo sapiens
  misc_feature: GYAE6OF02GETR8.41.6.A06.1.454.CMB.1.raw
  modified_base (202)..(202): a, c, t, g, unknown or other
  misc_feature (202)..(202): n is a, c, g, or t
  modified_base (374)..(374): a, c, t, g, unknown or other
  misc_feature (374)..(374): n is a, c, g, or t
  modified_base (457)..(457): a, c, t, g, unknown or other
  misc_feature (457)..(457): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcaggccactggcatcccagacaggttcagtgcagtggtctgggacagacttcactctcaccgtnagcagactggaccctgaagtattttgctagtgtattactgtcagtcagtatgtagctcacgatctactcgcgaaggacacgangagataaccgatgtgctgcacatctgtctc

SEQ ID NO: 181409 - DNA, 501 bp, Homo sapiens
  misc_feature: GYAE6OF02G4IUF.41.6.A06.1.454.CMB.1.raw
  modified_base (303)..(303): a, c, t, g, unknown or other
  misc_feature (303)..(303): n is a, c, g, or t
  modified_base (499)..(499): a, c, t, g, unknown or other
  misc_feature (499)..(499): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcagggccactggcatcccagacaggttcagtggcaggtggtctgggacagacttcactctcaccgtcagcagactggaccctgaagattttgctagtgtattactgttcagcagtatggtagctcaccgatcaccttcggccgaaggacacgacgtggagaactaaccgactgtgctgcaccatctgtntc

SEQ ID NO: 181410 - DNA, 508 bp, Homo sapiens
  misc_feature: GYAE6OF02GWXBD.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtggtctgggacagacttcactctcaccgtcagcagactcggaccctgaagtatttgctagtgtattactgtcagcagtatggtagctcgaccgatccaccttcggccaagggaccacgactggagtaacttaaccgacgtgtggctgcaccatctgtcttcg

SEQ ID NO: 181411 - DNA, 507 bp, Homo sapiens
  misc_feature: GYAE6OF02IQYOG.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggtcagtggcagtggtctgggacagacttcactctcaccgtcagcagactcggaccctgaagtatttgctagtgtattactgtcagcagtagtgtagcttcgaccgatcaccgttcggaccgaagggacacgactggagtaacttaaccgactgtgctgcaccatctgtcttac

SEQ ID NO: 181412 - DNA, 496 bp, Homo sapiens
  misc_feature: GYAE6OF02IJI2H.41.6.A06.1.454.CMB.1.raw
  modified_base (202)..(202): a, c, t, g, unknown or other
  misc_feature (202)..(202): n is a, c, g, or t
  modified_base (494)..(494): a, c, t, g, unknown or other
  misc_feature (494)..(494): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaacctggccaggctcccaggctcctcatctacggtgcatccagcagggccactggcatcccagacaggttcagtggcagtggtctgggacagacttcactctcaccgtcagcagactggaccctgaagtatttgctagtgtattactgtcagcagtatggtagctcgacgatcaccttcggccaagggacacgactggagattaaccgagtgtgctgcaccatctgtntc

SEQ ID NO: 181413 - DNA, 564 bp, Homo sapiens
  misc_feature: GYAE6OF02I56UJ.41.6.A06.1.454.CMB.1.raw
  modified_base (213)..(213): a, c, t, g, unknown or other
  misc_feature (213)..(213): n is a, c, g, or t
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttcncctgcaggtccagtcagagtcttaccaacgactacttagcctggtaccatcagaaacctggccaggctcccaggctcctcatctacggngcatccagcagggccactggcatccccagaccaggttcagtgcagtgggtctgggacagacttcactctcaccgtnacgcagactcggaccctggaacgtatttgctagtgttaattactcgttacagcagtatggtagccttcaccgtatccaccgtttcgggaccaaacggggaccaccggtacgtaggtacgtaacgttaacccggtaacgtcggtcggtccgtacgccgtaacccgacttccgttggttaccttaccg

SEQ ID NO: 181414 - DNA, 549 bp, Homo sapiens
  misc_feature: GYAE6OF02JE6ER.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagatcttaccaacgactacttagccttggaccatcaagaaacctggccaggcctcccaggctcctcatctacggtgcactccagcgagggccactggcactcccaagacaggttcagtggcaggtgggtctgggacagacttcactctcaccgtcagcagacgtcgacccgtagaacgtagtttgactacgttagttaattacgttgtacacgactagtagtgtagcctcgaccagtcctaccgttcggacctaaggaccgacgacgtaggagtaacgttaaccgtaacgtgtcgcgttacgcgacctatcgttgtcttac

SEQ ID NO: 181415 - DNA, 597 bp, Homo sapiens
  misc_feature: GYAE6OF02I9821.41.6.A06.1.454.CMB.1.raw
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (230)..(230): a, c, t, g, unknown or other
  misc_feature (230)..(230): n is a, c, g, or t
  modified_base (274)..(274): a, c, t, g, unknown or other
  misc_feature (274)..(274): n is a, c, g, or t
  modified_base (291)..(291): a, c, t, g, unknown or other
  misc_feature (291)..(291): n is a, c, g, or t
  modified_base (350)..(350): a, c, t, g, unknown or other
  misc_feature (350)..(350): n is a, c, g, or t
  modified_base (578)..(578): a, c, t, g, unknown or other
  misc_feature (578)..(578): n is a, c, g, or t
tcagtctatactatcacgaccggtgctcgatttagatctactgacagggtgtctggagactgcgtcaacacaatttctccgagggaaccatggaaacccagcgcagcttctcttcctctgctactctggctccagatgccccggagaaacttgtgttgacgcagtctccagacaccctgtcttttgcctccaggggaaanagcccactttcncctgcaggtccagtcagngttcttaccaagactcttagcctgtaccatcagaactgcaggcnccagctctcatctaggncatccagcagggccacgtggccatcccgagaccaggttccaggtcggcagttcggggtntacgggacagaccgttacacgttccgtcctaccgtagacgacgtacgaccgtacggacccctagaagtacgttttcgactaggtcttaacgttacgttacgtcgagtcgtacgtagtaggtacgtaccgttaccacgtactccgtaccgttacggaccgaagggacctacgacgttacggaacgttaacgtaaacccggtagtacggttacgacgtacgtcaaccgtntaccggttagttccttacg

SEQ ID NO: 181416 - DNA, 536 bp, Homo sapiens
  misc_feature: GYAE6OF02JU742.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccatggcactcccagacaggttcagtggcagtgggtctgggacagacttcactctacgaccgtcagacacgactggaccctgaagtatttgactagtgtattactgtacagcagtagtaggtagtctacgacgtatacgtaccgttcggaccgaaggacacgacgtaggacgtaacgttaaccgtacgtcgtagcgtacgacacctacgtcgtacgtcttac

SEQ ID NO: 181417 - DNA, 539 bp, Homo sapiens
  misc_feature: GYAE6OF02F7AO2.41.6.A06.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagngccaccttctcctgcaggtccagtcagagtcttaccaacgactacttagcctggtaccatcagaaacctggccaggctcccaggctcctcatctacggtgcatccagcagggccactggcatcccagacaggttcagtggcagtggtctgggacagacttcactctcaccgtnacgcagactcggaccctgaagtatttgctagtgttattacgtgtcagctagtagtggtagctcgaccgatcctaccgttcggaccgaaggacacgacgtaggacgtaacgttaaccgacgtcggtacggtcgtacgacctaccgtacgtcgttcgtacttacg

SEQ ID NO: 181418 - DNA, 500 bp, Homo sapiens
  misc_feature: GYAE6OF02F9SKW.41.6.A06.1.454.CMB.1.raw
  modified_base (202)..(202): a, c, t, g, unknown or other
  misc_feature (202)..(202): n is a, c, g, or t
  modified_base (366)..(366): a, c, t, g, unknown or other
  misc_feature (366)..(366): n is a, c, g, or t
  modified_base (373)..(373): a, c, t, g, unknown or other
  misc_feature (373)..(373): n is a, c, g, or t
  modified_base (497)..(497): a, c, t, g, unknown or other
  misc_feature (497)..(497): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcaggccactgcatcccagacaggtcagtggcagtggtctgggacagacttcactcncaccgtnagcagactggaccctgaagtattttgctagtgtattacgtgtcagcagtatgtagttcaccgatcaccttcgccaaggacacgactgacgtagtaaccgaactgtgtctgcaccatctgtcttntac

SEQ ID NO: 181419 - DNA, 504 bp, Homo sapiens
  misc_feature: GYAE6OF02GLQRH.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctccaggctcctcatctacggtgcatccagcagggccactggcatcccagacaggttcagtgcagtggctggacagcttcactctcaccgtcagcagactggaccctgaagtattttgctagtgtattactgtcagctagtatgtagctacaccgatctaccgttcggccaagggacacgacgtggagtacttaaccgactgtcgtcgtcgcaccatctgtcttc

SEQ ID NO: 181420 - DNA, 529 bp, Homo sapiens
  misc_feature: GYAE6OF02HY9CE.41.6.A06.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacacctgtctttgtctccaggggaaangccacttctcctgcaggtccagtcagagtcttaccaacgactacttagcctggtaccatcagaaacctggccaggctccaggctcctcatctacggtncatccagcagggccactgcatccagacaggttcagtgcagtggctggacagacttcgactctcaccgtcagcacgtacgtcgaccctgaagtattttgctagttgtacttactagtcagtcgagtagttggtagtctacgaccgactacgtaccgttacggccgaagggaccacgacgtggacgtacttaaccgaactgtacggctacgcaccgtatcgtcgtacttacg

SEQ ID NO: 181421 - DNA, 570 bp, Homo sapiens
  misc_feature: GYAE6OF02JCO85.41.6.A06.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (302)..(302): a, c, t, g, unknown or other
  misc_feature (302)..(302): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaanagccaccttctcctgcaggtccagtcagagtcttaccaacgactacttagcctggtaccatcagaacctggccaggcctccgaggctccncatctacggtncatccagcaggccagtggcactcccagacaggttcagtgacaggtggtctgggacagtcttcacgtctcacgtcagcagtacctcggaccctagtaagtagttttgacgtagttgttaacttacgtgtacaggctagtagttaggtactacgtaccgaccgtacttaccgtaccttccggacgaagggtaccacgtacgtaggaacgtaacgttaaccgacgtggtaccggtctacggacctaaccgtactcgttcgttaccttaccg

SEQ ID NO: 181422 - DNA, 586 bp, Homo sapiens
  misc_feature: GYAE6OF02IOOIN.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaacctggccaggctcccaggctcctcatctacggtgcatccagcgagggccactggcatcccagacaggttcagtgcaggtgggtctagggacagacttcacttctccaccgtcacgcacgactcggacctgaacgttatttgcgtagtgttattacgtgtacgtagcgtagtagtcgggtacgtcgtaccaccgtactaccgtaccgtttccgggaccgaaacgggtaccaacggtaccgtagggaaccgtaacgtttaaacccggaacgttcggtacggtacgttacgacccgtaccgtactcgttcgtaccttaccg

SEQ ID NO: 181423 - DNA, 538 bp, Homo sapiens
  misc_feature: GYAE6OF02IDNRE.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaacctggccaggctcccaggctcctcatctacggtgcatccagcagggccactggcatcccagacaggttcagtgcagtggtctggacagacttcactctcaccgtcagcagactcggacctagaagtatttgctagtgtattactgtcagcagtatggtagctcacgatccgtaccgttcggaccgaacgggacaccgtacgtaggacgtaacgttaaccgtaacgttcggtcggtacgtcgacctaccgtacgtcgttcgtccttacccg

SEQ ID NO: 181424 - DNA, 576 bp, Homo sapiens
  misc_feature: GYAE6OF02HD54T.41.6.A06.1.454.CMB.1.raw
  modified_base (389)..(389): a, c, t, g, unknown or other
  misc_feature (389)..(389): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggcctcctcatctacggtgccatccagcagggccacgtggccatcccagacaggttcaggtcggcaggtcgggtctagggacagtaccttcactctcgaccgtnacgcacgacgtcggaccctgaagtatttgctagtgtattacgtgttacagtactagtagtggtagtctacgaccgtactacctaccgttacggaccgtaacgggacaccgtacgtagggaacgtaacgttaaccgaagttggtacggtacgtacgacctaccgtacgttccgttcgttaccttaccg

SEQ ID NO: 181425 - DNA, 679 bp, Homo sapiens
  misc_feature: GYAE6OF02JE1EW.41.6.A06.1.454.CMB.1.raw
  modified_base (201)..(201): a, c, t, g, unknown or other
  misc_feature (201)..(201): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgagggaanagccaccttctcctgcaggtccagtcagagtcttaccaacgactacttagcctgtaccatcagaacctggccaggctcccaggcctcctcattcgtacggtgcactccgagcagggcctacgtcggcactcccgaagacgtacggttcaggtcggcgtaggtcggggtctaggggacctaggtactttcgacttcctacgtacccgtcgacgtcgaacgtaccgtacgggtacccgtaggtaacgttagttttcggactacgttacgttacgttaacgttcgttacgtacgtacgtagtacgttaggtacgtaccgtaccgtaaccgtacgttacccgtacccgttaccggaacccggtaacgggaaccgtaacccggtacgttacgggaacggttaaaccggttaaacccgaacggttacggtacggtaccgtacggtaccgtaccgttacgtttccgttaccggtttcctttaccg

SEQ ID NO: 181426 - DNA, 517 bp, Homo sapiens
  misc_feature: GYAE6OF02GK22E.41.6.A06.1.454.CMB.1.raw
  modified_base (375)..(375): a, c, t, g, unknown or other
  misc_feature (375)..(375): n is a, c, g, or t
  modified_base (439)..(439): a, c, t, g, unknown or other
  misc_feature (439)..(439): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctccaggctcctcatctacggtgcatccagcaggccactggcatcccagacaggttcagtggcagtgggtctgggacagacttcactctcaccgtnagcagactcggaccctgaagtatttgcgtagtgtattactgtcagcagtatggtagctcacgtntcctaccttcgcgtaagggacacgactaggaacgtacgttaaccgacgtgtgcgtacgacacctatcgttgtcctacg

SEQ ID NO: 181427 - DNA, 512 bp, Homo sapiens
  misc_feature: GYAE6OF02IVAD6.41.6.A06.1.454.CMB.1.raw
  modified_base (202)..(202): a, c, t, g, unknown or other
  misc_feature (202)..(202): n is a, c, g, or t
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaacctggccaggctcccaggctcctcatctacggtgcatccagcaggggccactggcactcccagacaggttcagtgcagtggtcngggacagacttcactctcacccgtnagcacgactcggacctgaagtatttgctagtgtacttactgtcagctagtagtgtagctcaccgatcaccgttcgaccgaaggacacgacgtaggacgtaacttaaccgactgtagcgtgactacatctgtctac

SEQ ID NO: 181428 - DNA, 625 bp, Homo sapiens
  misc_feature: GYAE6OF02INL1U.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcaagaaacctggccaggcctcccgaggcctcctcatctacggtgcatccagcaggccacgtcggacactacccagacgtacggttcaggtcggactaggtcggggtcgtagggacacgtaccttcaccttcctaccgaccgtcacgacgagaccgtcggacccctaggaagttcgttttgactagttagttacttactgtacagtactagtagttggtacgtcctaccgaccgtactaccgtaccgttaccggaccgtaacgggacctaccggacgttacggacgtaaaccgtttaaacccggacgttcggtacggtccgtacgaccgtaccgttacgttccgttacgttacctttaacccg

SEQ ID NO: 181429 - DNA, 597 bp, Homo sapiens
  misc_feature: GYAE6OF02HZQFB.41.6.A06.1.454.CMB.1.raw
  modified_base (417)..(417): a, c, t, g, unknown or other
  misc_feature (417)..(417): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgaggggaaagagccaccttctcctgcaggtccagtcagagtcttaccaacgactacttagcctggtaccatcagaaacctggccaggctccaggctcctcatctacggtgcactccgagcacgggccacgtcggacactcccagacgtaggttcaggtcggcaggtgggtctgggacagtacttcactcctcgacgtcagcacgtacgtcggaccctagaagtntttagctagttgttattacgtgtcgagatagtagtggtacgtctcaccgtactaccgtaccgttccggacgtaaacgggaccacggtaccgtagggtaacgtaacgttaaacccggtaacggttcggttacggccgttacggaccgtaaccgtacgtttcgttacggttaccctttaccg

SEQ ID NO: 181430 - DNA, 680 bp, Homo sapiens
  misc_feature: GYAE6OF02H2FTG.41.6.A06.1.454.CMB.1.raw
  modified_base (200)..(200): a, c, t, g, unknown or other
  misc_feature (200)..(200): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgctcgaggggaanagcctaccttctcctgcaggtccagtcagagtcttaccaacgactacttagcctggtaccatcacgaacctggcaggcctccgaggcctcctnatcgtacgtncactccagcaggccatggcatcccagacaggttcagtcggnaggtggtctagggactaggtccttcacttccgtacgaccgtcagtacgacgtcgtacggaccctaggaagttcgtttcgactaggttcgttaacgtttaccgtgtacacggtactaaggttaagtcgggttacgtacctccgtaacccgggtactacccgttaaccgtttcccggggaaactaaaaccgggggtacctacccgggtaacggttaccggggtaaaccttaaccggtttaaaaccccgggttaacgtaccggggtttacgggtacccgtcggtaaaccccgtacccgttaacggttttcccgtttaccggtttaccgtttaaccccgg

SEQ ID NO: 181431 - DNA, 525 bp, Homo sapiens
  misc_feature: GYAE6OF02GASDQ.41.6.A06.1.454.CMB.1.raw
  modified_base (387)..(387): a, c, t, g, unknown or other
  misc_feature (387)..(387): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (453)..(453): a, c, t, g, unknown or other
  misc_feature (453)..(453): n is a, c, g, or t
  modified_base (515)..(515): a, c, t, g, unknown or other
  misc_feature (515)..(515): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcacggtccagtcagagtcttaccaacgactacttagcctggtaccatcagaaacctggccaggcctccaggctcctcatctacggtgcatccgagcgacggccacgtggccacgtcccagacctaggttcagtggctaggtggtcgtggacagtactcactctcaccgtnagcagcgtgacctagtagtatttgctagtgttattacngttcagctagtagtgtacnctcaccgtntcctaccgttcgacgaagggacctagacgtggacgtaacgtaccgatggcgtcacgcacgtntctgtcctac

SEQ ID NO: 181432 - DNA, 507 bp, Homo sapiens
  misc_feature: GYAE6OF02F6VLS.41.6.A06.1.454.CMB.1.raw
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactactagcctggtaccatcagaaacctggccaggctcccaggctcctcatctacggtgcatccagcagggccactggcactcccagacaggttcagtggcaggtggtctgggacagacttcactctcaccgtcagcagactgaccctgaagtatttgctagtgttattactgtcagctagtatggtagctcacgatctaccgttcgacgaaggacacgacgtaggacgtacttaaccgacgtgtgctagccaccatctgtctc

SEQ ID NO: 181433 - DNA, 570 bp, Homo sapiens
  misc_feature: GYAE6OF02FVWNT.41.6.A06.1.454.CMB.1.raw
  modified_base (297)..(297): a, c, t, g, unknown or other
  misc_feature (297)..(297): n is a, c, g, or t
  modified_base (335)..(335): a, c, t, g, unknown or other
  misc_feature (335)..(335): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgaggggaaagagccaccttctcctgcaggtccagtcagagtcttaccaacgctacttagcctggtaccatcagaacctgccaggctccagctcctcatctacgngcatccgagcagggcccagtggctactcccgagtaccnggttcaggtgctaggtcggtctgggacagtacttcacttcctcgaccgtcagctagacgtcggacctgagtagtttgactagtcgtagttactgtcgagtcgagttacgtaggtacgtcgtccgaaccgttactacgttacccgttcggaccggtaagggacctacggacgtcggaacgtacttaaaccggacttcggtgtaccgtcgccgtacctacgtcttacggtcttaccg

SEQ ID NO: 181434 - DNA, 627 bp, Homo sapiens
  misc_feature: GYAE6OF02GGHZL.41.6.A06.1.454.CMB.1.raw
  modified_base (201)..(201): a, c, t, g, unknown or other
  misc_feature (201)..(201): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctcaggggaaanagccacttctcctgcaggtccagtcagagtcttaccaacgactacttagcctggtaccatcagaaacctggccaggctcccaggcctcctcatctacggtgcatcccagccgacgggcccacgtcggacactccccgagtaacctacgggtttcagttcggggcctagggttcggggtctaggggaactacggtacctttcaccttcctaccgacccgttcgagcctaaggaccgttacgggtacccctggtaaacgttagttttcggactaggttcgttattacgtgtacagtctaggttagtcggtacgtcctaccgacgtactacccgtacgttaccgaccgaagggaccaccggtactagggacgtaacgtaaccgacgttggacggtcgtcgaccgtacgtacgttcgttgttaccttacg

SEQ ID NO: 181435 - DNA, 746 bp, Homo sapiens
  misc_feature: GYAE6OF02JJOMS.41.6.A06.1.454.CMB.1.raw
  modified_base (202)..(202): a, c, t, g, unknown or other
  misc_feature (202)..(202): n is a, c, g, or t
  modified_base (303)..(303): a, c, t, g, unknown or other
  misc_feature (303)..(303): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccgagggaaanagccaccttctcctgcaggtccagtcagagtcttaccaacgactacttagcctggtaccatcagaactggccaggctcccaggcctcctcactctacggtncactccagccgagggcccacgtcggacctacgtccccaaggaacctagggtttccaaggttcgggacctaaggttcggggtctaggggacctaacggtaccgttttccgaaccgttcccgtaccgtaacccgttcaacggtccgtaaacggtacccgtacggggtaaacccccttagggtaaaaccggttacgtttttacggaccgtaacggtttcgtttaaactttacgtacgttacgaacggtaccgttaagtaacgttgggtaacgtcccttacgtaaccgtacttaccgtaacccgtttcggaccgtaaacgggaccgtaacccggttacgttacgggaacggttaaaccgtttaaacccggtaacgttccggttaacgggtaccttaccgggtacccaacccgtacgttttcccggtttacggttacctttaacccgg

SEQ ID NO: 181436 - DNA, 699 bp, Homo sapiens
  misc_feature: GYAE6OF02JIHZJ.41.6.A06.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
tcagtctatactatcacgaccggtgctcgatttagatctactgacagggtgtctggagactgcgtcaacacaatttctccgagggaaccatggaaacccagcgcagcttctcttcctcctgctactctggctcccagatcgccccggagaaattgtgttgacgcagtctccagacaccctgtctttgtctccgaaggggaaanacgccacctttcncctgcagtacgtccagtcagtacgtcttaaccaacgactacttacgcctaggtaccatacaagaaacctcggccaggctcccaggtcctcctcacttccgtacggtctcaactcccgaagccgaacgggcccaagtcggaccactccccgaagtacgaacggtttacagggtcgtcgtaagggttcgggttccgtaggggaacctaggtacccttttcgaacgttacccgtccgaaacccgttcaacggacgtaacgtaccccggttacgggtaacccgtagtaaaccggttagttttcgacgttaacgggtttatttaaaccgttactttaacggcgtaagacgtaagttacgtaggttacacgttacgaccgtacttaccgtccgttacgaaccgaaggtaccacgtacgtaggaaacttacgttaaaccgagttgggtaccgtacgttaccgccgtaaacgttcgttaccgtagtttccg

SEQ ID NO: 181437 - DNA, 706 bp, Homo sapiens
  misc_feature: GYAE6OF02JAOKP.41.6.A06.1.454.CMB.1.raw
  modified_base (200)..(200): a, c, t, g, unknown or other
  misc_feature (200)..(200): n is a, c, g, or t
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (297)..(297): a, c, t, g, unknown or other
  misc_feature (297)..(297): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccagggaanagccacttcncctgcaggtccagtcagngtctacaacgactacttagcctgtaccatcaagaacctgccaggcctccaggctcctcactctacggtncatccagcgacggccacgtggaccagtccccgaagtaccgtaggttccaaggttcggaccgagggttccggggtcgtacggggaaccgtaggtaaccctttcgaacccgttccgttacccaaccggtttacgaaccggaccgtaacggtaacccggttacgggtaaccccgttagggtaaacgttacgtttttacggacgttaacggttacgtttaacgtttacgttacgtacgtacgtacctaaggttacgttacggttacgtaccgtaccgtaaccgtaaccttccgacccgtttaccgggaccgtaaacgggacctacggtacgtacgggtaacgtaacgtttaaaccgacgttaggtaccggtctaccggactaaccgtacgttaccgtacgttaccgttacccg

SEQ ID NO: 181438 - DNA, 559 bp, Homo sapiens
  misc_feature: GYAE6OF02H2HE0.41.6.A06.1.454.CMB.1.raw
  modified_base (303)..(303): a, c, t, g, unknown or other
  misc_feature (303)..(303): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtncatccagcaggccactggcatcccagacaggttcagtgcaggtggctgggacagacttcactctcaccgtcagcagactcggaccctgaagtatttgctaggtagttattacttgtacagctagtagtggtacgtcgtacgaccgactaccgtaccgtttaccggaccgtaacgggactaaccggtacgtacggaaggtaacttaaccggtacgtggtacgtacgtcgacgaacccgtatccgttgttccttaccg

SEQ ID NO: 181439 - DNA, 543 bp, Homo sapiens
  misc_feature: GYAE6OF02GTO9X.41.6.A06.1.454.CMB.1.raw
  modified_base (303)..(303): a, c, t, g, unknown or other
  misc_feature (303)..(303): n is a, c, g, or t
  modified_base (409)..(409): a, c, t, g, unknown or other
  misc_feature (409)..(409): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtnccatccagcagggccacgtggcatcccagaccaggttcaggtcggctaggtgggtctgggacaggtaccttcactctcaccgtcagcagactcggaccctgaagtntttgctagtgtattactgtcagcagtagtggtacgcctcgaccgtatcctaccgttcggaccgaagggaccacgacgtaggaagtaacgtaaccgtacgtggtacggacgtcgaccacctactcgtcgtcttac

SEQ ID NO: 181440 - DNA, 546 bp, Homo sapiens
  misc_feature: GYAE6OF02GS6MP.41.6.A06.1.454.CMB.1.raw
  modified_base (202)..(202): a, c, t, g, unknown or other
  misc_feature (202)..(202): n is a, c, g, or t
  modified_base (414)..(414): a, c, t, g, unknown or other
  misc_feature (414)..(414): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaacctggccaggctcccaggctcctcatcgtacggtgcatccagcacgggccactggcatcccagaccaggttcaggtgcaggtgggtctgggacagacttcactctccaccgtcacgcacgactcggaccctgaatatttgctagtnttattacgtgtcagcagttagtggtagctacaccgtactcctaccgttccggaccgaagggacctacgactggacgtaacgttaaccgtaacgtggtacgccgtacggctacctagttcttacgttcttacc

SEQ ID NO: 181441 - DNA, 556 bp, Homo sapiens
  misc_feature: GYAE6OF02FXB0C.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaacctggccaggctccaggctcctcatctacggtgcatccagcagggccacgtggcatcccagacaggttcaggtggcaggtcgggtctgggacagtactttcactctccaccgtcagcagactcggaccctgaacgtatttgctagtagttattacgtgtcagctagtagtggtacgtctcgaccgtactccgtaccgttacggaccgaagggaccacgtacgtaggaacgtaacgtaaccgtaacgtaggtcggtctacggactaccgtactcgttacgttcttaccg

SEQ ID NO: 181442 - DNA, 577 bp, Homo sapiens
  misc_feature: GYAE6OF02HXK2E.41.6.A06.1.454.CMB.1.raw
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccagggaangccaccttctcctgcaggtccagtcagagtcttaccaacgactacttagcctggtaccatcagaaacctggccaggctccaggctcctcatctacggtncatccagccagggcccacgtggcatcccagacaggttcagtggcaggtggtctaggacagtacttcactctcaccgtcagcagactcggacctagagtattttgctagtagttattactgtacagctagtagtggtagctaccaccgtatacctaccgttaccggaccgtaaacgggacaaccggtactacgggtaacgtaaacgttaaacccgtaacgttcggttacggaccgttaggacccgtaacccgtaacgttccgttacgttctttaacccg

SEQ ID NO: 181443 - DNA, 547 bp, Homo sapiens
  misc_feature: GYAE6OF02FOGYB.41.6.A06.1.454.CMB.1.raw
  modified_base (202)..(202): a, c, t, g, unknown or other
  misc_feature (202)..(202): n is a, c, g, or t
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggcctcccaggctccncatctacggngcatccagcagggccactggcatcccagacaggttcagtgcagtggtcgtggacagacttcactctcaccgtcagcagacgtcgaccctagtaagtattttgctagtgtattactgtacacgctagtattaggtagtctcaccgtatacctaccgttcggaccgaacggaccacgacgtaggaacgtaacttaaaccgtaacgtcggtacggtcgtcgaccgtaccgtagttcgtgttcttacc

SEQ ID NO: 181444 - DNA, 589 bp, Homo sapiens
  misc_feature: GYAE6OF02IGAI0.41.6.A06.1.454.CMB.1.raw
  modified_base (201)..(201): a, c, t, g, unknown or other
  misc_feature (201)..(201): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (421)..(421): a, c, t, g, unknown or other
  misc_feature (421)..(421): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctccagatgccccggagaaattgtgttgacgcagtctccagacaccctgtctttgtctccgaggggaaanagccaccttctcctgcaggtccagtcagagtctaccaacgactacttagcctggtaccatcaagaacctggccaggctcccaggctcctnatctacggtncatccagcgagggccacgtggacactccccaagacgtaggttcagtggactaggtcgggtcgtagggacagtaccttcacgtcctacgaccgtcacgcagacctcggaccctagaagttntttgactagttgttacttacgtgtacagctaggtatggtgtacctaccgtaccgtatacctaccgttccggaccgaacgggaccaacgtacgtagggaacgtaacgtttaaccggaacgttcggtcgaccgttcgaccctaaccgttattcgttacgttcccgttacc

SEQ ID NO: 181445 - DNA, 701 bp, Homo sapiens
  misc_feature: GYAE6OF02JYRJM.41.6.A06.1.454.CMB.1.raw
  modified_base (299)..(299): a, c, t, g, unknown or other
  misc_feature (299)..(299): n is a, c, g, or t
tcagtctatactatcacgaccggtgctcgatttagatctactgacagggtgtctggagactgcgtcaacacaatttctccgaggaaccatggaacccagcgcagcttctcttcctcctgctactctgctccagatgcccccggagaattgtgttgacgcagtctcagacaccctgtcttgtctccgaggggaaatcgccaccttctcctgcaggtccagtcagagttccttaccgaacgtactaccttagcctggtaaccactcaagaacctcggcctacggctccgaggcctcctacnctctacggtgaccatccagccgacgggtccagttcgcgtactccccgaggtaccagggtttccaggtccggtcgtacgggttacgggtacggtacgggaccgtaggttaacctccgtaaccgttccgttaccgacccgttacgacgaccgtacgtacgtacggaccctaggtaacgtacgttttacgaccgttaggtacgttaacgtttcgtacgttacgacgtacgttaggtaacgttagggtaccgtccttaccgtcccgtaagttcccgtaaccgttaccgggtaaccgtacgggaacctcggtacccggtaggtaaccgtaacgttaaacccggtacggtaacggtccgttaacggtaccgtacggtaaccctagttaccttacgttaccgttacccg

SEQ ID NO: 181446 - DNA, 530 bp, Homo sapiens
  misc_feature: GYAE6OF02FG4UQ.41.6.A06.1.454.CMB.1.raw
  modified_base (202)..(202): a, c, t, g, unknown or other
  misc_feature (202)..(202): n is a, c, g, or t
  modified_base (443)..(443): a, c, t, g, unknown or other
  misc_feature (443)..(443): n is a, c, g, or t
  modified_base (482)..(482): a, c, t, g, unknown or other
  misc_feature (482)..(482): n is a, c, g, or t
  modified_base (525)..(525): a, c, t, g, unknown or other
  misc_feature (525)..(525): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaaanagccaccttctcctgcaggtccagtcagagtcttaccaacgactacttagcctggtaccatcagaaacctggccaggctcccaggctcctcatctacggtgcatccagcagggccagtggcactcccagacaggttcagtggcaggtcgggttctgggacacggactttcgacttctcaccgtcagcagactggaccctgaagtattttgctagtgtattactgtcagctagtatggtacnctcgacgctactaccgttcgaccgaagggaccagtacgnggagaacgttaaccgacgtcgtagtacgtcgccgacctatctntcttc

SEQ ID NO: 181447 - DNA, 727 bp, Homo sapiens
  misc_feature: GYAE6OF02JM51Z.41.6.A06.1.454.CMB.1.raw
  modified_base (199)..(199): a, c, t, g, unknown or other
  misc_feature (199)..(199): n is a, c, g, or t
  modified_base (532)..(532): a, c, t, g, unknown or other
  misc_feature (532)..(532): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctccagatcgccccggagaaattgtgttgacgcagtctccagacacctgtctttgctccgagggaaanagcctaccttctcctgcaggtccagtcagtacgtcttaccgaacgtactacgttacgcctacggtaaccacttacgaacgaaaccttcggaccgaacgggtcctacccgacggtccttaccgtactacgtccgttacggtacgactaccgtacctacggacgtaccggggtaccacggtacggacccgtaactcccgaacgtaaccgaacggtttcgaacggttcggaccgtgggttacgggtactcggggaacacggtaacctttacgacctccgttaaccgcgttacgacgtacgtacgtaccgtacggacccgtaagtacgttacgtttnacgtacgttacttattcgtcgtcgtacgactgggtactacgggtacgtccgtaaccgtaccgtacgtcccgttaaccggttcccgggtaaccgaagggtaccgtaacggtacgttaacggtaacgtaaccgttaaccgacgttacggtcgtacggacgtacctaaccgtaggttccttagtttacccggttaccg

SEQ ID NO: 181448 - DNA, 520 bp, Homo sapiens
  misc_feature: GYAE6OF02G53AL.41.6.A06.1.454.CMB.1.raw
  modified_base (212)..(212): a, c, t, g, unknown or other
  misc_feature (212)..(212): n is a, c, g, or t
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
  modified_base (311)..(312): a, c, t, g, unknown or other
  misc_feature (311)..(312): n is a, c, g, or t
  modified_base (315)..(316): a, c, t, g, unknown or other
  misc_feature (315)..(316): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (351)..(351): a, c, t, g, unknown or other
  misc_feature (351)..(351): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagacaccctgtctttgtctccaggggaagagccaccttcncctgcaggtccagtcagagtcttaccaacgactacttagcctggtaccatcagaaacctgccagcctccagctcctnatctacgngcatcagcaggccnngcnncccgagacagtcagngcngtggntggacanacttnacnctcacgtnagcagactgacctggatatttganaggtntacgttacngtcagctagtagtggtatctacaccgatcctaccgttcggacgaacgggcaaccggactaggaacgtaagtaaccggtaactcggtagtcgtacgacctacgacttcggttactcttacc

SEQ ID NO: 181449 - DNA, 661 bp, Homo sapiens
  misc_feature: GYAE6OF02G219Z.41.6.A06.1.454.CMB.1.raw
  modified_base (202)..(202): a, c, t, g, unknown or other
  misc_feature (202)..(202): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatcgcccccggagaattgtgttgacgcagtctccagacaccctgtctttgtctcgagggaaagngccaccttctcctgcaggtccagtcagagtcttaccgaacgactactagcctggtaccatcaagaacctggccaggcctcccaggcctctcatctacggtgcatccagccacgggccacgtggacactcccagactagttcaggtcgacgtaggtgggtctagggactacggtacttccgactccgtaccgaccgtcgacgcacgtacgtaccggaacccgtaggtaaagtcttttggacgttaggtagtttaagttacgttcgtacgtacgtacgtacgttagtcggttacgaccgttaccgtaaccgtacgtacccttaaccgttaccgggtaccgaaacgggtacccgacgtaccggttacggtaacggtaaaccgtttaaaccgggtaacgttcgggttaacggtccgttacggaccctaaccgttaaccgttacgttacggttacctttacccg

SEQ ID NO: 181450 - DNA, 837 bp, Homo sapiens
  misc_feature: GYAE6OF02JGL72.41.6.A06.1.454.CMB.1.raw
  modified_base (308)..(308): a, c, t, g, unknown or other
  misc_feature (308)..(308): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgccccggagaaattgtagttgacgcagtctccagaccacctgtctttgtctccgagggaagagcctaccgttctctgctaggtccagtcagacgtcttaaccaacgtactacttacgcctggtacactcaacgtaaaccgtggaccacggctacccgaggccttaccnctactccgtacgggtcacatcccaggtccgacgggcctaacgtggaccatcccaagactagggttcaaggtgaccgtaggtcgggtacgtgggaacctacggtacctttacgacccttcgtaccctaaccgggtacaacgggtaccgaagttaacccgtacgggaaacccccgtttaggtaaaaacgtttaccgtttttcggaacccggtttaaacggtttaacgtttaaccgtttaaaacgttccgggttaaacccgttaacggaaccgttaaagggtttaacgggtttacggggaaaccccttaccgtaacccggtaaacccgggtaaacctttcccggtaaacccgggttttaacccgggaaaccccgggttaaaaaggggtacccccgttaaaagggacccggttaaacgggggttaaccgtaaaacccgttttaaacccggggtaaacgttcccgggttaaacggttccgttaccggtaaaccctacccgttaacgttttcggttaccggtaaccgtttaaccc

SEQ ID NO: 181451 - DNA, 705 bp, Homo sapiens
  misc_feature: GYAE6OF02HKF39.41.6.A06.1.454.CMB.1.raw
  modified_base (461)..(461): a, c, t, g, unknown or other
  misc_feature (461)..(461): n is a, c, g, or t
  modified_base (564)..(564): a, c, t, g, unknown or other
  misc_feature (564)..(564): n is a, c, g, or t
  modified_base (573)..(573): a, c, t, g, unknown or other
  misc_feature (573)..(573): n is a, c, g, or t
  modified_base (610)..(610): a, c, t, g, unknown or other
  misc_feature (610)..(610): n is a, c, g, or t
  modified_base (643)..(643): a, c, t, g, unknown or other
  misc_feature (643)..(643): n is a, c, g, or t
  modified_base (688)..(688): a, c, t, g, unknown or other
  misc_feature (688)..(688): n is a, c, g, or t
tcagtctatactatcacgaccggtgctcgatttagatctactgacagggtgtctggagactgcgtcaacacaatttctccgagggaaccatcggaaacccagcgcagcttctcttcctcctgctactctggcctcccagatcggccccggagtaaattggtgttcgacgcagttctccagaccacccttggttctttcgtcgtaccggaaggggaaagacgtccctaccttccgtcccgtggacgtacgggtacctagtacgtaacgtacgttaccttaaacccaaaccgtacttaaccgtttaacgcccgttacggtaacctattaaccgaaaacggtaaacccgtacgggaccaacgggtccctcccgtacggtacctccttacgtacgttccgtaacggtcgactacgtcccacggccggacggcccaggtcgaccactccgaagaccgtagttacgnggtagggtcctagggtcggtagacgggtacacggttactctaccgtctaccgccgtacgacgtacacgtaactcgacgtagtaagttcgtttggagttagttntacgttacnggtacgaatcgtagttaggtctacgcttacgccttanaccgttcgttccggaacggacgtagcgttacgnggtaacttaacgacggttgtacggtacgcgacgtcctaaccggtnttcctacgttgtaaccc

SEQ ID NO: 181452 - DNA, 810 bp, Homo sapiens
  misc_feature: GYAE6OF02I2FRZ.41.6.A06.1.454.CMB.1.raw
  modified_base (204)..(204): a, c, t, g, unknown or other
  misc_feature (204)..(204): n is a, c, g, or t
  modified_base (390)..(390): a, c, t, g, unknown or other
  misc_feature (390)..(390): n is a, c, g, or t
  modified_base (775)..(775): a, c, t, g, unknown or other
  misc_feature (775)..(775): n is a, c, g, or t
tcagtctatactatcacgaccggtgctcgatttagatctactgacagggtgtctggagactgcgtcaacacaatttctccgagggaaccatggaaacccagcgcagcttctcttcctcctgctactctggctccagatcgccccggagtaaattgtgtgacgcagtcctccagacaccctgttctttgtctccgaggggaaagngaccctaccttctccgtagacgacggttaccgacgttcgagtaacgttaccttaaccaaacggtaccttaacgtttacggccgttacggtaaccctaacttaccgaaaccgtaaaaccgtcggaccctaacgggtcccttacccccgagggtcccttaccctaccgtacttccgttaacggggtcncctaaacgtcccgacggacgaacgggcccctaagttaccgctaaccgtcccaaggtaccgtacgggtttaccggagttacggggaccgttaagggttccggggttaccggtacggggaacctaacgttacccgtttaactacccgttctacccggttaacccggcgtaacggcgtaacgtaccgtacggtacccgtagtaaacggtacgtttcgacgttacgtacggtttacttacgttacgtcggtaacgtaccgttagttacgggttcggttaactcccggtaccgaaccgtaccttaccgttaccgaccggtaccggaaagggtacccgtacggtaccgtaggtaaccgtaacgtaaaccggtcgtacggttacgcggtacncccgttaaccgcgtttaggttccgtacgttacccg

SEQ ID NO: 181453 - DNA, 688 bp, Homo sapiens
  misc_feature: GYAE6OF02IRZTU.41.6.A06.1.454.CMB.1.raw
  modified_base (205)..(205): a, c, t, g, unknown or other
  misc_feature (205)..(205): n is a, c, g, or t
  modified_base (420)..(420): a, c, t, g, unknown or other
  misc_feature (420)..(420): n is a, c, g, or t
  modified_base (458)..(458): a, c, t, g, unknown or other
  misc_feature (458)..(458): n is a, c, g, or t
  modified_base (534)..(534): a, c, t, g, unknown or other
  misc_feature (534)..(534): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagaccaccctgtctttcgtctccgaggggaaanacgccaccttctcctgcacggtccagtcagacgttcttaccaacgactacttagcctgtacagtccaagaacctggacctacggcctaccccgaggccttcctactacttccgtacgggtcaccgtacgtccgaggtccgacggggtcctacgtcggacacttccccgaagtaacgtacggtttacgacggtcggcgtacgggtcgggttaccgngggtactacgtacgttacaccgttctaccgacccgttnacggtactacgacttcggaacccgtaggtaagtttctttacggacgttagttacgtttaacttacggtcgttacgngttacgtagtacgttcgggactccgtacctaccgtattcccgtaccggttccggaacgaaaccgggtactaacgggttcgacggtaacgttaacgtaaccggtacggttggacgtcctcggtaactaccgtactttccggttacttacctaccg

SEQ ID NO: 181454 - DNA, 776 bp, Homo sapiens
  misc_feature: GYAE6OF02FFMZB.41.6.A06.1.454.CMB.1.raw
  modified_base (204)..(204): a, c, t, g, unknown or other
  misc_feature (204)..(204): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctaggctcccagatcgccccggagaattgtgttgacgcagtctccagacctaccctgtacttgtctccgaggggaanagccaccttctcctgcacggtccagtcagacgttaccttaccaacggtacttacttacggacccgttaggtaacctagttaccgaacggtaaaccttcggggaccctacgggtccctaccccgaagggtcccttaccgtacctaacttccgttaaccgggtctaccacttcccgaagcgtacggggtaccacgtcggacctacgtacccgaggtacctacgggtttccaaggttcggtacgtagggttacgggttaccgtaggggtaacctacgggtacccttttacgggaacccttttcggaacccgtaaccggtaccgaacggtaccgtaacgtaaccggttccgggtaaaccctgggttaaacgttacgttttacgaaccgtaggttacgttaagttaaccgtgtacgtacgtcgtaaggtcgtaggtaccgctaccgaccgtacgttacctaccgggttaccaccggtaacgtccgaaaggttccgaagggtacgttaaaccgtaccgtaaacgttcggttacgaccgttacggaccctaactacgttccgttacggtaccttacccg

SEQ ID NO: 181455 - DNA, 702 bp, Homo sapiens
  misc_feature: GYAE6OF02FUQQP.41.6.A06.1.454.CMB.1.raw
  modified_base (203)..(203): a, c, t, g, unknown or other
  misc_feature (203)..(203): n is a, c, g, or t
  modified_base (306)..(306): a, c, t, g, unknown or other
  misc_feature (306)..(306): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggctcccagatgcccccggagaaattgtgttgacgcagtctccagaccaccctgtctttgtctccgagggaaangccaccttctcctgcaggtccagtcagacgttctaccaacgactacttagcctgaccatcagaacctggccagtctcccaggtcctccgtcactcgtacggtnccactaccagcgacggccacgtggcctactccccagacctaggttaccgaggttcggaccgtagggttcgggtacgtacgggactacggtaccgttcctaccgttaccgtaccgtacccgtcacgtaccgtacggtaccgtaccgggtaaccccgtaggtaaacggtttacgttttacgaccggtacgtttagttaaccgtttacgtcgttacgtagtaccttaaggtacgtttaggtaccgtccgttaaccggtacccgtaacttacccgtacccggtttcggaacccgtaaacgggttacccacgtacggtaggtaaccggtaacgtttaacccgtaccggttcggtacggtaccgtacgtcctaaccgtactccgtttaccgtcctttacccg

SEQ ID NO: 181456 - DNA, 725 bp, Homo sapiens
  misc_feature: GYAE6OF02JHWGI.41.6.A06.1.454.CMB.1.raw
  modified_base (149)..(149): a, c, t, g, unknown or other
  misc_feature (149)..(149): n is a, c, g, or t
  modified_base (222)..(222): a, c, t, g, unknown or other
  misc_feature (222)..(222): n is a, c, g, or t
tcagtctatactatcacgaccggtgctcgatttagatctactgacagggtgtctggagactgcgtcaacacaatttctccgagggaaccatagaaaccccagcgcagcttctcttcctcctgctactctggctccagatcgccccgganaattgtgtcgacgcagtccacagacctacctgttactttcgtctaccgaaggggaacacgccctacctttccnccttgaccgtacggtcctagttcaagttacgttacctaaccgaacgtaccttacttacgcctagtaaccataccaacaacgtcggctacgcctaccgtgccttccgactacgtaccgttacggtacaccttacacccgtaagccggtaaccggcctacgtggaccacccgttacgaacggtacgttaacggttccaaggtccggtagtacgggttggttaccgagggtaaccgacgttacgttccaaaccttccgaaccggtcctacgtacgtacgtacgtacgtacgtaacccgtagtaaccgttgttacgtcgtagttacgttacttaacgtccgtagtaccgtacgtagtacgtacgttacgtaccgtactaacgacgtaccgttaccgtacgaaccggaacgtaccgtaaggtacgtacgaacgttaaccggttaaccgaagtacccggttacgtactcggtacctaaaccgttccgtacgtttaccgtacgttaccgg

SEQ ID NO: 181457 - DNA, 680 bp, Homo sapiens
  misc_feature: GYAE6OF02FQBSP.41.6.A06.1.454.CMB.1.raw
  modified_base (567)..(567): a, c, t, g, unknown or other
  misc_feature (567)..(567): n is a, c, g, or t
tcagtctatactatcacgaccggtgctcgatttagatctactgacagggtgtctggagactgcgtcaacacaatttctccgagggaaccatggaaaccccagcgcagcttctcttcctcctgctactctggcctcccagatgcccccggagaaattgtgttgacgcagtctccagacaccctgtctttgtctccagggaagacgcctacttctcctgcagtccagtccagacgtccttaccaacgacttactagtccctacggtaccatcaacgaaaccgttcggccgacggtcctaccgcggtactcccttcaactcgttaacggtcgacactaccgtacgcgacgggaccctacgtcggaccgtactacccgaaggtacctagggttccgtaacggtcggtacggtagggttaccggggttacgtcgggtaaactacggtccttaccgaccgttcctaccgtaccgtcgacgtaccgacgtaccgtaccggaaccgtacggtaagtttacgtttcgacgttaagtcgttaacttacgttgtcacggtctaagttggtagtccgtntacccgtacgtacgttaccgtacgtccgtacggaaccgacggtcgacctagggacgttaaacgttaaccggagtccgtaggacttccggcactacggttcttactcgttaccg

SEQ ID NO: 181458 - DNA, 902 bp, Homo sapiens
  misc_feature: GYAE6OF02JMV8Z.41.6.A06.1.454.CMB.1.raw
tcagtctatactatcacgaccggtgctcgatttagatctactgacagggtgtctggagactgcgtcaacacaatttctccgagggaaccataggaaaccccagcgcagcttctcttcctcctgctactctggcctcccagatcgcccccggagtaattgtgttgacgcagtctccagaccaccctgttctttcgtcctccgaaggggaaagacgaccctacctttcctccgtcgaccgtaggtacccgtagtccgaagtacgttacccttaacccgaaaccgtaacttaaccttacgaccgttcggtaaccacttacgaacgtaaaccgtcggacccgaacgggtccctacccgacggtacccttcccgtacctaacgtttacccgtaaccgggtcgacctaaccgtacccgaacggtcccggtaaccgggaccctacgttaccggacctaacccgttaccccgaaaggtaaccgtaaccgggtttacggaacggtaccgggaccggtaacggggtcggggttaccggtacggggaaactaccggttaaccgtttccaaacccgtttccggtaaccgtacccggtagacgtaccgtacgtaccggtaccggtacccgtagttaaagttacgtttcgaacgtacgttaacgttacgtacgttacggtaacgtacgtaccgtaggttaaggtacgggttaccgtaacccgttacggtaaacccgttaccggtaacccgttacccggttaccgggaaaacccggtaaacgggtacccgtaaaccgggtacggttaccggtaaaaccggttaaccccggtttaaaccgtaacggttcggttacccgggtacccgttaccggtacccgtaacgtttaaccgtcggtttacccgttaacgttccccgg

SEQ ID NO: 181459 - DNA, 706 bp, Homo sapiens
  misc_feature: GYAE6OF01DKIE8.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacgaagggcttggagtggatggcagtggatcagtccttaaaccatggtatcacagactatgcacaggaattccgagggcagacgtcaccgttgaccacaacgacaacactcccaacgacgacaacacgaccctaacacgttacgggacccttggaacgggacgtacccgttaggaacgtacgttaccgttacgggaaccggaaccgaacccggggtacccgttaacgttaacgttttaacccgttagggttaccgggtacgggaaacgggttaaacgggttacgggttaaacttttaaacggttaccgggttacccgtttttaaaccccgggtttccccggggtttaaaccggttaacccccggttttaaccccccgggttaaccccccggtttttccgggggtttttttaaccccccgg

SEQ ID NO: 181460 - DNA, 559 bp, Homo sapiens
  misc_feature: GYAE6OF01BHI1V.25.7.A07.1.454.CMB.1.raw
  modified_base (428)..(428): a, c, t, g, unknown or other
  misc_feature (428)..(428): n is a, c, g, or t
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttgagtggatggcagtggatcagccttaacagtggtatcacagactatgcacgaggaattccgagggcagagtcacttgaccacagacacactccacgacgacacacgcctacacgtcggacctaggacggacnccgtagagtactcgtagaccgacgaccggccgttagttaacgttaccgtgtcgacggtaggtacgttacgtagttacgtcgtaccgtttaccgtccggtacgtaccctcccgtacccgttcggtttacccg

SEQ ID NO: 181461 - DNA, 565 bp, Homo sapiens
  misc_feature: GYAE6OF01E4XBZ.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacacggcccctggacgaaggcttggagtggatggcagtggatcagtacccttaacagtggtatcacagactatgcagagactcgaggcagacgtcacttacgaccacgacgacacactaccgacgacgaccacgacgtaccctacgagtcggaccgtaggaacggacgccgtagacgtacgtcgtacgacgaccgtaccggtactatacgttacgtgttacgagtacgtacgttattacgtcgtaccttacgtccggtacgtaccgtacccgtaccgttcgttcgtttacg

SEQ ID NO: 181462 - DNA, 655 bp, Homo sapiens
  misc_feature: GYAE6OF01DEHYI.25.7.A07.1.454.CMB.1.raw
  modified_base (434)..(434): a, c, t, g, unknown or other
  misc_feature (434)..(434): n is a, c, g, or t
  modified_base (517)..(517): a, c, t, g, unknown or other
  misc_feature (517)..(517): n is a, c, g, or t
  modified_base (526)..(526): a, c, t, g, unknown or other
  misc_feature (526)..(526): n is a, c, g, or t
  modified_base (587)..(587): a, c, t, g, unknown or other
  misc_feature (587)..(587): n is a, c, g, or t
tcagactgtacagtcacgaccggtgctcgatttagcacgtgtcgcaggggacccaaaaaccaccacccctccttgggagaatcccctagatcacagctcctcaccatggactggacctggagcattccttttctggtggcagcagcaacaggtcgcccactcccgaggttcaacgtggtgcagtctggactgaggtgaagaacgccgtcgggcctgagtgaacggtctcgtgcgaaggtcttcgtacggttactaccgtttagaccgtagtacgtacgtcggactaagttcgaggtccggttggggtagaccggtacgacgggacccctagggaacgtaacgggtcttaggacggtggtagtcggagtaggtacggtactacgtacgtaccgttaaacgagttacggtactacgagtaacgtaactagtacganaaccgtaagtaaccgtcggaacggctaaacggtacgtacctactaccgaaccgaacaacgacaacacgtaccagacgacctanacgacctanacgtgactaaggcgcaccgtgaagtcctcggacgaacgtaccgacgtacctatacgttagngaccggagtagtccgttagtactcgtagttaccgtcgtcgactacccggtccgttaacgtgtttaccg

SEQ ID NO: 181463 - DNA, 703 bp, Homo sapiens
  misc_feature: GYAE6OF01ES8BW.25.7.A07.1.454.CMB.1.raw
tcagactgtacagtcacgaccggtgctcgatttagcacgtgtcgcaggggacccaaaaaaccacacccctccttgggagaatcccctagatcacagctcctcaccatggactggacctggagcatccttttcttggtggcagcagcaacaggtgcccactcccaggttcaactggtgcagtctggacctgaggtgaagagcctggggcctcgagtgaaggtcctcctgcaaggtcttcgtcggttaactacctttaagccaggctagtcggcactcgagtcgtggggtcgacgtacgacggcccctgggaacgaacggggtcttaggaggttggaactggactagtggactccgaaggtaccctttaaccgagttacggtaataccgaactagtaaccttaagtcgaccgaacgtaggaaccgttccgaacgggtactaggtacggtacctaaccgtttacgaaccctaacgaacgacccaacgtactacccgaaggtacgaaccaacgtacggaccctaacaacgtcggacctacggacggtacgtccgtagacgtaacgtccgtacggtaaccgacgacggtaccgtaataccgttacgtcgtacggacggtaacgtacggttagtaagtttacggtacgtacccgtttacccggtccggttaccgtacccgtaccggttccccgtttagggtttaccccg

SEQ ID NO: 181464 - DNA, 965 bp, Homo sapiens
  misc_feature: GYAE6OF01DXKTY.25.7.A07.1.454.CMB.1.raw
tcagactgtacagtcacgaccggtgctcgatttagcacgtgtcgcaggggaacccaaaaaccacacccctccttgggagaactcccctagatcacagcctcctcaccatggacgtggacctggagcatttcccttttgttgggtggcagcgagacaacgaggtcgcccaacctcccgaggttcaacgtggtgcgtatcgtacggaccgtaggtaggtagaaaggaacggtccggtaggggtcctacggaggtaggtaacggttcctaccgtacggacgtaaggttccgttacgtttacggttacctaccgtttagacgtacgtagttagcggactacgtggacggtcgtcgggctaccgacggacccgggtacccgtaggtaaccggagggttcgtagggtaccggtaggacggtcgtagacggttaggtactaccggtaacgtttaacccgtagtacgtacggttaaccacgtaaccgtagtaccgtaagtacccggaaaccgtaacggttaaggttaaacccgcgggtaaacggtaccgttaacggttaacccggtaaccttttaccccgggaaacccgaacgtaaaccgttacccgaaaccgtaaaccccgtaccgtaaaccccgtaaacggacccgtaaaccccgaaccgtaaaaccccgggtccccttaaacgggttaacccgggtaccgggtaaccggttaacggggtaaaccggtacccggttaacgggtagtaacccgttaaccgttaacccgggtaccgaaccgggttaaccggtttacccccgtaaggttaccggttttaaccggttaaggttacccgggaaacgtttacgggtaacgggtttacccgttaaaggttccgtttaaccgggttaccccgtttacccggtttaaaccggtcccggtaaccccgggtttaacccggttttcccgtaacccggttttaaccgtttcggg

SEQ ID NO: 181465 - DNA, 505 bp, Homo sapiens
  misc_feature: GYAE6OF02GISTA.25.7.A07.1.454.CMB.1.raw
  modified_base (449)..(449): a, c, t, g, unknown or other
  misc_feature (449)..(449): n is a, c, g, or t
tcagactgtacagtcacgaccggtgctcgatttagcacgtgtcgcaggggacccgaaaaccacacccctccttgggagaattccctagatcacagctcctcaccatggactggaccttggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttgagtggatggcatggatcagccttaaccatggtatcacagactatgcacaggaattccagggcagagtcaccttgaccacagacacatccacgagcacacgcctacatggacctgaggagcctgagatctgacgacacggcctatagttacngtgcgaggagtcgattatgtacttactccggtgacctccggacccttggttacccg

SEQ ID NO: 181466 - DNA, 547 bp, Homo sapiens
  misc_feature: GYAE6OF02FXDW8.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttgagtggatggcagtggatcagccttaacatggtatcacagactatgacacgaggaacttccagggcagagtcaccttgaccacagacacactacacgagcacacgcctacagtggacctggaggacgccgtggagatccgtgaaccgacgaccgggtacctagttacgttacgtgtcgacgaggtagtacgtattacgtcggtactttacgtccgggttacgacccgtcccggtacccgttggtttacccg

SEQ ID NO: 181467 - DNA, 566 bp, Homo sapiens
  misc_feature: GYAE6OF02HMIOW.25.7.A07.1.454.CMB.1.raw
  modified_base (328)..(328): a, c, t, g, unknown or other
  misc_feature (328)..(328): n is a, c, g, or t
  modified_base (338)..(338): a, c, t, g, unknown or other
  misc_feature (338)..(338): n is a, c, g, or t
  modified_base (383)..(383): a, c, t, g, unknown or other
  misc_feature (383)..(383): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttaccacctttagcagctatggcatcagcgtgggtgcgacaggcccctggacaagggcttggagtgatggcatggatcagtcccttaacntggtactcanagactatgacacaaggattccgaggcagtagtcaccttcgaccanacgacacactccacgacnccacgacgccctaanacgtcggaccttggagacgccgtagacgtactcgtagacgtaccgaccggtaccgtaattacgtttacgtcggtacgaggaacggtgtaccgtagttaacgtacgtcgttacgttccggtagtacccgtccgtacccgttggtttacccg

SEQ ID NO: 181468 - DNA, 737 bp, Homo sapiens
  misc_feature: GYAE6OF02I80EG.25.7.A07.1.454.CMB.1.raw
  modified_base (380)..(380): a, c, t, g, unknown or other
  misc_feature (380)..(380): n is a, c, g, or t
  modified_base (657)..(657): a, c, t, g, unknown or other
  misc_feature (657)..(657): n is a, c, g, or t
tcagactgtacagtcacgaccggtgctcgatttagcacgtgtcgcagggggcccaaaaaccacacccctccttgggagaatcccctagatcacagctcctcaccatggactggacctggagcattcctttttcttggtggcagcagcaacaggtcgcccactcccaggttcaactggtgcagtctggacctgaggtgaagacgccgtggggcctcgaggtgaaggtctccgtgcgaaggtcttcgtaggttacaccgtttagcagtcttagtcggactatccgagtcgttgggcgacgacgacggtccccgtaggaccgaaggggtcttaggagtgggacgtgggacctagtagggacttcgacgtacccgttaaaccgngttagggtaactaccgaactaaacggtaccttaagttcgtaacctaacggaaacgggttaaacgttccggaaacggggaacttacggggtaaccgtaacccgtacccgtttaccggaacccgtaacgtaaccggaacgtaacccaacgtacccgtaaacgggaacctaccggaaccttaccgggaaccctacgtaacgttccggaacgttagggacgtaccgcgttacggagtacctacgacgaaccgtaccggaacgtaccgttactacggttacncggttacgacgtaggtacgtacgtattacgtcgtacgttaccgtacgttacgtacccgttaccgtaccgtttcgttacgg

SEQ ID NO: 181469 - DNA, 785 bp, Homo sapiens
  misc_feature: GYAE6OF02HYBWM.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagcctggggcctcagtgaaggtctcctgcaaggcttctggttacacctttagcagctatggcatcagctgggtgcgacacggcccctggaacagggcttggagtggatgggcagtggactcgacgtccttaaacgagtacggttaatccaacgtaacgtaccttagtcgaccgtaacgaaggtaacttcccggaaggggaccaaggtacgttaccgtaaccgtttacgaaccctaacgaacggaacctaaccgtaacgtaccccgaacggaaccgaccgaaacctacggtaaccccttaaacgtaacggtaacccgggtaccggttaacggggaacgggtaccggtacccttaaggggaaccgttaacgttaccggttaccgggaaaacccgtaccgggtaacccgggttaacccggtttaaattaacgttttaacggaccggtttacgggaacggtaacgggttaaacgggtttaccgttaaagtttaacggttaccggtttaaccccgttttaacccggtttacccggggtaacccgtttaccccggttaccccggtttaccccggtttcgggttttttaaccccg

SEQ ID NO: 181470 - DNA, 613 bp, Homo sapiens
  misc_feature: GYAE6OF02G3VT0.25.7.A07.1.454.CMB.1.raw
  modified_base (430)..(430): a, c, t, g, unknown or other
  misc_feature (430)..(430): n is a, c, g, or t
tcagactgtacagtcacgaccggtgctcgatttagcacgtgtcgcaggggacccaaaaaccacacccctccttgggagaatcccctagatcacagctcctcaccatggactggacctggagcatcctttcttggtggcagcagcaacaggtgcccactcccaggttcaactggtgcagtctggacctgaggtgaagaagccgtggggcctcagtgaaggtctcctgcaaggcttctggttacacctttagcagctatggcatcagcgtgggtgcgacacggcccctggacgaagggctggagtggatggacagtggatcgtacgtacccttaacagtaggtatacgaacgagtactagtcgacgagtaagtaacgttcgaggtacagtactcgtacctacgaccacaacgaccacaactacccgaagacncacgactcccgtacagtcgaactggacggacgtccgtagaactcgttacgacggaaccgtacgtaccggacccgtttaagaacgttctggacggtacggtaggtacggttacgttagttaccgttagttaccggttaccgtccgggttactaccccggtacccgttaccgtttccggtttacg

SEQ ID NO: 181471 - DNA, 651 bp, Homo sapiens
  misc_feature: GYAE6OF02FI3NT.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatcctttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaggcttgagtgatgcatggatcgagccttaaccatcggtatcacagactatgcacaggaacttccgagggcagacgtccacctgaccacagaccacactaccgacgagaccacacgaccctacgagcggtaccctggaacggacgtaccctggaacgtacgttcctaacggtaccgaacccgtaaccggggacccttaaacggttaacgttttacccgttggttaccggaccgggtaacgggtaaacgttaccggtaaacgttttagttaccggttacccgtttttaacccggtacccgggggttttaccgtaaccccggtttacccccgggtaaccccggttttcgggtttttaaccccccgg

SEQ ID NO: 181472 - DNA, 594 bp, Homo sapiens
  misc_feature: GYAE6OF02I4X8Q.25.7.A07.1.454.CMB.1.raw
  modified_base (347)..(347): a, c, t, g, unknown or other
  misc_feature (347)..(347): n is a, c, g, or t
  modified_base (423)..(423): a, c, t, g, unknown or other
  misc_feature (423)..(423): n is a, c, g, or t
tcagactgtacagtcacgaccggtgctcgatttagcacgtgtcgcagggggacccaaaaaccacacccctccttgggagaatcccctagatcacagctcctcaccatggactggacctggagcatccttttcttggtggcagcagcaacaggtgcccactcccaggttcaactggtgcagtctggacctgaggtgaagagcctggggcctcagtgaaggtctcctgcaaggcttctggttaccacctttagcagctatggcatcagcgtgggtcgcgacgacggccccctagggacgaagggtcttggacggtggagtggcagtgggactcgacgtcccttaaaccngtaggtaactacaacacgtaactatcggaccaacgaggtaactccgagggcagacgtaccaccgttagaccacganacgactactacacgacacacacgcctaacgtgtacggacctagacgacgtcctagacgtatcgtacgacggaccgacggtacgtactacgttactggtgacgaggtacgtacgttattacgtcgtacttacggttccggtaccgtaccgtcccgttaccgttcgtttaccg

SEQ ID NO: 181473 - DNA, 814 bp, Homo sapiens
  misc_feature: GYAE6OF02J1OFR.25.7.A07.1.454.CMB.1.raw
  modified_base (599)..(599): a, c, t, g, unknown or other
  misc_feature (599)..(599): n is a, c, g, or t
tcagactgtacagtcacgaccggtgctcgatttagcacgtgtcgcaggggacccaaaaaccacacccctccttgggagaatcccctagatcacagctcctcaccatggactgggacctggagcatccttttctggtggcagcagcaacaggtgcccctactcccaggttcaacgtggtcgcgacgtcgtacgggtacctggtagggttagaaacggaaacggtcccgttgggggccctcgaaggtacggtaacgggttcctaccgttggacgtaagggtcctttcgttacgggtttaacctaccgtttaacggacacggtacttaacgtgggacctacgttacgaacggttcggtcggggtacgaccggtaaccgtacccgggtacccccgttggggaacccgaagggttccgttaagggacggtaggtacgttggacggtaagtcgggtaactcccgtaacggtacccttaaacgtacggtacggtttaacaccgtaacgacggtaacgtacgtcgtaaccgaagtacggttaaaccgcggaaacgggtctacggtagttacccgtacgttaacgactacgaacgtaccaccgtaacnccggtaacgacgactaccgaacgtcccaagtcgttaccgggataccggtaggaccttcggagtataccgttcggaacgacccggtacgtaacgtccgtaagttaccgtcgtacgtcggaacgacggtcgttaccgatacccggtttcgtaacccggtttaccggttacccggaacgtttaacccctaccgggtttacccgtttacggtttaaccg

SEQ ID NO: 181474 - DNA, 691 bp, Homo sapiens
  misc_feature: GYAE6OF02H56N6.25.7.A07.1.454.CMB.1.raw
tcagactgtacagtcacgaccggtgctcgatttagcacgtgtcgcaggggacccaaaaaccacacccctccttgggagaatcccctagatcacagctcctcaccatggactggacctggagcatccttttcttggtgcagcagcaacaggtgcccactcccaggttcaactggtgcagtcgtggacctgaggtgaagagccgtgggcctcaggtgaaggtcctcgtgacgaacggtcttctaggttaccacctttagcagtctagtcggctatcgagcgtgggtgcgaccgacggccccgtggacgaacggtcttggacgttaggagtggacagtcgatcgtacgaccgttaactgtaggtactcgactaacgtactagtacacaacgtacggtaacgttaccggaggacgtacggtacgtacctaccgttacgtaaccaggtaacccaactaacctaccgtacccgtaacggacgacccgtaaccgaaccgtacctaaaccgtacgtaaccggggtaccgttaacgggcggtaaccgcggtaacggaacttacgtacccgtaaggtaacccgaccggttaacggttaccgttaaattaacgttaccgtagtacggacggtaagtacggttacgttattacgtactaccgtttacggcgtaccgttcccgtcccgttacgttcgtttaacg

SEQ ID NO: 181475 - DNA, 176 bp, Homo sapiens
  misc_feature: GYAE6OF01ADVHN.44.70.G04.1.454.CMB.1.raw
  modified_base (154)..(176): a, c, t, g, unknown or other
  misc_feature (154)..(176): n is a, c, g, or t
tcagacagtatatacacgaccggtgctcgatttagtgtagtgtgaagggaaagggacacgacttgagattaaggcgaactgtggctgcaccatctgtcttcatcttcccgcatctgatatatactgtctgagcgggctggccaaggcgcatagnnnnnnnnnnnnnnnnnnnnnnn

SEQ ID NO: 181476 - DNA, 154 bp, Homo sapiens
  misc_feature: GYAE6OF01BCQ43.44.70.G04.1.454.CMB.1.raw
  modified_base (152)..(154): a, c, t, g, unknown or other
  misc_feature (152)..(154): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgctgagcgggctggcaaggcgcatagnnn

SEQ ID NO: 181477 - DNA, 152 bp, Homo sapiens
  misc_feature: GYAE6OF01CMCXE.44.70.G04.1.454.CMB.1.raw
  modified_base (152)..(152): a, c, t, g, unknown or other
  misc_feature (152)..(152): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcggctggcaaggcgcatagn

SEQ ID NO: 181478 - DNA, 154 bp, Homo sapiens
  misc_feature: GYAE6OF01BT7XA.44.70.G04.1.454.CMB.1.raw
  modified_base (153)..(154): a, c, t, g, unknown or other
  misc_feature (153)..(154): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnn

SEQ ID NO: 181479 - DNA, 154 bp, Homo sapiens
  misc_feature: GYAE6OF01AC36L.44.70.G04.1.454.CMB.1.raw
  modified_base (153)..(154): a, c, t, g, unknown or other
  misc_feature (153)..(154): n is a, c, g, or t
tcagacagtatatacacgaccggtgctcgatttagtgtagtgtgaagggaaagggaccaaggtggaaatcaaacgaactgtgactgcaccatctgtcttcatcttcccgccatctgatatatactgtctgagcgggctggcaaggcgcatagnn

SEQ ID NO: 181480 - DNA, 153 bp, Homo sapiens
  misc_feature: GYAE6OF01CAEJU.44.70.G04.1.454.CMB.1.raw
  modified_base (153)..(153): a, c, t, g, unknown or other
  misc_feature (153)..(153): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagn

SEQ ID NO: 181481 - DNA, 437 bp, Homo sapiens
  misc_feature: GYAE6OF01DCA5E.44.70.G04.1.454.CMB.1.raw
  modified_base (431)..(437): a, c, t, g, unknown or other
  misc_feature (431)..(437): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcaccctcctccaagacgcacctctgggggcacagcggccctgggctgcctggtcaaggctacttccacgtctactgctgagcgggctggcaaggcgcatagnnnnnnn

SEQ ID NO: 181482 - DNA, 153 bp, Homo sapiens; identical to SEQ ID NO: 181480
  misc_feature: GYAE6OF01BPS44.44.70.G04.1.454.CMB.1.raw
  modified_base (153)..(153): a, c, t, g, unknown or other
  misc_feature (153)..(153): n is a, c, g, or t

SEQ ID NO: 181483 - DNA, 153 bp, Homo sapiens; identical to SEQ ID NO: 181480
  misc_feature: GYAE6OF01D9F4X.44.70.G04.1.454.CMB.1.raw
  modified_base (153)..(153): a, c, t, g, unknown or other
  misc_feature (153)..(153): n is a, c, g, or t

SEQ ID NO: 181484 - DNA, 495 bp, Homo sapiens
  misc_feature: GYAE6OF01C8H6E.44.70.G04.1.454.CMB.1.raw
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctcacaactcctgatctatttgggttccactcgggcctccggggtctctgacaggttcagtgccagtgcatcacacacagatttcacactgcacatcagcagagtggaggctgacgatgttggggtctattactgcatccaagttctacaacccgttcaccttcggacagggacacgacttgagnttaagcgaactgtggntgcacctac

SEQ ID NO: 181485 - DNA, 151 bp, Homo sapiens
  misc_feature: GYAE6OF01BT90D.44.70.G04.1.454.CMB.1.raw
  modified_base (151)..(151): a, c, t, g, unknown or other
  misc_feature (151)..(151): n is a, c, g, or t
tcagacagtatatacacgaccggtgctcgatttagtgtagtgtgaagggaaaggacacgacttgagattaagcgaactgtggctgcaccatctgtcttcatcttcccgccatctgatatatacgtctgagcgggctggcaaggcgcatagn

SEQ ID NO: 181486 - DNA, 188 bp, Homo sapiens
  misc_feature: GYAE6OF01BZES0.44.70.G04.1.454.CMB.1.raw
  modified_base (154)..(188): a, c, t, g, unknown or other
  misc_feature (154)..(188): n is a, c, g, or t
tcagacagtatatacacgaccggtgctcgatttagtgtagtgtgaagggaaaggacacgacttgagattaagtcgaacgtgtggctgcaccatctgtcttcatcttacccgcatctgatatatactgtctgagcgggctggcaaggcgcatagnnnnnnnnnnnnnnnnnnnnnnnnnnnnnnnnnnn

SEQ ID NO: 181487 - DNA, 151 bp, Homo sapiens
  misc_feature: GYAE6OF01DR8AI.44.70.G04.1.454.CMB.1.raw
  modified_base (151)..(151): a, c, t, g, unknown or other
  misc_feature (151)..(151): n is a, c, g, or t
tcagacagtatatacacgaccggtgctcgatttagtgtagtgtgaagggaaaggacacgacttgagattaagcgaactgtggctgcaccatctgtcttcatcttcccgccatctgatatatactgtctgagcggctggcaaggcgcatagn

SEQ ID NO: 181488 - DNA, 152 bp, Homo sapiens
  misc_feature: GYAE6OF01BSGO4.44.70.G04.1.454.CMB.1.raw
  modified_base (151)..(152): a, c, t, g, unknown or other
  misc_feature (151)..(152): n is a, c, g, or t
tcagacagtatatacacgaccggtgctcgatttagtgtagtgtgaagggaaaggacacgacttgagattaagcgaactgtggctgcaccatctgtcttcatcttcccgccatctgatatatactgtctgagcggctggcaaggcgcatagnn

SEQ ID NO: 181489 - DNA, 163 bp, Homo sapiens
  misc_feature: GYAE6OF01D5VLA.44.70.G04.1.454.CMB.1.raw
  modified_base (153)..(163): a, c, t, g, unknown or other
  misc_feature (153)..(163): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnnnnnnnnnn

SEQ ID NO: 181490 - DNA, 153 bp, Homo sapiens; identical to SEQ ID NO: 181480
  misc_feature: GYAE6OF01DBEWP.44.70.G04.1.454.CMB.1.raw
  modified_base (153)..(153): a, c, t, g, unknown or other
  misc_feature (153)..(153): n is a, c, g, or t

SEQ ID NO: 181491 - DNA, 154 bp, Homo sapiens; identical to SEQ ID NO: 181478
  misc_feature: GYAE6OF01BU6YP.44.70.G04.1.454.CMB.1.raw
  modified_base (153)..(154): a, c, t, g, unknown or other
  misc_feature (153)..(154): n is a, c, g, or t

SEQ ID NO: 181492 - DNA, 153 bp, Homo sapiens; identical to SEQ ID NO: 181480
  misc_feature: GYAE6OF01EVP11.44.70.G04.1.454.CMB.1.raw
  modified_base (153)..(153): a, c, t, g, unknown or other
  misc_feature (153)..(153): n is a, c, g, or t

SEQ ID NO: 181493 - DNA, 154 bp, Homo sapiens; identical to SEQ ID NO: 181478
  misc_feature: GYAE6OF01C8G95.44.70.G04.1.454.CMB.1.raw
  modified_base (153)..(154): a, c, t, g, unknown or other
  misc_feature (153)..(154): n is a, c, g, or t

SEQ ID NO: 181494 - DNA, 432 bp, Homo sapiens
  misc_feature: GYAE6OF01D7RGT.44.70.G04.1.454.CMB.1.raw
  modified_base (428)..(432): a, c, t, g, unknown or other
  misc_feature (428)..(432): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaaccctggtcaccgtctcctcagcctccaccaagggcccatcggtcttccccctggcaccctcctccaagagcacctctgggggcacagcggccctgggctgcctggtcaaggctactcctatatactgtctgagcgggctggcaaggcgcatagnnnnn

SEQ ID NO: 181495 - DNA, 156 bp, Homo sapiens
  misc_feature: GYAE6OF01A6TKC.44.70.G04.1.454.CMB.1.raw
  modified_base (153)..(156): a, c, t, g, unknown or other
  misc_feature (153)..(156): n is a, c, g, or t
tcagacagtatatacacgaccggtgctcgatttagtgtagtgtgaagggaaagggaccaaggtggaaatcaaacgaactgtgactgcaccatctgtcttcatcttcccgccatctgatatatactgtctgagcgggctggcaaggcgcatagnnnn

SEQ ID NO: 181496 - DNA, 211 bp, Homo sapiens
  misc_feature: GYAE6OF01B4XH4.44.70.G04.1.454.CMB.1.raw
  modified_base (210)..(211): a, c, t, g, unknown or other
  misc_feature (210)..(211): n is a, c, g, or t
tcagacagtatatacacgaccggtgctcgatttagtgtagtgtgaagggaaaggggacgtcggtcaccgtctcctcagcttccaccaagggcccatcggtcttcccctggcgccctgctccaggagcacctctggggcacagcggcctgggctgcctggtcaaggactacttccacgtctactgctgagcgggctggcaaggcgcatagnn

SEQ ID NO: 181497 - DNA, 152 bp, Homo sapiens
  misc_feature: GYAE6OF01CDC35.44.70.G04.1.454.CMB.1.raw
  modified_base (151)..(152): a, c, t, g, unknown or other
  misc_feature (151)..(152): n is a, c, g, or t
tcagacagtatatacacgaccggtgctcgatttagtgtagtgtgaagggaagggacacgacttgagattaagcgaactgtggctgcaccatctgtcttcatcttcccgccatctgatatatactgtctgagcggctggcaaggcgcatagnn

SEQ ID NO: 181498 - DNA, 153 bp, Homo sapiens; identical to SEQ ID NO: 181480
  misc_feature: GYAE6OF01DZYIE.44.70.G04.1.454.CMB.1.raw
  modified_base (153)..(153): a, c, t, g, unknown or other
  misc_feature (153)..(153): n is a, c, g, or t

SEQ ID NO: 181499 - DNA, 153 bp, Homo sapiens
  misc_feature: GYAE6OF01CZBJ1.44.70.G04.1.454.CMB.1.raw
  modified_base (153)..(153): a, c, t, g, unknown or other
  misc_feature (153)..(153): n is a, c, g, or t
tcagacagtatatacacgaccggtgctcgatttagtgtagtgtgaagggaaagggaccaaggtggaaatcaaacgaactgtgactgcaccatctgtcttcatcttcccgccatctgatatatactgtctgagcgggctggcaaggcgcatagn

SEQ ID NO: 181500 - DNA, 163 bp, Homo sapiens
  misc_feature: GYAE6OF01AMHGP.44.70.G04.1.454.CMB.1.raw
  modified_base (153)..(163): a, c, t, g, unknown or other
  misc_feature (153)..(163): n is a, c, g, or t
tcagacagtatatacacgaccggtgctcgatttagtgtagtgtgaagggaagggacacgacttgagattaagcgaactgtggctgcaccatctgtcttcactccttcccgcatctgatatatactgtctgagcgggctggcaaggcgcatagnnnnnnnnnnn

SEQ ID NO: 181501 - DNA, 166 bp, Homo sapiens
  misc_feature: GYAE6OF01ESZUK.44.70.G04.1.454.CMB.1.raw
  modified_base (155)..(166): a, c, t, g, unknown or other
  misc_feature (155)..(166): n is a, c, g, or t
tcagacagtatatacacgaccggtgctcgatttagtgtagtgtgaagggaaagggtacgacgacttgagagttaagcgaactgtggctgcaccatctgtcttcatcttcccccatctgatatatactgtctgagcgggctggcaaggcgcatagnnnnnnnnnnnn

SEQ ID NO: 181502 - DNA, 154 bp, Homo sapiens; identical to SEQ ID NO: 181479
  misc_feature: GYAE6OF01DCR51.44.70.G04.1.454.CMB.1.raw
  modified_base (153)..(154): a, c, t, g, unknown or other
  misc_feature (153)..(154): n is a, c, g, or t

SEQ ID NO: 181503 - DNA, 565 bp, Homo sapiens
  misc_feature: GYAE6OF01CLSKQ.44.70.G04.1.454.CMB.1.raw
  modified_base (281)..(281): a, c, t, g, unknown or other
  misc_feature (281)..(281): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttgggagtcagaacatctatgtggactggtacttgcagaagaccggnagtcctccacaactctgatctatttcggtccacgtcgggcctccggggtctcgtgactaggttcaggtcgccagtcgcatcacacactagtactttacacactcgacacatcagcagaggtggacggctaggacgtagtttgggttagggttacttagttacgtcgactacttaccgtaagttcccgtaaaccctaaccccgttcaacccgttcgggacgtaaacgggaccacggtacttaggaacgtaattaacgacgtaactcggtacgctcgcctacgtcg

SEQ ID NO: 181504 - DNA, 501 bp, Homo sapiens
  misc_feature: GYAE6OF01EOZX3.44.70.G04.1.454.CMB.1.raw
  modified_base (492)..(492): a, c, t, g, unknown or other
  misc_feature (492)..(492): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctagttactgcatcctaagttctacaacccgttcaccttcgggcaagggacacgacttgagtattaagcgaactgtaggntgcacgtac

SEQ ID NO: 181505 - DNA, 434 bp, Homo sapiens
  misc_feature: GYAE6OF01E3P67.44.70.G04.1.454.CMB.1.raw
  modified_base (431)..(434): a, c, t, g, unknown or other
  misc_feature (431)..(434): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgcatagnnnn

SEQ ID NO: 181506 - DNA, 565 bp, Homo sapiens
  misc_feature: GYAE6OF01B1SJW.44.70.G04.1.454.CMB.1.raw
  modified_base (358)..(358): a, c, t, g, unknown or other
  misc_feature (358)..(358): n is a, c, g, or t
tcagacagtatatacacgaccggtgctcgatttagtgtagtgtgaagggaaaaggggactgatcgaggactcctcagttcaaccttctcacaatgaggctccctgctcagctcctaggggctgctaatgctctgggtctcagggtccagtaggagatattataatgactacagtctcccctctcccctggacccgtcacccctggacgacgccggcctccatcctcctgtaggtctagtgagagttcgttggaggtcagaacgatctatgtggactggtacttgcagaaggaccggcaggtcctccacaacctcctgactctagtttgggtccacgtcgggccgtcgggtctctgacnggttcgagtcgccagtcgacgatcaccacactagtactttacgacgtactggaccaacgtactacagacgagagtggaggcgtagacgagttggttggggttcttagttactgactactaccgtaagttcctaacctaaccccgttcaccgttcgggacaagggacacgtacgttagagtacgtaagcaacgtgtgctgctactacg

SEQ ID NO: 181507 - DNA, 153 bp, Homo sapiens
  misc_feature: GYAE6OF01D8A1O.44.70.G04.1.454.CMB.1.raw
  modified_base (153)..(153): a, c, t, g, unknown or other
  misc_feature (153)..(153): n is a, c, g, or t
tcagacagtatatacacgaccggtgctcgatttagtgtagtgtgaagggaaagggacacgacttgagattaagcgaactgtggctgcaccatctgtcttcatattcccgccatctgatatatactgtctgagcgggctggcaaggcgcatagn

SEQ ID NO: 181508 - DNA, 156 bp, Homo sapiens
  misc_feature: GYAE6OF01BJ5AT.44.70.G04.1.454.CMB.1.raw
  modified_base (153)..(156): a, c, t, g, unknown or other
  misc_feature (153)..(156): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnnn

SEQ ID NO: 181509 - DNA, 157 bp, Homo sapiens
  misc_feature: GYAE6OF01AIVDG.44.70.G04.1.454.CMB.1.raw
  modified_base (153)..(157): a, c, t, g, unknown or other
  misc_feature (153)..(157): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnnnn

SEQ ID NO: 181510 - DNA, 154 bp, Homo sapiens; identical to SEQ ID NO: 181478
  misc_feature: GYAE6OF01CD5TL.44.70.G04.1.454.CMB.1.raw
  modified_base (153)..(154): a, c, t, g, unknown or other
  misc_feature (153)..(154): n is a, c, g, or t

SEQ ID NO: 181511 - DNA, 433 bp, Homo sapiens
  misc_feature: GYAE6OF01AT0DO.44.70.G04.1.454.CMB.1.raw
  modified_base (430)..(433): a, c, t, g, unknown or other
  misc_feature (430)..(433): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcgaactggctcgacccctggggccagggaaccctggtcaccgtctcctcagcctccaccaaggcccatcggtcttccccctggcaccctcctccaagagcacctctggggcacagcggccctgggctgcctggtcaaggactacttccctatatactgtctgagcgggctggcaaggcgcatagnnnn

SEQ ID NO: 181512 - DNA, 534 bp, Homo sapiens
  misc_feature: GYAE6OF01DEYT9.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggcccgtcacccctggagagccggcctccatctcctgtaggtctagtgagagtcttggaggtcagaacatctatgtggactggtacttgcagaagaccggcagtctcacaactcctgatctatttgggtccactcgggcctccggggtctctgacaggttcagtgccagtgcatcacacacagtatttcacactgcacatcagcagagtggaggctggacgagtggtttggggtctagttactgcacttccgtaagttcctaaccgtaaaccccgttcaacccgtttccgggacaacgggtacacggtacttggaagtattaacggcgaacgtggtacggctcgctaccgtac

SEQ ID NO: 181513 - DNA, 153 bp, Homo sapiens; identical to SEQ ID NO: 181480
  misc_feature: GYAE6OF01BE24D.44.70.G04.1.454.CMB.1.raw
  modified_base (153)..(153): a, c, t, g, unknown or other
  misc_feature (153)..(153): n is a, c, g, or t

SEQ ID NO: 181514 - DNA, 571 bp, Homo sapiens
  misc_feature: GYAE6OF01AMW1X.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctccctctccctggccgtcacccctggagagccggcctccatctcctgtaggtctagtgagagtcttggaggtcagaacatctatgtggactggtacttgcagaagaccgggcagtctccacaactcctgatctatttcgggtccacgtcgggcctccggggtctctgacaggttcagtgccagtgcatcacacacagtatttcacactgcacatcagcagagtggagctgacgtagtggttagggtctagttacgtgtactataccctaacgttccttaaaccgtaaacccccgtttcaaccccgtttcgggaccgtaaacggggaccaaccggtaacgttacggaacggtaagtttaaacggaccgtaacgttcggttcggacctcggtccgaaccctacg

SEQ ID NO: 181515 - DNA, 445 bp, Homo sapiens
  misc_feature: GYAE6OF01CCFY4.44.70.G04.1.454.CMB.1.raw
  modified_base (433)..(433): a, c, t, g, unknown or other
  misc_feature (433)..(433): n is a, c, g, or t
  modified_base (438)..(445): a, c, t, g, unknown or other
  misc_feature (438)..(445): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgaccctggggccagggaccctggtccaccgtctcctcagcctccaccaagggcccatccggtccttccccctggccaccctcctccaagacgcacctcgtgggggcacaggccggcccgtgggctgcctggtcaaggactacttcctatatactgtctgagcgggctggcaaggcgnatagnnnnnnnn

SEQ ID NO: 181516 - DNA, 153 bp, Homo sapiens; identical to SEQ ID NO: 181480
  misc_feature: GYAE6OF01E3W5A.44.70.G04.1.454.CMB.1.raw
  modified_base (153)..(153): a, c, t, g, unknown or other
  misc_feature (153)..(153): n is a, c, g, or t

SEQ ID NO: 181517 - DNA, 153 bp, Homo sapiens; identical to SEQ ID NO: 181480
  misc_feature: GYAE6OF01CP4WU.44.70.G04.1.454.CMB.1.raw
  modified_base (153)..(153): a, c, t, g, unknown or other
  misc_feature (153)..(153): n is a, c, g, or t

SEQ ID NO: 181518 - DNA, 624 bp, Homo sapiens
  misc_feature: GYAE6OF01DCG9O.44.70.G04.1.454.CMB.1.raw
  modified_base (150)..(150): a, c, t, g, unknown or other
  misc_feature (150)..(150): n is a, c, g, or t
  modified_base (255)..(255): a, c, t, g, unknown or other
  misc_feature (255)..(255): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (415)..(415): a, c, t, g, unknown or other
  misc_feature (415)..(415): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtgganatattataatgactcagtcctcccctctccctggcccgtccacccctgggacgacgccggcctcatctcctgtaggtctagtgagagtcgttggaggtcagaacntctagtgtggactggtactgcagacgacggntagtctccacactcngatctagtttcggtccacgtccgggtcctcgggtctcgtgaccgtaggttcacggtcgccgtagtcgactatcacacgacagtactttcgacactgacacactacgagcaaggnggtacggagtcgtagaagtcgttggttacgggttacttacgttacgtcaccgtacttacccgtaacgttacctaacccgtaaccccgttccgtaaccggtttccggggaacgtaaaccggggtacctaaccgggtaacttaggaaaccgttaagtttaaccggaccgttaaacgttcggttacggaccgtacggtaccctacgttaccg

SEQ ID NO: 181519 - DNA, 312 bp, Homo sapiens
  misc_feature: GYAE6OF01CKAR7.44.70.G04.1.454.CMB.1.raw
  modified_base (194)..(194): a, c, t, g, unknown or other
  misc_feature (194)..(194): n is a, c, g, or t
  modified_base (199)..(199): a, c, t, g, unknown or other
  misc_feature (199)..(199): n is a, c, g, or t
  modified_base (218)..(219): a, c, t, g, unknown or other
  misc_feature (218)..(219): n is a, c, g, or t
  modified_base (221)..(221): a, c, t, g, unknown or other
  misc_feature (221)..(221): n is a, c, g, or t
  modified_base (225)..(227): a, c, t, g, unknown or other
  misc_feature (225)..(227): n is a, c, g, or t
  modified_base (229)..(312): a, c, t, g, unknown or other
  misc_feature (229)..(312): n is a, c, g, or t
tcagacagtatatacacgaccggtgctcgatttagtgtagtgtgaagggaaagggggggacgtcggtcaccgtctcctcagcttccaccaagggcccatccggtcttccccctggcgccctgcctccaggagcacctctgggggcacagcggccctggctgcctgggtcaaggctactcctatatactgtctgngcggntggcaaggcgctatacggnngnagcnnntnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 181520 - DNA, 417 bp, Homo sapiens
  misc_feature: GYAE6OF01CKOPJ.44.70.G04.1.454.CMB.1.raw
  modified_base (393)..(393): a, c, t, g, unknown or other
  misc_feature (393)..(393): n is a, c, g, or t
  modified_base (403)..(403): a, c, t, g, unknown or other
  misc_feature (403)..(403): n is a, c, g, or t
  modified_base (409)..(417): a, c, t, g, unknown or other
  misc_feature (409)..(417): n is a, c, g, or t
tcagacagtatatacacgaccggtgctcgatttagtgtagtgtgaagggaaaggggctggagtgggttggccgtattagaaccaaagctgacggtgggacagcagactacgctgcacccgtgaaaggcagattcaccatctcaagagatgattcaaaaagatacggtgtctctgcagatgaacagcctgaacaccgaggacacagccgtctattactgtctgggatggtttcattcgggccagggaccctggtcaccgtctcctcagcctccaccaagggcccatccggtcttccccctggccgccctgcctcccaggacgccacctccgagcgcacagccggccctgggctgcctggtcaaggtctactcctatactactgtctgagcgggntggcaaggcncatagnnnnnnnnn

SEQ ID NO: 181521 - DNA, 214 bp, Homo sapiens
  misc_feature: GYAE6OF01A16KS.44.70.G04.1.454.CMB.1.raw
  modified_base (213)..(214): a, c, t, g, unknown or other
  misc_feature (213)..(214): n is a, c, g, or t
tcagacagtatatacacgaccggtgctcgatttagtgtagtgtgaagggaaagggggacgtcggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnn

SEQ ID NO: 181522 - DNA, 536 bp, Homo sapiens
  misc_feature: GYAE6OF01ANV0K.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagtatttcacactgcacatcagcagagtggaggctggacgagtggttggggtcttattacgtgacactacctaagttcctaacctaacccccgttcgacccgttcgggctaacgggacaccggtacttaggagtacgttaacgcgtaacgtggtacggctcgccaccgtacg

SEQ ID NO: 181523 - DNA, 154 bp, Homo sapiens
  misc_feature: GYAE6OF01CU0WZ.44.70.G04.1.454.CMB.1.raw
  modified_base (152)..(154): a, c, t, g, unknown or other
  misc_feature (152)..(154): n is a, c, g, or t
tcagacagtatatacacgaccggtgctcgatttagtgtagtgtgaagggaaagggaccaaggtggaaatcaaacgaactgtgactgcaccatctgtcttcatcttcccgcatctgatatatactgtctgagcgggctggcaaggcgcatagnnn

SEQ ID NO: 181524 - DNA, 153 bp, Homo sapiens; identical to SEQ ID NO: 181480
  misc_feature: GYAE6OF01EFU3C.44.70.G04.1.454.CMB.1.raw
  modified_base (153)..(153): a, c, t, g, unknown or other
  misc_feature (153)..(153): n is a, c, g, or t

SEQ ID NO: 181525 - DNA, 163 bp, Homo sapiens
  misc_feature: GYAE6OF01ALQSP.44.70.G04.1.454.CMB.1.raw
  modified_base (152)..(163): a, c, t, g, unknown or other
  misc_feature (152)..(163): n is a, c, g, or t
tcagacagtatatacacgaccggtgctcgatttagtgtagtgtgaagggaaaggacacgacgttgagattaagcgaactgtggctgcaccatctgtcttcatcttcccgcatctgatatatactgtctgagcgggctggcaaggcgcatagnnnnnnnnnnnn

SEQ ID NO: 181526 - DNA, 574 bp, Homo sapiens
  misc_feature: GYAE6OF01ESMJJ.44.70.G04.1.454.CMB.1.raw
  modified_base (285)..(285): a, c, t, g, unknown or other
  misc_feature (285)..(285): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcgagggtccagtggagatattataatgactcagtcctcccctctccctggcccgtcaccccgtggagacgccggcctccatctcctgtaggtctagtgagagtcttggaggtcagaacatctatgtggactggtacttgcagaagccggnagtctccacactctgattctagtttcgggtccacgtccgggtccgtccgggtctcgtgacgtaggttcagtcgcctagtcgactatcacacacagtatttaccacactcgacacatacagtacaggaggtaggagtcgtgacgtagttggttgggtacttattacgtgactacgtacctaacgtttaccctaaccctaaaccccgttcgtaaccgttacgggacgaacgggactacggtacttagaacgtagttaacgacgtaacgtggtacgtactcgccaccgtacg

SEQ ID NO: 181527 - DNA, 205 bp, Homo sapiens
  misc_feature: GYAE6OF01BDLVF.44.70.G04.1.454.CMB.1.raw
  modified_base (154)..(154): a, c, t, g, unknown or other
  misc_feature (154)..(154): n is a, c, g, or t
  modified_base (159)..(205): a, c, t, g, unknown or other
  misc_feature (159)..(205): n is a, c, g, or t
tcagacagtatatacacgaccggtgctcgatttagtgtagtgtgaagggaaagggacacgacttgagattaagcgaactgtggctgcaccatctgtcttacatcttcccgcctatctgactatatactgtctgacgcgggctgggcaaggccgnatagnnnnnnnnnnnnnnnnnnnnnnnnnnnnnnnnnnnnnnnnnnnnnnn

SEQ ID NO: 181528 - DNA, 602 bp, Homo sapiens
  misc_feature: GYAE6OF01DXQGY.44.70.G04.1.454.CMB.1.raw
  modified_base (230)..(230): a, c, t, g, unknown or other
  misc_feature (230)..(230): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (410)..(410): a, c, t, g, unknown or other
  misc_feature (410)..(410): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtagtctagtgagngtcttggagtcagaacatctatgtggactggtacttgcagaacgccggcagtcnccacaactccngatctagtttcggtccacgtcgggcctccgggtctcgtgacgtaggttcaggtcgccgtagtcgactactacacacaacagtactttccaactactcgacacatcgaagcaaggngtggacggtcgtaggaacgtagttgggttacggggttacttaagtttacgacggtactaacgttaccgtaacgtttaccctaaaccctaaaccccgttcctaacccggttcgggacgaaaccgggaccgtaaccggtacgttagaaggttaacgttaacggacgtaacgtggtacggctcgcctaccgtacg

SEQ ID NO: 181529 - DNA, 581 bp, Homo sapiens
  misc_feature: GYAE6OF01ES0OD.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtcctccacaactcctgatctatttcgggttccacgtcgggccgtccggggtctctgactaggttcagtcgccagtgcatcacacaacagtactttcactactgaccacatcgagacagaggtggaggctaggacgtagttgggtttggggttcttagttactgtactacgtaccgtaagtttacctaacccgtaaccccgttcgtaacccggtttcgggaccgaaacgggtacctaaccggtacgttaggaacgtacgttaaacggacgtaacgtcggtcggactcgccgacctacg

SEQ ID NO: 181530 - DNA, 153 bp, Homo sapiens; identical to SEQ ID NO: 181480
  misc_feature: GYAE6OF01EOWX4.44.70.G04.1.454.CMB.1.raw
  modified_base (153)..(153): a, c, t, g, unknown or other
  misc_feature (153)..(153): n is a, c, g, or t

SEQ ID NO: 181531 - DNA, 153 bp, Homo sapiens; identical to SEQ ID NO: 181480
  misc_feature: GYAE6OF01CFUHW.44.70.G04.1.454.CMB.1.raw
  modified_base (153)..(153): a, c, t, g, unknown or other
  misc_feature (153)..(153): n is a, c, g, or t

SEQ ID NO: 181532 - DNA, 536 bp, Homo sapiens
  misc_feature: GYAE6OF01CGVJG.44.70.G04.1.454.CMB.1.raw
  modified_base (185)..(185): a, c, t, g, unknown or other
  misc_feature (185)..(185): n is a, c, g, or t
  modified_base (337)..(337): a, c, t, g, unknown or other
  misc_feature (337)..(337): n is a, c, g, or t
  modified_base (503)..(503): a, c, t, g, unknown or other
  misc_feature (503)..(503): n is a, c, g, or t
  modified_base (505)..(506): a, c, t, g, unknown or other
  misc_feature (505)..(506): n is a, c, g, or t
  modified_base (508)..(536): a, c, t, g, unknown or other
  misc_feature (508)..(536): n is a, c, g, or t
tcagacagtatatacacgaccggtgctcgatttagtgtagtgtgaagggaaaggggctggagtgggttggccgtattagaaccaaagctgacggtgggacagcagactacgctgcacccgtgaaaggcagattcaccatctcaagagatgattcaaaaagatacggtgtctctgcagatgaaacngcctgaacaccgaggacacagccgtctattctgtctgggattggtttcagttccgggaccaaggggtaaccctggtccaccgtctcctcacgcctccaaccgaagggcccagtcccggtccttccccccgtggccgccctgcctccgaggcncccacctccgagacgccacgacggcccggcccgtgggcctcggcccgttagggaccaaacgggtccctttaacctttcccgtaatttacttaaccgttcggtccgttacggacgggacccggggtcttacgggggaaccgaaacggggccgaaccgtaagtacggnanngnnnnnnnnnnnnnnnnnnnnnnnnnnnnn

SEQ ID NO: 181533 - DNA, 577 bp, Homo sapiens
  misc_feature: GYAE6OF01DC1WM.44.70.G04.1.454.CMB.1.raw
  modified_base (288)..(288): a, c, t, g, unknown or other
  misc_feature (288)..(288): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtcacccctggagacgccggcctccatctcctgtaggtctagtgagagtcttggaggtcagacatctatgtggactggtacttgacagaacgacggcagtcnccacaactcctgatctagtttgggtccacgtcgggccgtccggggtctcgtgactggttcagtcgccagtgcactaccacacactagtactttaccactaactcgaccactatcagcaagaggtggagtcgtagacgtagttggtttgggtacttagttactgactacgtaccgtaacgttacctaacctaaccccgttctaccggttaccgggacgaaacgggaccaacggtacgttagaacggtaattaaacggcgtaacgttcggtacggctacgcgtaccgtacg

SEQ ID NO: 181534 - DNA, 594 bp, Homo sapiens
  misc_feature: GYAE6OF01E1SSM.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctccttgggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagccggcagtctccacactcctgatctatttgggttccacgtcgggcctccggggtctcgtgacgtaggttcagtgcctagtgcactcacacacagtactttccactactgaccacattcgagcaacggaggtgggaggcgtaggacgtagttggttggggttcttaagttactgactacgttaccgtaacgtttaccctaacctaaacccccgttccgtaacccgttacgggaccgaaacgggtaaccgtaccggtacgttaggtaagtaacgttaaacggacgtaaacgttcggtacggacctacggcctaccgtaacg

SEQ ID NO: 181535 - DNA, 216 bp, Homo sapiens
  misc_feature: GYAE6OF01C6J8H.44.70.G04.1.454.CMB.1.raw
  modified_base (213)..(216): a, c, t, g, unknown or other
  misc_feature (213)..(216): n is a, c, g, or t
tcagacagtatatacacgaccggtgctcgatttagtgtagtgtgaagggaaagggggacgtcggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnn

SEQ ID NO: 181536 - DNA, 594 bp, Homo sapiens
  misc_feature: GYAE6OF01B1NCU.44.70.G04.1.454.CMB.1.raw
  modified_base (282)..(282): a, c, t, g, unknown or other
  misc_feature (282)..(282): n is a, c, g, or t
  modified_base (386)..(386): a, c, t, g, unknown or other
  misc_feature (386)..(386): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagacgccggcctccatctcctgtaggtctagtgagagtcttggaggtcagaacatctatgtggactggtacttgcagaagaccggnagtctccacaactcctgatcttagtttcgggtccacgtccgggccgttccggggtctcgtgacgtggttcagtcgccagtcgcatcacacacagtactttcacnctcgacacatcagcaggagtggagctaggacgtagttgggttgggttcttagttacgtcgtactactaccgtaacgttacccttaacccgtaaccccgttccgtaacccgttaccggggaccgtaaacggggtaaccgtacggtaccgttaggaacggtaacgttaacggacgtaacgttcggtacggtaccgtcgaccgaccctacg

SEQ ID NO: 181537 - DNA, 790 bp, Homo sapiens
  misc_feature: GYAE6OF01A5DBG.44.70.G04.1.454.CMB.1.raw
  modified_base (294)..(294): a, c, t, g, unknown or other
  misc_feature (294)..(294): n is a, c, g, or t
  modified_base (402)..(402): a, c, t, g, unknown or other
  misc_feature (402)..(402): n is a, c, g, or t
tcagacagtatatacacgaccggtgctcgatttagtgtagtgtgaagggaaagggactgatcaggactcctcagttcaccttctcacaatgaggctccctgctcagctcctgggctgctaatgctctgggtctcagggtccagtggagatattataatgactcagtctcccctctccctggcccgtcacccctggacgacgcccggcctccatcctccgtgtacggtctagtgagtacgttcgttggacggtcaagaacatctagtggtggtactggttactgcagagaccggnagtcctccgactactcctgactcttagttcgggtaccacgtccgggtccgtccggggttctcgtacgtacgacggttcaggtcgccgtaagtcgactacgtccgaacncgactagtactttaccgactaacgtcgactaactactcgaacggtacctaagggtaacggttacgggaaccgggtaccgttacgggaaaccggttggtttacggggtttacccgggggttactttaaccgtttaacccggtcgtaaccttaaccggttaaccccgttaaacgggttttaccccctaaaccccggttaaaccccccggttttacccggtaaaccccgggtttaccggggtaacccggtaaaacccggggtaacccgttaaacccgggttaaccggtttaaacgggtaaaccggttaaaaccggttaaaccggtacccggttaaaaccgttccgggtaacgggttacccgtaccggtaaccccgtaacgtttaaccccgg

SEQ ID NO: 181538 - DNA, 572 bp, Homo sapiens
  misc_feature: GYAE6OF01ERWZW.44.70.G04.1.454.CMB.1.raw
  modified_base (401)..(401): a, c, t, g, unknown or other
  misc_feature (401)..(401): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctccctctccctggccgtcacccctggacgacgccggcctccatcctcctgtagtctagtgagtagtcttgggagtcagaacatctatgtggactggtacttgcagaagaccgggcacgtctaccacaactcctgatctattcgggtccacgtcggcctcgggtctcgtgacgagttcagtcgctaggtgtacatcacacacagtactttcactactgtcactatcagcagngtggacgcgtagacgtagttggttagggttcttatacgtgactaactacctaagtttcctaacccgtaacccgttccgtaaccgttcgggaccgtaacgggacctaaccggtacttaggaatagttaaacgaccggtaaccgttggacggttccgtacgtacgccgtaacg

SEQ ID NO: 181539 - DNA, 755 bp, Homo sapiens
  misc_feature: GYAE6OF01CMMM8.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcaggtccagtggagatattataatgactcagtcctcccctctccctggcccgtccacccgtggacgacgcccggcctccatcctccgtgtagtctagtgagagttcgttggaggtacagaactatctagtggtggactggttacttgacaaggaacggaccgggcacgtcctaccaactaacctccgtgtacttctttagttttcgggtaccctacggtccggggtcccttccggggtctacgtcgaccgtggttcaggtcgaccgtgtcgccataccgacaacctaagacgttactttacaacctactacgacaaccgtactaccgaacgacgtaaggtaacgggtacgggtacgggaccgttacgggaaccggtttagggtttacggggtttacgggggtttaacctttaacgtttaccggtacgtaacttaaccgttaacccgtttaaaccggttttacccctaaaccccgttaaacccccggtttaccgtaacccgggtttaccggggaaccgtaaaccggggtaccgtaaaccgggttaacgttaggaaacggttaaacgttaaaccggtaccggtaacggttcggttacgtacctccggaaccttccgttaccg

SEQ ID NO: 181540 - DNA, 160 bp, Homo sapiens
  misc_feature: GYAE6OF01ACJPN.44.70.G04.1.454.CMB.1.raw
  modified_base (147)..(147): a, c, t, g, unknown or other
  misc_feature (147)..(147): n is a, c, g, or t
  modified_base (153)..(160): a, c, t, g, unknown or other
  misc_feature (153)..(160): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcncatagnnnnnnnn

SEQ ID NO: 181541 - DNA, 459 bp, Homo sapiens
  misc_feature: GYAE6OF01BV3BA.44.70.G04.1.454.CMB.1.raw
  modified_base (346)..(346): a, c, t, g, unknown or other
  misc_feature (346)..(346): n is a, c, g, or t
  modified_base (357)..(357): a, c, t, g, unknown or other
  misc_feature (357)..(357): n is a, c, g, or t
  modified_base (439)..(440): a, c, t, g, unknown or other
  misc_feature (439)..(440): n is a, c, g, or t
  modified_base (442)..(459): a, c, t, g, unknown or other
  misc_feature (442)..(459): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattatgtgcgagagattcctatcgatacagtagagacgggggcaactggctcgaccctgggccagggaaccctggtcaccgtctcctcacgcctccaccgaagggcccatccggtccttcccccgtggccgccctgcctccaggnccacctcgagngcacagcgcccgtggctcgcctggtcagactactctatatactgtcgtgacggcgggctcggacgaacgggcgactagtagnngnnnnnnnnnnnnnnnnnn

SEQ ID NO: 181542 - DNA, 155 bp, Homo sapiens
  misc_feature: GYAE6OF01C1MXF.44.70.G04.1.454.CMB.1.raw
  modified_base (153)..(155): a, c, t, g, unknown or other
  misc_feature (153)..(155): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnn

SEQ ID NO: 181543 - DNA, 171 bp, Homo sapiens
  misc_feature: GYAE6OF01A1EM0.44.70.G04.1.454.CMB.1.raw
  modified_base (154)..(171): a, c, t, g, unknown or other
  misc_feature (154)..(171): n is a, c, g, or t
tcagacagtatatacacgaccggtgctcgatttagtgtagtgtgaagggaaaggggacacgacttgagattaagcgaactgtggctgcaccatctgtcttcatcttcccgccatctgatatatactgtctgagcgggctggcaaggcgcatagnnnnnnnnnnnnnnnnnn

SEQ ID NO: 181544 - DNA, 152 bp, Homo sapiens; identical to SEQ ID NO: 181497
  misc_feature: GYAE6OF01CL566.44.70.G04.1.454.CMB.1.raw
  modified_base (151)..(152): a, c, t, g, unknown or other
  misc_feature (151)..(152): n is a, c, g, or t

SEQ ID NO: 181545 - DNA, 607 bp, Homo sapiens
  misc_feature: GYAE6OF01AZK9S.44.70.G04.1.454.CMB.1.raw
  modified_base (289)..(289): a, c, t, g, unknown or other
  misc_feature (289)..(289): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtccacccctggagacgccggcctccatcctcctgtacggtctagtgagtagttcttggaggtcaagaacatctatgtggactggtacttgacagaagccggnacgtctccaacactcctagatcgttagtttcggtcccacgtccgggtcctccgggttctcgtcgacgtggttcaggttcgccgtagtcgctaactccaaccacaatacgttacttttaaccacgtcgacactactcaagtccaaggaggtgggacgtcgtaggtacgtaggttggttaggggttacttagttacctgtactacgttaccgtaacgttacctaaccctaaaccccgttctacccgtacgggacgtaacggacctacgtacgttagacgtaagttacgacgtaacgtggtcgactaggcctaacgtctcg

SEQ ID NO: 181546 - DNA, 154 bp, Homo sapiens; identical to SEQ ID NO: 181478
  misc_feature: GYAE6OF01CEWIU.44.70.G04.1.454.CMB.1.raw
  modified_base (153)..(154): a, c, t, g, unknown or other
  misc_feature (153)..(154): n is a, c, g, or t

SEQ ID NO: 181547 - DNA, 826 bp, Homo sapiens
  misc_feature: GYAE6OF01E4IKF.44.70.G04.1.454.CMB.1.raw
  modified_base (250)..(250): a, c, t, g, unknown or other
  misc_feature (250)..(250): n is a, c, g, or t
  modified_base (284)..(284): a, c, t, g, unknown or other
  misc_feature (284)..(284): n is a, c, g, or t
  modified_base (364)..(364): a, c, t, g, unknown or other
  misc_feature (364)..(364): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcaccctggagacgccggcctccatctcctgtacggtctagtgagagtcttgggagtcagaacntctatggtggtactggtacttgcagagaccgggnagtctccacactcctgatcttatttcgggtacctacgtcgggtccgtccggggtctctaggacgtacggttcagtcgccnggtagctatcgaccaccactaggtactttaccaaccgtaacgtcggtaccacctaagttcccgaaggtaccgtaacgggtaacggttacggggggtaacggtacggtaacgggtaacccggggttaaaggttttcggggggtttccggggggttttaaccgtttaacggttttaaccttcgggtaaacccgttaaccgtttaacccccggttaaaacggttttaacccccgtttaaaccccgtttaaaaccccccccggtttacccggttaaaccccccggtttaacccgggggggtaacccgtaaaaacccgggggggtaacccgttaaacccgggttaacccggttttaacggggaaacggtttaaaccgggtttaaaaccgggaacccggttttaaacccgggtcgggtttacccggggttacccgtacggttacccccggtaaaccccgtttaaccgg

SEQ ID NO: 181548 - DNA, 152 bp, Homo sapiens
  misc_feature: GYAE6OF01EPAFL.44.70.G04.1.454.CMB.1.raw
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
tcagacagtatatacacgaccggtgctcgatttagtgtagtgtgaagggaaaggacacgacttgagattaagcgaactgtggctgcaccatctgtcttcatcttcccgccatctgatatatactgtctgagcgggctggcaaggcncatagn

SEQ ID NO: 181549 - DNA, 153 bp, Homo sapiens; identical to SEQ ID NO: 181480
  misc_feature: GYAE6OF01BIPLE.44.70.G04.1.454.CMB.1.raw
  modified_base (153)..(153): a, c, t, g, unknown or other
  misc_feature (153)..(153): n is a, c, g, or t

SEQ ID NO: 181550 - DNA, 175 bp, Homo sapiens
  misc_feature: GYAE6OF01DDZVF.44.70.G04.1.454.CMB.1.raw
  modified_base (150)..(150): a, c, t, g, unknown or other
  misc_feature (150)..(150): n is a, c, g, or t
  modified_base (157)..(175): a, c, t, g, unknown or other
  misc_feature (157)..(175): n is a, c, g, or t
tcagacagtatatacacgaccggtgctcgatttagtgtagtgtgaagggaaagggacacgacttgagattaagcgaactgtggctgcaccatctgtcttcatcttcccgcatctgatatatactgtctaggacgcgggtctggcaaggcnctaatgnnnnnnnnnnnnnnnnnnn

SEQ ID NO: 181551 - DNA, 516 bp, Homo sapiens
  misc_feature: GYAE6OF01AS8O4.44.70.G04.1.454.CMB.1.raw
  modified_base (359)..(359): a, c, t, g, unknown or other
  misc_feature (359)..(359): n is a, c, g, or t
  modified_base (486)..(516): a, c, t, g, unknown or other
  misc_feature (486)..(516): n is a, c, g, or t
tcagacagtatatacacgaccggtgctcgatttagtgtagtgtgaagggaaagggactggagtggattgggcgcatctataacagtggcagcaccaactacaacccccgccctcaagagtcgagtcaccatgtcactagacaggtccaagaaccagttctccctgaaattgacttctgtgaccgccgcggacacggccgtatattattgtgcgagagattcctatcgatacagtagaggacggggggcaactggctcgaccccgtggggccagggaaccctggtccaccgtctcctcacgcctccaccaacggcccagtccggtccttccccgtggtccaccctcctaccaagacgccnccgtcgtgggggccacgacggccggcccgtggggctcggccgtggtaccgaacggtacctacctttacctaattacgtaccttgtcctggacggtcgggtcgtcggacgaacggtcgacgaatagcnnnnnnnnnnnnnnnnnnnnnnnnnnnnnnn

SEQ ID NO: 181552 - DNA, 216 bp, Homo sapiens
  misc_feature: GYAE6OF01A0KWF.44.70.G04.1.454.CMB.1.raw
  modified_base (211)..(216): a, c, t, g, unknown or other
  misc_feature (211)..(216): n is a, c, g, or t
tcagacagtatatacacgaccggtgctcgatttagtgtagtgtgaagggaaagggggacgtcggtcaccgtctcctcagcttccaccaaggcccatcggtcttcccctggcgccctgctccaggagcacctctgggggcacagcggcctgggctgcctggtcaaggactacttcctatatactgtctgagcgggctggcaaggcgcatagnnnnnn

SEQ ID NO: 181553 - DNA, 606 bp, Homo sapiens
  misc_feature: GYAE6OF01A5SPJ.44.70.G04.1.454.CMB.1.raw
  modified_base (289)..(289): a, c, t, g, unknown or other
  misc_feature (289)..(289): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggcccgtcacccctggagcgccggcctccatctcctgtaggtctagtgagagtcttggaggtcagaacatctatgtggactggtacttgcagaacgaccgggcagtcnccacaactcctgatcttagtttcgggttcccacccgggtccgtccgggtctctgactaggttcagtcgccgagtgcactcacacacagtactttacacactgaccacactcacgacgagaggtgggacggcgtaggacggtagtagggtttcggggttacttagttacgtcgtactacgtacctaacgtttacccgtaaacccttaaacccccggttacctacccggtttcgggacgaacgggtaccaccggtaacgttggaagtaacgttaacggaccgtaacgtcgggtcggcgttacgaccctaccgtgttccg

SEQ ID NO: 181554 - DNA, 545 bp, Homo sapiens
  misc_feature: GYAE6OF01AC11X.44.70.G04.1.454.CMB.1.raw
  modified_base (438)..(438): a, c, t, g, unknown or other
  misc_feature (438)..(438): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
  modified_base (523)..(545): a, c, t, g, unknown or other
  misc_feature (523)..(545): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctcccttaatatacgttctgtgaccgcccgccggacgaccgaccggtactattattagttgcgacgagattacttactgagtacctaagtaggtaggacgggggggtaccggggacgtaggtcgtccgacccccggtcgggccggaacggaaccggtccgtggacccgtccgtccttccagccgtcccaccaacggcccgctcggttccgttcccccgtccgtcgacccctccctacgaacgactcgacctcgtcggggcgacacgcggcccgcggcgtcnccggngtcgaacgacgtccttaccttntaactattcgtcgtacggcgtaccgggcgtcgggacgtagggacgttccgataacgcnnnnnnnnnnnnnnnnnnnnnnn

SEQ ID NO: 181555 - DNA, 897 bp, Homo sapiens
  misc_feature: GYAE6OF01BPE7A.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctccgtggggctgctaatgctcgtgggtctcgagggtccaggtggagtattattaataacgtgtactactcgtcccttccccttccgttcccggtccggtcccgtacccgtacccggtaggaacggaccggcccgtcctacctcgttccttaccgtaggttacgttacgttaggtaggagttacggttcggtagggtacgtacgtaacgaactacttacgttagttagggtacgtacggttacggttactacggacggaaacggaaccggaccgggtaccttacgtaccctaaccgaaccttaccgttacgtacgttactttacgtttacggtttccggtaccgtccggtcccgggttccggtcggttctacgtacgtacggtcggtacgagtccgacgtaggtcacgtactacgaccgtacgaaacgtcgttaaccttacaccgttagtaccgtaaccaacgttccgaagaacgtagggtaaccgggttaggggtaaccgggtcttaccgggttacgggtaaaggtttccggggttttaggggtttaacgtttaacttaacgggttcccgtacgtttaaaccgtaaccccgtttaaccgtttaaccccggtaaaacccccgtttacccccggtttaccggtaacccccgggttaggaaaccggggtaaacccggtaaccgttaaaccggttacggtttaaagggtaaaccgtttaacgggttaaaccggaccggtttaaacgggtcgggttacccgtccggtaacctacccggtaagttccggttacgg

SEQ ID NO: 181556 - DNA, 155 bp, Homo sapiens
  misc_feature: GYAE6OF01BBYRF.44.70.G04.1.454.CMB.1.raw
  modified_base (147)..(147): a, c, t, g, unknown or other
  misc_feature (147)..(147): n is a, c, g, or t
  modified_base (153)..(155): a, c, t, g, unknown or other
  misc_feature (153)..(155): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcncatagnnn

SEQ ID NO: 181557 - DNA, 152 bp, Homo sapiens
  misc_feature: GYAE6OF01EWFV1.44.70.G04.1.454.CMB.1.raw
tcagacagtatatacacgaccggtgctcgatttagtgtagtgtgaagggaaagggaccaaggtggaaatcaaacgaactgtgactgcaccatctgtcttcatcttcccgccatctgatatatactgtctgagcgggctggcaaggcgcatag

SEQ ID NO: 181558 - DNA, 677 bp, Homo sapiens
  misc_feature: GYAE6OF01DIUM2.44.70.G04.1.454.CMB.1.raw
  modified_base (536)..(536): a, c, t, g, unknown or other
  misc_feature (536)..(536): n is a, c, g, or t
tcagacagtatatacacgaccggtgctcgatttagtgtagtgtgaagggaaaggggactgatcaggactcctcagttcaccttctcacaatgaggctccctgctcagctccgtggggctgctaatgctctgggtctcgagggtccaggtggatattacttaataatgactcacgtcctcccctctccctcggcctccacccgtggaagcgcccgcctccattcctccgtggttacgtctaggtagagtacgttcgttgggacggtacaagaactattctagtggttacggacgttggtacttggacgaaggaaccggaccggctacgttcctaccaactaactcctagtacttattcggtttcggtcctacggtccgggtccgtccgggtctcgtagtacgttcggtcagtcacgtgtacgactacgtacaccgatactagttacttaccactactcgactaatctaccgagaccgaagggttagcgggtagtcgtacgttacggtgggtttcgggtttacggttacttagttacngtaaccgtacttaacccgttaacgttaccctaaccccgttaacccgttcgtacccggttacgggaacgtaaccggctacggttaacgtaggtaacgttaagaaccggtacgtaagttcggtacgacctcgaccgttgtacg

SEQ ID NO: 181559 - DNA, 501 bp, Homo sapiens
  misc_feature: GYAE6OF01BOGOO.44.70.G04.1.454.CMB.1.raw
  modified_base (347)..(347): a, c, t, g, unknown or other
  misc_feature (347)..(347): n is a, c, g, or t
  modified_base (466)..(466): a, c, t, g, unknown or other
  misc_feature (466)..(466): n is a, c, g, or t
  modified_base (470)..(501): a, c, t, g, unknown or other
  misc_feature (470)..(501): n is a, c, g, or t
tcagacagtatatacacgaccggtgctcgatttagtgtagtgtgaagggaaaggggctggagtgggtctcaggtattaataccggtggtgggacatactacgcagactccgtgaagggccgattcaccatctccagagacaagtccaagaatacggtgtatcttcaattgagcagcctgagagccgaggacgcggccgtatattactgtgcgagagtgggcggagctactccttctactattactactacatggacttcgtaggggaaaagggaccacggtcaccgtctcctcagcttccaccacgggcccatccggtccttccccctggccgccctgctccaggcnccacctcgtggggcacgacggccggcccgtggctgcctggtccgaaggtacctacgttccaccggttctaaccgtgtcgtcggacggtccgggcgtcgggcgaaagggccgacaagtgnacgnnnnnnnnnnnnnnnnnnnnnnnnnnnnnnnn

SEQ ID NO: 181560 - DNA, 574 bp, Homo sapiens
  misc_feature: GYAE6OF01BFPZO.44.70.G04.1.454.CMB.1.raw
  modified_base (350)..(350): a, c, t, g, unknown or other
  misc_feature (350)..(350): n is a, c, g, or t
  modified_base (406)..(406): a, c, t, g, unknown or other
  misc_feature (406)..(406): n is a, c, g, or t
  modified_base (537)..(537): a, c, t, g, unknown or other
  misc_feature (537)..(537): n is a, c, g, or t
  modified_base (540)..(574): a, c, t, g, unknown or other
  misc_feature (540)..(574): n is a, c, g, or t
tcagacagtatatacacgaccggtgctcgatttagtgtagtgtgaagggaaagggactggagtggattgggcgcatctataacagtggcagcaccaactacaacccccgccctcaagagtcgagtcaccatgtcactagacaggtccaagaaccagttctccctgaaattgacttctgtgaccgccgcggacacggccgtatattattgtgcgagagtattcctatcgatacagtagaggacggggggcgaacgtggcctcgaccccgtggggaccacgggaccctggtccaccgtctccctcacgcctaccaccgaacggccccatccggtccctcccccgtcggcccncccctcctccgaagacgcccgacctcggtcgggggccacgacggcccggtccccgnggggcctcggcccgttacggacgtaaacgggtaccttacccgttttaccctaagttactaaccgtttcggttaaccgtcggggacggtccggggtcgttagggacccgaaacgggcccgactaagtaaggncgnnnnnnnnnnnnnnnnnnnnnnnnnnnnnnnnnnn

SEQ ID NO: 181561 - DNA, 660 bp, Homo sapiens
  misc_feature: GYAE6OF01BSREN.44.70.G04.1.454.CMB.1.raw
  modified_base (303)..(303): a, c, t, g, unknown or other
  misc_feature (303)..(303): n is a, c, g, or t
tcagacagtatatacacgaccggtgctcgatttagtgtagtgtgaagggaaaggggactgatcaggactcctcagttcaccttctcacaatgaggctccctgctcagctcctgggctgctaatgctctgggtctcagggtccagtggagatattataatgactcagtcctcccctctccctggccgtcaccccgtggagacgcccggcctccatctcctgtagtctagtgagagttcttgggagtcaagaacatctatgtgactgtactgcaggaacgaccggcagtctaccactaactcctnacttcgttagtttcgggtcctaccggtccgggtcccgttccggggttctcgtcgaacgtacggttcagtcgacccgtaggtccgacgtaactaccctacgaaccctaaagacgttactttacccaacgtaacgttccggaccacgtaactacgtacggaacgaaggtaggtaccgggacggtacgtacggaacgtttaggttcgggtttaggggtttaaccttacgttacgttcgtacgtaacctaccgttaagttaccccttaaacccgtaacccgttcctaaccggtcgggaaacgaaccggacacgttacggtagaggtaagtaacgaccgtagtaggcagtcgccacgttacg

SEQ ID NO: 181562 - DNA, 852 bp, Homo sapiens
  misc_feature: GYAE6OF01ER1B3.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcgagggtcagtggagatattataatgactcagtcctcccctctccctggccgtcacccgtggagacgcccggcctccatcctcgtgtaggtctagtagagagtcgttgggaggtcaagaactatctaagtgtaggtactaggttacttgacaaggaaacggaccgggcacggtcctaccgaactaacctcctagacttcgttaagtttcgggttacccacggtccgggtcccgttccggggtctcgtacgactacggttacacggtcgaccgtaggtcgaccatccgaactaaccaacgtacgttaacttttaccaaccgtacgtacgacccaaacgtactaccgaaggaccgtaaagggtacgggttacggggaacgggtccgttacggtaacgggtaggtttacggggtttacggggtttacttaaacgtttacgtacggtaaccttaacgttaacccgtttaaaccgtttaaccccgttaaaacccccgtttaaaaccccccgggtttacccgttaaaccccggggtttaccggggtaaaaccgggtaaaaccggggtaaacccgttaaaccccggggttaaaacggttttaagggaaaccggggttttaaaaacttttaaaccggggggaacccttttaaaacccggggtttcgggggtttaaaccggtacccggtttaacccgggtaaacccctaacccggtttaaacccgg

SEQ ID NO: 181563 - DNA, 846 bp, Homo sapiens
  misc_feature: GYAE6OF01D94MW.44.70.G04.1.454.CMB.1.raw
tcagacagtatatacacgaccggtgctcgatttagtgtagtgtgaagggaaagggactgatcaggactcctcagttcaccttctcacaatgagctccctgctcagctccgtggggctgtctaatcgcgttcgtgggtctacggtacgggtccaggtggaatattattaatatgactcacgttccctcccctcctcccgtggcccgtccacccgtaggacgaccggcccgtaccctcctacttccgtccgttaggtacgtcttaaggtcgtaaggtcgtttcgttacgggacgttacgaacgaaacttattcgtaagttcggtaggttaccgttaggttaccttggacgaaacggaaccggtaccgggtctaaccgttccaaccgtaaacctaaccgtttccgtaagttacgtttccggttttacggttttcccgggtaccttaaccgggttcccggggttccccggtttcccggggtttccttaccgtaggtaaaccggtttacggttacctaacgggttctccccggtaagtacccgtaacttaccgtaacgaaacccacgttaagtaactttccgttaacccaactaaccgtcctaacctacctacgtaacgcgtaacggtaacggtagggtacggacggttacggtacgtagggttacggttttacgggtcggtttaacttacgtttacgacgttactaaccgtacccgttaaacgttacccgtaaaccccgttaaccggttacccgtaccggtaaccgggacgtaaccggtaaccgtaaccgttgtaaggtaacgtaaagttacgtacggtaacgtcgtccggattacggtcctacgttccg

SEQ ID NO: 181564 - DNA, 627 bp, Homo sapiens
  misc_feature: GYAE6OF01BJVYD.44.70.G04.1.454.CMB.1.raw
  modified_base (196)..(196): a, c, t, g, unknown or other
  misc_feature (196)..(196): n is a, c, g, or t
  modified_base (278)..(278): a, c, t, g, unknown or other
  misc_feature (278)..(278): n is a, c, g, or t
  modified_base (546)..(546): a, c, t, g, unknown or other
  misc_feature (546)..(546): n is a, c, g, or t
  modified_base (578)..(578): a, c, t, g, unknown or other
  misc_feature (578)..(578): n is a, c, g, or t
  modified_base (582)..(582): a, c, t, g, unknown or other
  misc_feature (582)..(582): n is a, c, g, or t
  modified_base (584)..(587): a, c, t, g, unknown or other
  misc_feature (584)..(587): n is a, c, g, or t
  modified_base (589)..(591): a, c, t, g, unknown or other
  misc_feature (589)..(591): n is a, c, g, or t
  modified_base (595)..(596): a, c, t, g, unknown or other
  misc_feature (595)..(596): n is a, c, g, or t
  modified_base (598)..(599): a, c, t, g, unknown or other
  misc_feature (598)..(599): n is a, c, g, or t
  modified_base (604)..(604): a, c, t, g, unknown or other
  misc_feature (604)..(604): n is a, c, g, or t
  modified_base (606)..(606): a, c, t, g, unknown or other
  misc_feature (606)..(606): n is a, c, g, or t
  modified_base (608)..(612): a, c, t, g, unknown or other
  misc_feature (608)..(612): n is a, c, g, or t
  modified_base (614)..(614): a, c, t, g, unknown or other
  misc_feature (614)..(614): n is a, c, g, or t
  modified_base (616)..(622): a, c, t, g, unknown or other
  misc_feature (616)..(622): n is a, c, g, or t
  modified_base (624)..(627): a, c, t, g, unknown or other
  misc_feature (624)..(627): n is a, c, g, or t
tcagacagtatatacacgaccggtgctcgatttagtgtagtgtgaagggaaagggactggagtggattggggcgcatctataacagtggcagcaccaactacaaccccgccctcaagagtcgagtcaccatgtcactagacaggtccaagaaccagttctccctgtaaacttgtacttctgtgaccgcgcggaacncggaccttattacgttatttaggtcgacgtaggagtacttcctagtacgattaacgaggtaaggacgggaaccggggggganaacgtacggccgtccggaccccgtggggaccccgtaacggggaacccgtcggcctaaccggtcctaccgtacaccggccccgttacccaaaccggaaccggacccgtacgtttaccggtacccctttcccccgtacggccctaccccgttcctaacccgagaccgactacccgttcggcgggtaaccacgacggccggtaccgtcgggctacggccgttagtacgaacggttacctacttacctaagttaacgtccgtacggttacgngtacgggacggtcgtaggaccgaagcgactanagcngnnnncnnntcgnncnnctcancngnnnnncnannnnnnnannnn

SEQ ID NO: 181565 - DNA, 866 bp, Homo sapiens
  misc_feature: GYAE6OF01AQDZA.44.70.G04.1.454.CMB.1.raw
tcagacagtatatacacgaccggtgctcgatttagtgtagtgtgaagggaaaggggactgatcaggactcctcagttcaccttctcacaatgaggctcctgctcagctccgtggggctgctaatgctcgtgggtctcgagggtcaggtggatattattataatgacctcgagtccttccctcgtcccgtggacccgtaccacccgtgggacgacggccggtcctctacttccttccgttggtacggttctaggtgtaagtggttcgtagggtaggtacgaaacggtaactcttacgttagtggttacgggtacgttacggttacgttcggacgaacggaaaccgggtaccgggtacctacggtccctaacctaaccgtaccgttccgtacgtactttacggtttacggtttccgggttaccgtacgggtcccgggtaccggttcccggggttctcggtacgtaccggttacgtcggtacgtccggacgtacgtcacgtactaccgaacgaacctaacggtaccttacgtttaaccgacccgtttacggtacccaaccgtaacttacggtacgtaacgggtacggtaacgggtacgggtacgggtaacggtcgggttacggtaacgggtttacgggtttcggggttaacgggttactttacggtttaaccgtcgtaccgttaaccgttaaacccggttaacgtttaaccccgtttaaccccgttaaccccggttaccttaacccggggttaacgggtaaccggtaaaccgtaacggtaccggtttaacgtaacggttaacggttacggttaaaccggtacgtaaccggttacgggtaccggtaaccgtcctaaacggttaccttccg

SEQ ID NO: 181566 - DNA, 736 bp, Homo sapiens
  misc_feature: GYAE6OF01ADEBU.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctccgtgggactgctaatcgctcgtgggtcctacgacgggtaccaggtaggatattaattaactaacgtcgtactccgacgttccctccccttccgtcccgtcggtcccgtccacccgtggacgaccggccgtcctactactccgtcgtaggtacgtcgtagtcgacgtcgttcgttggacgtacaagacctagtacgttaggtcggtacgtaccgttacgtacgtacggacggaacggtaccgggtaccgactacgtaccctaacctaacctcgttactacgttacgtttacggtttaccggtttaccggtaccggtaccgggttcccgggtcccggttaccgtcgttacgacggttacggtacgtcgtcgtacgaccgtacgtaccgactactacccgaactacgtaacgtcttacctacgacgtacgacgactacgacgtacgagtaggtacggtacggcgtacggtactaaggttacgttggttacggttacgtactacgtcgtctacgtaccgtacgttaccgttacctacccgtaccgtacgtaccggtacgaccgtacgtacgtacggtacgtagacgttacggtacgtcgttacgtcggactaacgtctaccgttcgtccg

SEQ ID NO: 181567 - DNA, 613 bp, Homo sapiens
  misc_feature: GYAE6OF01A6O73.44.70.G04.1.454.CMB.1.raw
  modified_base (149)..(149): a, c, t, g, unknown or other
  misc_feature (149)..(149): n is a, c, g, or t
  modified_base (249)..(249): a, c, t, g, unknown or other
  misc_feature (249)..(249): n is a, c, g, or t
  modified_base (283)..(283): a, c, t, g, unknown or other
  misc_feature (283)..(283): n is a, c, g, or t
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (444)..(444): a, c, t, g, unknown or other
  misc_feature (444)..(444): n is a, c, g, or t
  modified_base (503)..(503): a, c, t, g, unknown or other
  misc_feature (503)..(503): n is a, c, g, or t
  modified_base (599)..(599): a, c, t, g, unknown or other
  misc_feature (599)..(599): n is a, c, g, or t
tcagacagtatatacacgaccggtgctcgatttagtgtagtgtgaagggaaagggactgatcaggactcctcagttcaccttctcacaatgaggctcctgctcagctcctggggctgctaatcgctctgggtctcagggtccagtgganatattagtaatgactcagtcctccctctccctgccgtcaccctgagcgccggcctccatctcctgtagtctagtgagcgttcgttggaggtcagtaactntctatggtggacttggtacttgcaagagaccggnacgtcctaccaatacctcgngtacttcttagttttcggtacctacggtccgggtccttaccggggtctctacggtacctggtcgtaggtcgaccgagtcgactacnccgtaacacctacgaagttacttaccaacgacgtgacctaanacgtacgtaacgngtaaggtagtgggacgtctagggtacctagttcggttagggtcttaacttagtaccgtntaactaccgtacgtttacccaaccttaacccgtcgtaaccgtccggactaacgggactaacccgtgtacgtaagtacgttacgaccgtaatcggtnacgttcagtctaac

SEQ ID NO: 181568 - DNA, 150 bp, Homo sapiens
  misc_feature: GYAE6OF02FYOXZ.44.70.G04.1.454.CMB.1.raw
tcagacagtatatacacgaccggtgctcgatttagtgtagtgtgaaggaagggacacgacttgagattaagcgaactgtggctgcaccatctgtcttcatcttcccgccatctgatatatactgtctgagcgggctggcaaggcgcatag

SEQ ID NO: 181569 - DNA, 152 bp, Homo sapiens
  misc_feature: GYAE6OF02F6GFR.44.70.G04.1.454.CMB.1.raw
  modified_base (152)..(152): a, c, t, g, unknown or other
  misc_feature (152)..(152): n is a, c, g, or t
tcagacagtatatacacgaccggtgctcgatttagtgtagtgtgaagggaagggacacgacttgagattaagcgaactgtggctgcaccatctgtcttcatcttcccgccatctgatatatactgtctgagcgggctggcaaggcgcatagn

SEQ ID NO: 181570 - DNA, 153 bp, Homo sapiens; identical to SEQ ID NO: 181480
  misc_feature: GYAE6OF02GYABH.44.70.G04.1.454.CMB.1.raw
  modified_base (153)..(153): a, c, t, g, unknown or other
  misc_feature (153)..(153): n is a, c, g, or t

SEQ ID NO: 181571 - DNA, 152 bp, Homo sapiens; identical to SEQ ID NO: 181569
  misc_feature: GYAE6OF02F86MJ.44.70.G04.1.454.CMB.1.raw
  modified_base (152)..(152): a, c, t, g, unknown or other
  misc_feature (152)..(152): n is a, c, g, or t

SEQ ID NO: 181572 - DNA, 160 bp, Homo sapiens
  misc_feature: GYAE6OF02GCZFP.44.70.G04.1.454.CMB.1.raw
  modified_base (152)..(160): a, c, t, g, unknown or other
  misc_feature (152)..(160): n is a, c, g, or t
tcagacagtatatacacgaccggtgctcgatttagtgtagtgtgaagggaagggacacgacttgagattaagcgaactgtggctgcaccatctgtcttcatcttcccgccatctgatatatactgtctgagcgggctggcaaggcgcatagnnnnnnnnn

SEQ ID NO: 181573 - DNA, 152 bp, Homo sapiens; identical to SEQ ID NO: 181569
  misc_feature: GYAE6OF02FL8YJ.44.70.G04.1.454.CMB.1.raw
  modified_base (152)..(152): a, c, t, g, unknown or other
  misc_feature (152)..(152): n is a, c, g, or t

SEQ ID NO: 181574 - DNA, 166 bp, Homo sapiens
  misc_feature: GYAE6OF02HZRVZ.44.70.G04.1.454.CMB.1.raw
  modified_base (155)..(166): a, c, t, g, unknown or other
  misc_feature (155)..(166): n is a, c, g, or t
tcagacagtatatacacgaccggtgctcgatttagtgtagtgtgaagggaaagggacgacgacttgagattaagcgaacgtgtggctgcaccatctgtcttcatcttcccgccatctgatatatactgtctgagcgggctggcaaggcgcatagnnnnnnnnnnnn

SEQ ID NO: 181575 - DNA, 214 bp, Homo sapiens
  misc_feature: GYAE6OF02IO0NV.44.70.G04.1.454.CMB.1.raw
  modified_base (211)..(214): a, c, t, g, unknown or other
  misc_feature (211)..(214): n is a, c, g, or t
tcagacagtatatacacgaccggtgctcgatttagtgtagtgtgaagggaaaggggacgtcggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnn

SEQ ID NO: 181576 - DNA, 154 bp, Homo sapiens; identical to SEQ ID NO: 181478
  misc_feature: GYAE6OF02GY7GR.44.70.G04.1.454.CMB.1.raw
  modified_base (153)..(154): a, c, t, g, unknown or other
  misc_feature (153)..(154): n is a, c, g, or t

SEQ ID NO: 181577 - DNA, 159 bp, Homo sapiens
  misc_feature: GYAE6OF02JDM0T.44.70.G04.1.454.CMB.1.raw
  modified_base (152)..(159): a, c, t, g, unknown or other
  misc_feature (152)..(159): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgctgagcgggctggcaaggcgcatagnnnnnnnn

SEQ ID NO: 181578 - DNA, 190 bp, Homo sapiens
  misc_feature: GYAE6OF02IIV7H.44.70.G04.1.454.CMB.1.raw
  modified_base (158)..(190): a, c, t, g, unknown or other
  misc_feature (158)..(190): n is a, c, g, or t
tcagacagtatatacacgaccggtgctcgatttagtgtagtgtgaagggaaaggggacacgacgttgagattaagcgaactgtggctggcaccatctgtcttcatccttccgccatcctcgatatatactgtctgagcgggctggcaaggcgcatagnnnnnnnnnnnnnnnnnnnnnnnnnnnnnnnnn

SEQ ID NO: 181579 - DNA, 496 bp, Homo sapiens
  misc_feature: GYAE6OF02GSHXU.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctattactgcatccaagttctacaaacccgttcaccttcgggcagggacacgacttgagattaagcgaactgtggctgcactac

SEQ ID NO: 181580 - DNA, 171 bp, Homo sapiens
  misc_feature: GYAE6OF02IFI2S.44.70.G04.1.454.CMB.1.raw
  modified_base (155)..(171): a, c, t, g, unknown or other
  misc_feature (155)..(171): n is a, c, g, or t
tcagacagtatatacacgaccggtgctcgatttagtgtagtgtgaagggaaagggacacgacttggagattaagcgaactggtggctgcaccatctgtcttcatcttcccgccactctgatatatactgtctgagcggctggcaaggcgcatagnnnnnnnnnnnnnnnnn

SEQ ID NO: 181581 - DNA, 154 bp, Homo sapiens; identical to SEQ ID NO: 181478
  misc_feature: GYAE6OF02IRHHT.44.70.G04.1.454.CMB.1.raw
  modified_base (153)..(154): a, c, t, g, unknown or other
  misc_feature (153)..(154): n is a, c, g, or t

SEQ ID NO: 181582 - DNA, 153 bp, Homo sapiens; identical to SEQ ID NO: 181480
  misc_feature: GYAE6OF02IWLEO.44.70.G04.1.454.CMB.1.raw
  modified_base (153)..(153): a, c, t, g, unknown or other
  misc_feature (153)..(153): n is a, c, g, or t

SEQ ID NO: 181583 - DNA, 158 bp, Homo sapiens
  misc_feature: GYAE6OF02GIEW9.44.70.G04.1.454.CMB.1.raw
  modified_base (153)..(158): a, c, t, g, unknown or other
  misc_feature (153)..(158): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnnnnn

SEQ ID NO: 181584 - DNA, 549 bp, Homo sapiens
  misc_feature: GYAE6OF02ISY06.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggtccacgtcgggcctccggggtctctgacaggttcagtcgccagtgcatcacacacagtatttcacactgcacatcagcagagtggaggctgacgagttggttggggtctagttacgtgactactacctaagttcctaaccgtaaaccccgttacacccgttcgggaccgaacgggaccaccggtacgttacggaagtaagttaacggacgtaacgtggtacggcgtcggaccacctacg

SEQ ID NO: 181585 - DNA, 166 bp, Homo sapiens
  misc_feature: GYAE6OF02II7P8.44.70.G04.1.454.CMB.1.raw
  modified_base (154)..(166): a, c, t, g, unknown or other
  misc_feature (154)..(166): n is a, c, g, or t
tcagacagtatatacacgaccggtgctcgatttagtgtagtgtgaagggaaagggacacgacttgagattaagcgtaactgtggctgcaccatctgtcttcatcttcccgccagtctgatatatactgtctgagcggctggcaaggcgcatagnnnnnnnnnnnnn

SEQ ID NO: 181586 - DNA, 152 bp, Homo sapiens
  misc_feature: GYAE6OF02HTCI0.44.70.G04.1.454.CMB.1.raw
  modified_base (151)..(152): a, c, t, g, unknown or other
  misc_feature (151)..(152): n is a, c, g, or t
tcagacagtatatacacgaccggtgctcgatttagtgtagtgtgaagggaaagggacacgacttgagattaagcgaactgtggctgcaccatctgtcttcatcttcccgccatctgataaactgtctgagcgggctggcaaggcgcatagnn

SEQ ID NO: 181587 - DNA, 181 bp, Homo sapiens
  misc_feature: GYAE6OF02F7N2K.44.70.G04.1.454.CMB.1.raw
  modified_base (153)..(181): a, c, t, g, unknown or other
  misc_feature (153)..(181): n is a, c, g, or t
tcagacagtatatacacgaccggtgctcgatttagtgtagtgtgaagggaaagggacacgacttgagattaagcgaactgtggctgcaccatctgtcttcatcttcccgccatctgatatatactgtctgagcgggctggcaaggcgcatagnnnnnnnnnnnnnnnnnnnnnnnnnnnnn

SEQ ID NO: 181588 - DNA, 153 bp, Homo sapiens; identical to SEQ ID NO: 181480
  misc_feature: GYAE6OF02I67Z2.44.70.G04.1.454.CMB.1.raw
  modified_base (153)..(153): a, c, t, g, unknown or other
  misc_feature (153)..(153): n is a, c, g, or t

SEQ ID NO: 181589 - DNA, 508 bp, Homo sapiens
  misc_feature: GYAE6OF02IQPMI.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgaatcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatggttggggtctagttactgcatcctaagttctaacctaaacccgttcaaccgttcgggacagggacacgtacttgagtattaagacgaactgtggctgcactac

SEQ ID NO: 181590 - DNA, 153 bp, Homo sapiens; identical to SEQ ID NO: 181480
  misc_feature: GYAE6OF02HIMI1.44.70.G04.1.454.CMB.1.raw
  modified_base (153)..(153): a, c, t, g, unknown or other
  misc_feature (153)..(153): n is a, c, g, or t

SEQ ID NO: 181591 - DNA, 510 bp, Homo sapiens
  misc_feature: GYAE6OF02G8S0R.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcattctccacaactcctgatctatttgggttccactcgggcctccggggtctctgacaggttcagtgccagtgcatcacacacagatttcacactgcacatcagcagagtggaggctgacgatggttggggtctattactgcatccaagttctaacctaaaccccgttcaaccgttcgggacacgggacacggacttgagtattaagacgtaactggtgctgcacctac

SEQ ID NO: 181592 - DNA, 496 bp, Homo sapiens
  misc_feature: GYAE6OF02F55YP.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctattactgcatccaagttctacaacccgttcaccttcggcagggacacgcttagagtattaagcgaactgtaggctgcactac

SEQ ID NO: 181593 - DNA, 191 bp, Homo sapiens
  misc_feature: GYAE6OF02GKTKF.44.70.G04.1.454.CMB.1.raw
  modified_base (148)..(148): a, c, t, g, unknown or other
  misc_feature (148)..(148): n is a, c, g, or t
  modified_base (154)..(191): a, c, t, g, unknown or other
  misc_feature (154)..(191): n is a, c, g, or t
tcagacagtatatacacgaccggtgctcgatttagtgtagtgtgaagggaaagggtacgacgacttgagattaagcgaactgtggctgcaccatctgtcttcatcttcccgccatctgatatatactgtctgagcggctggcaaggcncatagnnnnnnnnnnnnnnnnnnnnnnnnnnnnnnnnnnnnnn

SEQ ID NO: 181594 - DNA, 491 bp, Homo sapiens
  misc_feature: GYAE6OF02GZAFJ.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcaggtctccacaactcctgatctatttgggttccaactcgggcctccggggtctctgacaggttcagtgccagtgcatcacacacagatttcacactgcacatcagcagagtggagctgacgatgttgggtctatactgcatcaagttctacaacccgtcaccgttcggcaggacacgactgagattaagcgaactgtggctgcactacg

SEQ ID NO: 181595 - DNA, 509 bp, Homo sapiens
  misc_feature: GYAE6OF02JG1AT.44.70.G04.1.454.CMB.1.raw
  modified_base (424)..(424): a, c, t, g, unknown or other
  misc_feature (424)..(424): n is a, c, g, or t
  modified_base (499)..(499): a, c, t, g, unknown or other
  misc_feature (499)..(499): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccggcagtctccacaactcctgatctatttgggtccacgtcgggcctccggggtctctgacaggttcagtgccagtgcatcacacacagtatttcacactcgcacatcagcagagtgggagcgtgacgagtgttggggtctagttacngcatccaagttctaacctaacccgttcaccgttcggacagggtacacgtacttgagtataacgcgaacgtgtggntcgacactac

SEQ ID NO: 181596 - DNA, 154 bp, Homo sapiens; identical to SEQ ID NO: 181478
  misc_feature: GYAE6OF02I8FSA.44.70.G04.1.454.CMB.1.raw
  modified_base (153)..(154): a, c, t, g, unknown or other
  misc_feature (153)..(154): n is a, c, g, or t

SEQ ID NO: 181597 - DNA, 506 bp, Homo sapiens
  misc_feature: GYAE6OF02IDY82.44.70.G04.1.454.CMB.1.raw
  modified_base (424)..(424): a, c, t, g, unknown or other
  misc_feature (424)..(424): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccgggtctctgacaggttcagtgccagtgcatcacacacagattttcacactgcacatcagcagagtggaggctgacgatgttggggtctattactgctntaccaagttctaacctaaaccccgttcacccgttcgggcaacgggacacgcttgagtattaagcgaactgtggctgcactac

SEQ ID NO: 181598 - DNA, 798 bp, Homo sapiens
  misc_feature: GYAE6OF02GP4J9.44.70.G04.1.454.CMB.1.raw
  modified_base (293)..(293): a, c, t, g, unknown or other
  misc_feature (293)..(293): n is a, c, g, or t
tcagacagtatatacacgaccggtgctcgatttagtgtagtgtgaagggaaaggggactgattcggggaggactccgtcgagttcaccttctcacgaatgacggctcctggcctcgagctcctggggcttcgctaacttcgctctgggtcgtcagggtccgacgtgggacgatattataactgacctcacgtctcccctctccctggccggtcacccctggagaggccggcctccatctccgtgtaggttcctaggtcgagtaggtccttagggaggtcagaactagtcttangtggactggtacttggacaagaacgaccggcacgtaccctacacaacttcctagtactcgttagtttcggggtaccctacggttcccgggggcccttcccggggggtactccgttcggtacctacggtttacacggttcgtccctaaggttcggcctaacttaccgaaccacgaaccaacggtaccgttttacccaaccgtaacctacggtcctaaccgtacggtcccaaccggtacgtaacgggagggtaccgggaacgggttcgttacggtaacgttacgttggggttcggggttactttaacgtttaacgttggaccctacgttacccttaacggtttccgttaacccgtttaaacccccgggttacgtaacccggttaccggggaaccgtaacggggtaccgtaacccgggtaccgtttacgggaacgtaaacgttaacccggaccggtaaacccgttcggggtacccgggtaccgttacggtaccctaacccggttaccg

SEQ ID NO: 181599 - DNA, 443 bp, Homo sapiens
  misc_feature: GYAE6OF02I8YJR.44.70.G04.1.454.CMB.1.raw
  modified_base (433)..(443): a, c, t, g, unknown or other
  misc_feature (433)..(443): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcgaactggctcgacccctggggccagggaaccctggtcaccgtctcctcagcctccaccaagggcccatcggtcttccccctggccaccctcctccaagacgcacctctgggggcacagcggccctggggctgcctggtcaaggctacttccacgtctactctgagcgggctggcaaggcgcatagnnnnnnnnnnn

SEQ ID NO: 181600 - DNA, 153 bp, Homo sapiens; identical to SEQ ID NO: 181480
  misc_feature: GYAE6OF02G0FZN.44.70.G04.1.454.CMB.1.raw
  modified_base (153)..(153): a, c, t, g, unknown or other
  misc_feature (153)..(153): n is a, c, g, or t

SEQ ID NO: 181601 - DNA, 154 bp, Homo sapiens; identical to SEQ ID NO: 181478
  misc_feature: GYAE6OF02HSWGS.44.70.G04.1.454.CMB.1.raw
  modified_base (153)..(154): a, c, t, g, unknown or other
  misc_feature (153)..(154): n is a, c, g, or t

SEQ ID NO: 181602 - DNA, 153 bp, Homo sapiens; identical to SEQ ID NO: 181480
  misc_feature: GYAE6OF02GR4L2.44.70.G04.1.454.CMB.1.raw
  modified_base (153)..(153): a, c, t, g, unknown or other
  misc_feature (153)..(153): n is a, c, g, or t

SEQ ID NO: 181603 - DNA, 498 bp, Homo sapiens
  misc_feature: GYAE6OF02HINH9.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctagttactgcatccaagttctaccaaacccgttcaccttcgggcagggacacgacttgagattaagcgaactggtgctgcactac

SEQ ID NO: 181604 - DNA, 567 bp, Homo sapiens
  misc_feature: GYAE6OF02JM5NR.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctccctctccctggccgtcacccctggacgacgccggcctccatcctcctgtaggtctagtgagagtcttggaggtcagaacatctatgtggactggtacttgcagaagaccgggcagtctccacaactcctgatctatttcgggtccacgtcgggcctccggggtctcgtgacgaggttcagtcgccagtcgcagtcacacacagtatttcacactgacacatcagcagacgtggagctagacgagtcgttggggtctagttctggctacgtcctaagttacctaaccgtaaacccgttctaaccgttcggggacctaacggggacctaaccggtaacgttaggaaggtaacgtttaacggaccgtaacgttaggtccggacgtacgaccgtactacg

SEQ ID NO: 181605 - DNA, 653 bp, Homo sapiens
  misc_feature: GYAE6OF02IB3CX.44.70.G04.1.454.CMB.1.raw
  modified_base (471)..(471): a, c, t, g, unknown or other
  misc_feature (471)..(471): n is a, c, g, or t
tcagacagtatatacacgaccggtgctcgatttagtgtagtgtgaagggaaaggggacgtgatcaggactcctcagttcaccttctcacaatgaggctccctgctcagctcctgggctgctaatgctctgggtctcgagggtccaggtggagatattataatgactcagtcctccctctccctggccgttcacccctggacgacgccggcctccatcctcctggtacggtctagtgagagttcgttggacggtcaggaactatctaagtgtaggactggttacttgcagaacgaccgggcaggtcctcacgaactccgtgaactcttatttcgggttaccacgttcgggcccgtttccggggtcttcgtcgtacgtacggttcacgttcggccaggtttcggacaacttccgaactaacctaacgcgtaacttttacacctaacgtcgacacactacagtacacgtaacgngggtaacgcgtagacggtagttggttaggggtacttagtttacgtcgtataccgtaccgtaagttaccttaaccgtaaccccgttacgtaccgttacgggaccgaaccgggacgtaacgtaccgttagtacgtaacgttaacggtaacgtacgtacggtacggtacgtcgtaccaccgtacg

SEQ ID NO: 181606 - DNA, 442 bp, Homo sapiens
  misc_feature: GYAE6OF02HEZDM.44.70.G04.1.454.CMB.1.raw
  modified_base (365)..(365): a, c, t, g, unknown or other
  misc_feature (365)..(365): n is a, c, g, or t
  modified_base (436)..(442): a, c, t, g, unknown or other
  misc_feature (436)..(442): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctgggggccaggggaaccctggtcaccgtctcctcagcctccaccaagggcccatcggtcttccccctggccaccctcctccaagagcacctctgggggcacgngcggccctgggctcgcctggtcaaggactacttccacgtctactgctgagcgggctggcaaggcgcatagnnnnnnn

SEQ ID NO: 181607 - DNA, 155 bp, Homo sapiens; identical to SEQ ID NO: 181542
  misc_feature: GYAE6OF02IG2M5.44.70.G04.1.454.CMB.1.raw
  modified_base (153)..(155): a, c, t, g, unknown or other
  misc_feature (153)..(155): n is a, c, g, or t

SEQ ID NO: 181608 - DNA, 691 bp, Homo sapiens
  misc_feature: GYAE6OF02F6EOI.44.70.G04.1.454.CMB.1.raw
  modified_base (361)..(361): a, c, t, g, unknown or other
  misc_feature (361)..(361): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcaccctggagagccggcctccatctcctgtaggtctagtgagagtcttgggagtcagaacatctatgtgactggtacttgcagaagaccggcagtctccacactctgatctatttcgggtccacgtcgggccgtccggggtctcgtgactaggttcaggtcgcctagtgactancaacacactagtactttcaactactcgaccacactcgagccgaaggtaggtgggacggtcgttacggaacgttaggttcgggtttacgggggtctttaacgtttaccgtcggtaccgttaacgttacccgttaaacggttttacccgttaaaccccgttaaaacccccggtttaccgttaaaccccgggtttaccgggggtaacccggtaaacggggtaacccgtaacccgggttaacggtttaacggtaaacggttaacgtttaaacgggtaccggttaaacggttcgggttaccgggtaccgttaccggtacccgaacccgtttaacg

SEQ ID NO: 181609 - DNA, 515 bp, Homo sapiens
  misc_feature: GYAE6OF02FZVPQ.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagactttcacactgcacatcagcagagtggagctgacgatgttggggtctagttactgctatcctaagttctaaccaaaccccgttcaccgttcgggacacgggacacgtacttagagtaattaagcgtaacgtgtaggctagccactacg

SEQ ID NO: 181610 - DNA, 613 bp, Homo sapiens
  misc_feature: GYAE6OF02HYIWK.44.70.G04.1.454.CMB.1.raw
  modified_base (279)..(279): a, c, t, g, unknown or other
  misc_feature (279)..(279): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattaataatgactcagtctccctctccctggccgtcaccctggagacgccggcctccatctcctgtaggtctagtgagagtcttggagtcagaacatctatgtggactggtactgcagaagaccggnagtctcacactctgatctattggtccacgtcgggcctccgggtctcgtgactaggttcaggtgccagtcgcatcaacacacagtatttacacactcgacacatacagcaaggaggtggagctcggacgtagttcgggtttaggggtcttaagttacgtgtactacgttacctaacggtttacccttaaacccgttaaacccccggtttcctaacccggtttccggggaaccgtaacggggaaccgtaaccggtaaccggtttacgaaggttaactttaaacggaaccggttaacgttcgggttacggtaccgttacggaccctaacccttaacg

SEQ ID NO: 181611 - DNA, 181 bp, Homo sapiens
  misc_feature: GYAE6OF02HE72J.44.70.G04.1.454.CMB.1.raw
  modified_base (159)..(181): a, c, t, g, unknown or other
  misc_feature (159)..(181): n is a, c, g, or t
tcagacagtatatacacgaccggtgctcgatttagtgtagtgtgaagggaaagggacgacgacttgagattaagcggaactgtggctgcaccatctgtcttcattcttcccgcctatctgatatatactgtctggagcgggctggcaagggcgcatagnnnnnnnnnnnnnnnnnnnnnnn

SEQ ID NO: 181612 - DNA, 158 bp, Homo sapiens
  misc_feature: GYAE6OF02F0MWZ.44.70.G04.1.454.CMB.1.raw
  modified_base (152)..(158): a, c, t, g, unknown or other
  misc_feature (152)..(158): n is a, c, g, or t
tcagacagtatatacacgaccggtgctcgatttagtgtagtgtgaagggaagggacacgacttgagattaagcgaactgtggctgcaccatctgtcttcatcttcccgccatctgatatatactgtctgagcgggctggcaaggcgcatagnnnnnnn

SEQ ID NO: 181613 - DNA, 519 bp, Homo sapiens
  misc_feature: GYAE6OF02G95NZ.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcaccccctggagagccggcctccatctcctgtaggtctagtgagagtcttggagtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgagttggttggggtcttagttactggacatccaagttcctacctaaaccccgttctaccgttcgggcagggcacggacttaggacgtaattaacgcgtaactgtaggctgccacctac

SEQ ID NO: 181614 - DNA, 616 bp, Homo sapiens
  misc_feature: GYAE6OF02G6UYH.44.70.G04.1.454.CMB.1.raw
  modified_base (250)..(250): a, c, t, g, unknown or other
  misc_feature (250)..(250): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagacgccggcctccatctcctgtaggtctagtgagagtcttggaggtcagaacntctatgtggactggtacttgcagaagaccgggcagtctccacaactcctgactctagtttcgggttcccacgtccggggtccgtcccggggttctcgtgaccgtaggttccgagttcgccaggttcgcgtatcgactacacagtactttcacactgcacatcagcagagtggaggcgtgacgagttggtttggggtctatttacgtgtactacgtaccgtaacgtttacctaaccgttaaacccccggttctaacccgtttaccggggacgaacggggtaccgtaacggtaaccgttaggaacgttaacgttaaaccggtaccgtaacgttcggtacgggtacctacggtacccgtaccttaaccg

SEQ ID NO: 181615 - DNA, 532 bp, Homo sapiens
  misc_feature: GYAE6OF02F2RX6.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttgggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgtagtggttacggggtctattactgctatacctaagttcctaaccgaaaccccgttcaccgttacgggacgaacgggacacgtacttaggaagtaacttaagcgtaacttggtacggctcgacacctacg

SEQ ID NO: 181616 - DNA, 597 bp, Homo sapiens
  misc_feature: GYAE6OF02ISSVF.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctccctctccctggccgtcaccctggagagccggcctccatctcctgtaggtctagtgagagtcttggaggtcaggaacatctatgtgactggtacttgcagaagaccgggcagtctccacaactcctgatctatttcggtccacgtcgggccgtccgggtctcgtgacgtggttcagtgccagtgcatcacacacgagtacttttcactacgttcgaccaacactacacgacgtaggaagggtcgggaggtcgttacggacgtagttcgggtttggggttacttaagtttacgtgtacctatacccgtaagtttacctaaacccgttaaaccccgttacgtaccgttaccgggaacgtaacgggacctaacggtaacgttaggaacgtaagttaacgacgtacgttaggtcggcgtacgaccactacg

SEQ ID NO: 181617 - DNA, 635 bp, Homo sapiens
  misc_feature: GYAE6OF02HMGUZ.44.70.G04.1.454.CMB.1.raw
  modified_base (285)..(285): a, c, t, g, unknown or other
  misc_feature (285)..(285): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctccctctccctggcccgtcacccctggagacgcccggcctccatcctcctgtaggtctagtgagagtcttggaggtcagaacatctatgtggactggtacttgcagaacgccggnagtctccacactcctgatctagtttcggtccacgtcgggtccgttccggggtctcgtcgacgtaggtttcagtcgccgtaggtcgacactccaacaccacagtactttccactactcgaccaacactcagacaggaggtaggaggtcttaggacgtagttgggttgggttactagttacgtggtacctacgtaccgtaaacgtttaccctaaacccgtaaaccccggtttcaacccggtttacgggaaccgtaaccggggtaccacccggttaacgttaccgggtaagtaaacgtttaacggaaccggtaacgttcgggtaccgggtacctacggaccctacgttaaccg

SEQ ID NO: 181618 - DNA, 153 bp, Homo sapiens; identical to SEQ ID NO: 181480
  misc_feature: GYAE6OF02GN5EY.44.70.G04.1.454.CMB.1.raw
  modified_base (153)..(153): a, c, t, g, unknown or other
  misc_feature (153)..(153): n is a, c, g, or t

SEQ ID NO: 181619 - DNA, 449 bp, Homo sapiens
  misc_feature: GYAE6OF02IQCBM.44.70.G04.1.454.CMB.1.raw
  modified_base (440)..(449): a, c, t, g, unknown or other
  misc_feature (440)..(449): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcgaactggctcgacccctggggccagggaaacctggtcaccgtctcctcagcctccaccaagggcccatcggtcttcccccgtggccaccctcctccaagacgccacctcgtgggggcacagccggcccgtgggctggcctggtcaaggactacttcctatactactgtctgagcgggctggcaaggcgcatagnnnnnnnnnn

SEQ ID NO: 181620 - DNA, 461 bp, Homo sapiens
  misc_feature: GYAE6OF02I5810.44.70.G04.1.454.CMB.1.raw
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (451)..(461): a, c, t, g, unknown or other
  misc_feature (451)..(461): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcacgcctccaccaagggcccatcggtccttcccccgtgggccacccgtcctccgaagacgccacctcgtcggggggcaccgacgcggccctgggccttgccctgggtccaagggactactcctcgactcgcgttcngagcgggctggcaggcgnatgnnnnnnnnnnn

SEQ ID NO: 181621 - DNA, 730 bp, Homo sapiens
  misc_feature: GYAE6OF02IS216.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtcacccctggagagcccggcctccatctcctgtaggtctagtgagtagtcgttgggaggtcagaacatctatgtggactggtacttgcagaacggccgggcagtcctaccgactaactcctgactcttagtttcgggtccacgtccgggcctccggggtctcgtagacgtacggtttcaggttcgacccgagttcgacacgttaccaaccgacctaacgaggttaacttttacgaacctaccttcggacctacgtaacctacacggaccgaaggtaggtacggggaggtcgttagggacggtaggtttcggggtttcgggggtttaccttaaggtttaccgttaggtaccttacgtaacccgttaaacggtttacccttaaaccccgttaaacccccggttaccggttaaaccccgtttccgggaaccggtaacggggaacccgttaaccgggttaacgtttaacggaacggttaaacgttaacggtaacccggttaacgggttcgggtaccggtacggttacggtacccgacctttaaccgg

SEQ ID NO: 181622 - DNA, 455 bp, Homo sapiens
  misc_feature: GYAE6OF02F1F3S.44.70.G04.1.454.CMB.1.raw
  modified_base (448)..(455): a, c, t, g, unknown or other
  misc_feature (448)..(455): n is a, c, g, or t
tcagacagtatatacacgaccggtgctcgatttagtgtagtgtgaagggaaagggactggagtggattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgaccccgtggggccagggaaccctggtcaccgtctcctcagcctccaccaaggcccatccggtcttccccctggccaccctcctccaagacgccaccctcgtcggggggccacgacgccggcccgtggggctcggcctgggtcaaggacctacttcccacgtctactgctgagcgggctggcaggcgcatgnnnnnnnn

SEQ ID NO: 181623 - DNA, 594 bp, Homo sapiens
  misc_feature: GYAE6OF02GXTMH.44.70.G04.1.454.CMB.1.raw
  modified_base (364)..(364): a, c, t, g, unknown or other
  misc_feature (364)..(364): n is a, c, g, or t
tcagacagtatatacacgaccggtgctcgatttagtgtagtgtgaagggaaaggggactgatcaggactcctcagttcaccttctcacaatgaggctccctgctcagctcctgggctgctaatgctctgggtctcagggtccagtggagatattataatgactcagtctcccctctcccctggcccgtcacccctggacgagccggcctccatctcctgtaggtctagtgagagtcttggaggtcagaacatctatgtggactggtacttgcagaagaccgggcagtctccacaactcctgatctagtttcgggttccacgtcgggccgttccggggtctctgactaggttcagtcgccaggtncatcacacacagatttccactactgcacatcagcagagtggagctagacgtagttggttcggggtcttacgttacgtgtcctacgttaccgaagtttcccaaacccttaaaccccgtttccgtaacccgtttccggggacctaacgggtaaccaacggtaccgttacggtaaggtaacgtttaacggaccggtaacgttcggtacggtaccgtacgtacccgtactaccg

SEQ ID NO: 181624 - DNA, 525 bp, Homo sapiens
  misc_feature: GYAE6OF02FO2IK.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttgggaggtcagaacatctatgtggactggtacttgcagaagaccgggcagtctccacaactcctgatctatttgggttccactcgggcctccggggtctctgacaggttcagtgccagtgcatcacacacagactttcacactgggcacatcagcagagtggaggctgacgagtggttggggtctattactgcatcctaacgttcttaacctaaacccgttcctaccgttcgggacgacgggacgacgtacgttagagtaattaagacgaacgtgtggcgtcgcactacg

SEQ ID NO: 181625 - DNA, 202 bp, Homo sapiens
  misc_feature: GYAE6OF02G7M54.44.70.G04.1.454.CMB.1.raw
  modified_base (162)..(202): a, c, t, g, unknown or other
  misc_feature (162)..(202): n is a, c, g, or t
tcagacagtatatacacgaccggtgctcgatttagtgtagtgtgaagggaaagggacacgaacgttcgaagattaacgcgaacgtgtggcctgcaccatctgtcttcatcttcccgccatctgatatattactggtctgagcgggctggcaaggcgcatagnnnnnnnnnnnnnnnnnnnnnnnnnnnnnnnnnnnnnnnnn

SEQ ID NO: 181626 - DNA, 625 bp, Homo sapiens
  misc_feature: GYAE6OF02GRKJ7.44.70.G04.1.454.CMB.1.raw
  modified_base (391)..(391): a, c, t, g, unknown or other
  misc_feature (391)..(391): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggacgagccggcctccatctcctgtaggtctagtgagagtcttggaggtcagaactatctatgtgactggtacttgcagaagaccgggcagtctaccacaactcctagatcttagtttcggtccacgtcgggccgttccgggtctcgtgactaggtcagtgccagtgcataccactacacagtactttacacacgtnaccacatacagcaaggcgtggacggtcgtcgagtacgttgggttacgggttcttaacgttacgtagaccgttaacgtacccgttaaacgttacccgtaaacccgttaaacccccggtttaccgtaacccggtttaccggggaccgtaaacgggaccgtaaccggtaaccgttaggaacgtaacgttaaggacccgtaacgtacggttaccggtacgtacgtaccgacgttaccg

SEQ ID NO: 181627 - DNA, 157 bp, Homo sapiens
  misc_feature: GYAE6OF02FFT3O.44.70.G04.1.454.CMB.1.raw
  modified_base (144)..(144): a, c, t, g, unknown or other
  misc_feature (144)..(144): n is a, c, g, or t
  modified_base (150)..(157): a, c, t, g, unknown or other
  misc_feature (150)..(157): n is a, c, g, or t
tcagacagtatatacacgaccggtgctcgatttagtgtagtgtgaagggaagggacacgacttgagattaagcgaactgtggctgcaccatctgtcttcatcttcccgcatctgatatatactgtctgagcggctggcaaggcncatagnnnnnnnn

SEQ ID NO: 181628 - DNA, 642 bp, Homo sapiens
  misc_feature: GYAE6OF02HEF2L.44.70.G04.1.454.CMB.1.raw
  modified_base (137)..(137): a, c, t, g, unknown or other
  misc_feature (137)..(137): n is a, c, g, or t
  modified_base (167)..(167): a, c, t, g, unknown or other
  misc_feature (167)..(167): n is a, c, g, or t
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (389)..(389): a, c, t, g, unknown or other
  misc_feature (389)..(389): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcngggtaaccagtggagatattataatgactnagtcctcccctctccctggccgtcacccctggagacgccggcctccatctcctgtagtctagtgagtgtcttggagtnagaacntctatggtgtacgttcggtacttgacaggaacggaccgggtcacgttcctaccaacaacctcctgtactcttacgtttcgggtccacgtccgggcccgttccggggtctcgtcgacgtaggtcgtagtcgccgtagtncatacaccacacagtactttacactactcgacacatacgacgacgaggacgggtagggacgtacgaggtaacgttacggttacgggtttcggggttacttaccgtttacgtcggacctacgtaccgttaacgttacctaaaccccgttaacccgttacccgtacccgttacgggaccgaacgggtaccgaacgtaccgtaggtaacgtaattaaaccggcgtaaccgtggacgtacgtacggacctacgtacg

SEQ ID NO: 181629 - DNA, 596 bp, Homo sapiens
  misc_feature: GYAE6OF02IWGOG.44.70.G04.1.454.CMB.1.raw
  modified_base (236)..(236): a, c, t, g, unknown or other
  misc_feature (236)..(236): n is a, c, g, or t
  modified_base (264)..(264): a, c, t, g, unknown or other
  misc_feature (264)..(264): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (430)..(430): a, c, t, g, unknown or other
  misc_feature (430)..(430): n is a, c, g, or t
tcagacagtatatacacgaccggtgctcgatttagtgtagtgtgaagggaaaggggactgatcaggactcctcagttcaccttctcacaatgaggctccctgctcagctcctgggctgctaatgctctgggtctcagggtccagtggagatattataatcgactcagtctcccctctccctggcccgtcaccccgtggacgacgccggcctccagtctcctgtaggtctagtgagngtcttgggaggtcagtaacatctagtgnggcgtggtacttgcagaagaccgggnagtcgtcacactcngatctattcggtccacgtcggcctccgggtctcgcgacgtacggtcagtcggtccaaggttcgactagtccaacaccactagtatttccacacttcgaccacgtactcacgcaaggtacgtagggngtcacggagttactcggttcgggtacttaagtctacgctaccgtactaacggttactaaaccctaacccggttactaccgttaccgggtaccgaacggtacgaaccgtcttaacggtagtaacgtacgtaacggacgttcgtaaggtcgtacgtacccacgttacg

SEQ ID NO: 181630 - DNA, 561 bp, Homo sapiens
  misc_feature: GYAE6OF02I0EVC.44.70.G04.1.454.CMB.1.raw
  modified_base (202)..(202): a, c, t, g, unknown or other
  misc_feature (202)..(202): n is a, c, g, or t
  modified_base (391)..(391): a, c, t, g, unknown or other
  misc_feature (391)..(391): n is a, c, g, or t
  modified_base (482)..(482): a, c, t, g, unknown or other
  misc_feature (482)..(482): n is a, c, g, or t
  modified_base (499)..(499): a, c, t, g, unknown or other
  misc_feature (499)..(499): n is a, c, g, or t
  modified_base (525)..(561): a, c, t, g, unknown or other
  misc_feature (525)..(561): n is a, c, g, or t
tcagacagtatatacacgaccggtgctcgatttagtgtagtgtgaagggaaagggcctgatgtgggtctcacgtattaacaccgatgggactatcactggttactcagacgccgtgaagggccgattcgatcatctccagagacaatgtacgaaaacacggtgtaatttacaaatgaacagtactaagagtcgagacacggntgtactactattgtggtgagtaccttatgtattcacgttgggggtattactcggtttcggcccagtacgttggggcccaaggggtaacccgttggtacgtcgtccgttcctcgacgtcttccaaccgacgggtccccagttccggttccctccccccgttggccccgtccctagtccgaccacgggacnccctaccgttccggtgggggccctaaccgcggccggtcccggtcggggctcgccggttaggacgaaggtccttactcctaaagtctacgtntcggtgacgtccggggntcggacgtacgggcgactagtacggnnnnnnnnnnnnnnnnnnnnnnnnnnnnnnnnnnnnn

SEQ ID NO: 181631 - DNA, 738 bp, Homo sapiens
  misc_feature: GYAE6OF02G5I8E.44.70.G04.1.454.CMB.1.raw
  modified_base (256)..(256): a, c, t, g, unknown or other
  misc_feature (256)..(256): n is a, c, g, or t
  modified_base (293)..(293): a, c, t, g, unknown or other
  misc_feature (293)..(293): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtccaccccgtggacgacgccggcctccatcctcctgtaggtctagtgagtagtcttggaggtcagaacntctatgtggtactggtacttgacaggaacgaccgggntacggtcctaccaactaacctccgtgtacttcgttacgtttcgggtccacgtccgggtccgttcgggtctcgtgacgtaggttcaggtcgccgagtcgactacgtaccaacctaaccaacgtacgttaacttttacccgaacctaccgttacggaccctaaccgtaccgttaccgaacgtacgaaggtacgggtacgggacgtcggttacggaacggttagttaggggtttcggggttactttaagttacgtacgtaccgttaccgtaccgttaaccgtttacccgtaaaccccttaaaccccggtttccttaacccgggttccgggtaaccggtaaccgggtaaccgtaccggttaacggttacggtaaacggttaacgtttaaaccgggaccggttaacggttcgggttacggtacccgttacggaccccgtaccgttaccgg

SEQ ID NO: 181632 - DNA, 662 bp, Homo sapiens
  misc_feature: GYAE6OF02IDN8J.44.70.G04.1.454.CMB.1.raw
  modified_base (264)..(264): a, c, t, g, unknown or other
  misc_feature (264)..(264): n is a, c, g, or t
  modified_base (307)..(307): a, c, t, g, unknown or other
  misc_feature (307)..(307): n is a, c, g, or t
  modified_base (319)..(319): a, c, t, g, unknown or other
  misc_feature (319)..(319): n is a, c, g, or t
  modified_base (326)..(326): a, c, t, g, unknown or other
  misc_feature (326)..(326): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagacagtatatacacgaccggtgctcgatttagtgtagtgtgaagggaaaggggactgatcaggactcctcagttcaccttctcacaatgaggctccctgctcagctcctgggctgctaatgctcgtgggtctcgagggtccaggtggagattattataatgactcagtcctcccctctcccgtggccgtaccacccgtggagcgcccggcctccatcctctggtagtctagtcgagtcgttcttgggacgtacaagaactnttactaagtggtacgtacgtggttacctgacaagacggccggnacgtcaccgtanaccttcngtattcttagttcggtccagtccgggccttacgggctgtacgcgacgtttnacggtcaccgnggttcatacgtcaactaccgaatacgttcgtacccatacgttcgactaaccgtactagaccggtaactaagggtagtcgggaccggtaagttaggaaccggtttaggttcggttacgggttaactacgtttacgcgtaattaccgtacctaacgttacccgttaaaccctaaccgtactacccggtacgaacgtacggacctacggtaacttagggaaacttacggtaaacgtcggttaacttacgggtcgttaccggctaccgtacttaccgg

SEQ ID NO: 181633 - DNA, 595 bp, Homo sapiens
  misc_feature: GYAE6OF02JKGE2.44.70.G04.1.454.CMB.1.raw
  modified_base (383)..(383): a, c, t, g, unknown or other
  misc_feature (383)..(383): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtccaccccgtggagacgccggcctccatcctccgtgtacggtctagtgagagttcgttggaggtacagaacatctagtgtggacttggtactgacagaacgaccggcagtcctccacacttccagtctcttagtttcgggttccacggtccgggtccgtcccgggtctcgtagacgtagttcagtcgccgtagtcnctatccaacacgactaatactttaccactacncgacacactcacgngagaggtggagcgtgacgtaggttcgggttgggtacttaacgttactgtacctagtaccgttaacttaccgtaaccctaaccccgttctaccgttacggacgacggtacgacgtagtacggagtaacgttagaccgtacgttcggtacgtacgacgacctactacg

SEQ ID NO: 181634 - DNA, 635 bp, Homo sapiens
  misc_feature: GYAE6OF02GPAIQ.44.70.G04.1.454.CMB.1.raw
  modified_base (166)..(166): a, c, t, g, unknown or other
  misc_feature (166)..(166): n is a, c, g, or t
  modified_base (197)..(197): a, c, t, g, unknown or other
  misc_feature (197)..(197): n is a, c, g, or t
tcagacagtatatacacgaccggtgctcgatttagtgtagtgtgaagggaaagggggactgatcaggactcctcagttcacctttctcacaatgaggctccctgctcagctcctgggctgctaatgctctgggtctcagggtccagtggagatattataatgactnagtctccctctcctggccgtcaccctggagngccggcctcatcgtcctgtagtctagtgagagtcttggaggtcagaactatctatgtggactggtacttgcagaagaccgggctagtcctaccgactaactccgtgtatcttagtttcgggttaccacgtccggggtcctccggggtctcgtggacaggttcagtcgcctaagtcgctagtaccaacgaccacgtaagtacttttacgactaactacgacacctattacacgactaaggaggttaggacggtacttacggacgtacgtttgggttacggggttactttaacgtttaaccgtggaccttaacgtacccgttaaagtttcccttaaacccgttaaaccccgtttcgaacccggtttacgggacgtaacggacctaacggacttagacggtaattaacgacgttaacgtggtacgtacgtgaccgataccg

SEQ ID NO: 181635 - DNA, 200 bp, Homo sapiens
  misc_feature: GYAE6OF02HI0U6.44.70.G04.1.454.CMB.1.raw
  modified_base (159)..(200): a, c, t, g, unknown or other
  misc_feature (159)..(200): n is a, c, g, or t
tcagacagtatatacacgaccggtgctcgatttagtgtagtgtgaagggaaagggtacgacgacttgagattaaagcgaactgtggctgcaccatcctgtcttcatcttcccggccatctgatatatactgtctgagcgggctgggcaaggcgcatagnnnnnnnnnnnnnnnnnnnnnnnnnnnnnnnnnnnnnnnnnn

SEQ ID NO: 181636 - DNA, 154 bp, Homo sapiens; identical to SEQ ID NO: 181478
  misc_feature: GYAE6OF02GM0WW.44.70.G04.1.454.CMB.1.raw
  modified_base (153)..(154): a, c, t, g, unknown or other
  misc_feature (153)..(154): n is a, c, g, or t

SEQ ID NO: 181637 - DNA, 550 bp, Homo sapiens
  misc_feature: GYAE6OF02HV3IV.44.70.G04.1.454.CMB.1.raw
  modified_base (512)..(513): a, c, t, g, unknown or other
  misc_feature (512)..(513): n is a, c, g, or t
  modified_base (515)..(520): a, c, t, g, unknown or other
  misc_feature (515)..(520): n is a, c, g, or t
  modified_base (522)..(522): a, c, t, g, unknown or other
  misc_feature (522)..(522): n is a, c, g, or t
  modified_base (524)..(550): a, c, t, g, unknown or other
  misc_feature (524)..(550): n is a, c, g, or t
tcagacagtatatacacgaccggtgctcgatttagtgtagtgtgaaggggaaagggactggagtggattgggcgcatctataaacagtggcagcaccaactacaaccccgccctcaagatcgagtcaccatgtcactagacaggtccaaagaaccagttctccctgaaaatttgacttctgtcgacccgccgcggacacggccgtatattattgtgcgagagattcctatcgatacagtagaggacgggggggcgaacgtggctcgaccccgtggggccagggaaccctggtcaccgtctcctcacgcctccaccgaacggcccatccggtcccttcccccgtggcctacccctcctcccgaagtacgcctacccgtcggtcggggggcctaaccgacggcccggtccccgtggggcctccggtccgttaggtacgaaacggtaccttaacctttacccgtaattacttaccgtgtctacgacggcgggtcgtaggcgaggtcgactagtgnntnnnnnncnannnnnnnnnnnnnnnnnnnnnnnnnnn

SEQ ID NO: 181638 - DNA, 711 bp, Homo sapiens
  misc_feature: GYAE6OF02I8CHT.44.70.G04.1.454.CMB.1.raw
  modified_base (252)..(252): a, c, t, g, unknown or other
  misc_feature (252)..(252): n is a, c, g, or t
  modified_base (513)..(513): a, c, t, g, unknown or other
  misc_feature (513)..(513): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctggctcccaggttcgagatgtgacatcgagatcgacccagtcctccttccttcctgtcttcttctgttggaggcagcgtcaccatcacttcggccgggacgacgtcgacgggttcgttttcggngtcgttggttgtcccgttagggtttaacaaaacggtaaaaaaggggggcgaacggtaccccctaaggtcctcgtactcgtcgtagaaaccagacgtagggtaaggtacgtacgtccccgtacgtaacggttcaaggtcgacccgtaggtccgaaggggttcgggtcggggacccggtacgtcccgtacctcgtaccaacctaagttacgcccgtaaccgtggccgtctaggaagtctttctagtactaactttcgtttacncgtacagtactaaggttactacctagttaaccggtccgtaccccgttttacgtaaccgttttcgggacccgtaaaggggtaaacctacgtaccgttaaagggaaaactaccgtaaaaacgtcttcggtacgtaccgtcgaactaaccgtgttacctgtacccttcgtaaccttcccgttacccgactacctgtaaccg

SEQ ID NO: 181639 - DNA, 617 bp, Homo sapiens
  misc_feature: GYAE6OF02FUBRO.44.70.G04.1.454.CMB.1.raw
  modified_base (598)..(598): a, c, t, g, unknown or other
  misc_feature (598)..(598): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtctcccctctccctggccgtcacccctggagacgcccggcctccatcctcctgtaggtctagtgagtagttcttgggaggtcaagaactatctatggtgactggtacttgacaggaacggaccggcacgtcctaccacgtaacctcctagtattcgttagttttcgggtccacggttccgggtcccgttccggggtcctcgtacgaccggtggttacgacgtcgtccctagtcgcactccaacacacgtagtactttcacgtactgaccacacttcagcgaaggtaggtcggaggtcgtagacgtagttcgggttgggtacttagttcgtgactacgtaccgtaagttccctaaaccgtaaccccgtttccgaccggtttaccggacgtaacggtaccacgtacgtgtagtaacttaaggacgtacgtcgnggtactcgacaccgttacg

SEQ ID NO: 181640 - DNA, 185 bp, Homo sapiens
  misc_feature: GYAE6OF02GANTD.44.70.G04.1.454.CMB.1.raw
  modified_base (149)..(149): a, c, t, g, unknown or other
  misc_feature (149)..(149): n is a, c, g, or t
  modified_base (155)..(185): a, c, t, g, unknown or other
  misc_feature (155)..(185): n is a, c, g, or t
tcagacagtatatacacgaccggtgctcgatttagtgtagtgtgaagggaaagggacacgacttcgagattaagcgaactgtggctgcaccatctgtcttcatcttcccgccgatctgatatatactgtctgagcgggctggcaaggcncatagnnnnnnnnnnnnnnnnnnnnnnnnnnnnnnn

SEQ ID NO: 181641 - DNA, 158 bp, Homo sapiens
  misc_feature: GYAE6OF02H6PIH.44.70.G04.1.454.CMB.1.raw
  modified_base (120)..(120): a, c, t, g, unknown or other
  misc_feature (120)..(120): n is a, c, g, or t
  modified_base (146)..(146): a, c, t, g, unknown or other
  misc_feature (146)..(146): n is a, c, g, or t
  modified_base (152)..(158): a, c, t, g, unknown or other
  misc_feature (152)..(158): n is a, c, g, or t
tcagacagtatatacacgaccggtgctcgatttagtgtagtgtgaagggaaagggacacgacttgagattaagcgaactgtggctgcaccatctgtcttcatcttccgccatctgatatntactgtctgagcgggctggcaaggcncatagnnnnnnn

SEQ ID NO: 181642 - DNA, 729 bp, Homo sapiens
  misc_feature: GYAE6OF02IDVF8.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattaataatgactcagtcctcccctctccctggcctcaccccgtggagacgccggcctccatcctcctggtaggtctagtgagagtcgttgggaggtcagaacatctatggtggactggtacttgacaggaacgccgggcacgtcctaccactaactccgtagacttcgtttacgtttcgggttaccctacggttcccggggtcccggttccgggggttcttccggtacggtaacgttacgggtttcctagggtacggtacccgtaaggtcgtacctaacgtacctaaccaaccgtaacgtacgttacttttacccgaactaccgtcgtacctaaccgtactacgaacgtccgaaagggtcggtaaggggtcgggtccgttaaggtaggtagggtttacggggtttaggggtactttacgtttacgtcggtaaccttaccggtaaccgttaaccgttacccgttaaacccgttaaaccccgttacgtacccgggttaacgggaccgtaacgggtacaaccggtaggtaacgagttaacgtaacgcggtaatcgggtacgcgtacgccgtacgttacg

SEQ ID NO: 181643 - DNA, 659 bp, Homo sapiens
  misc_feature: GYAE6OF02I4OUY.44.70.G04.1.454.CMB.1.raw
  modified_base (126)..(126): a, c, t, g, unknown or other
  misc_feature (126)..(126): n is a, c, g, or t
  modified_base (306)..(306): a, c, t, g, unknown or other
  misc_feature (306)..(306): n is a, c, g, or t
  modified_base (316)..(316): a, c, t, g, unknown or other
  misc_feature (316)..(316): n is a, c, g, or t
  modified_base (349)..(349): a, c, t, g, unknown or other
  misc_feature (349)..(349): n is a, c, g, or t
  modified_base (360)..(360): a, c, t, g, unknown or other
  misc_feature (360)..(360): n is a, c, g, or t
  modified_base (372)..(372): a, c, t, g, unknown or other
  misc_feature (372)..(372): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgntctgggtctcagggtccagtggagatattataatgactcagtcctcccctctcccctggccgtcacccccgtggagacgccggcctaccatctcctggtaggtctagtgagtagtcgttggaggtcaggaacattcgtagttgtggacgttggtacttgacagaaggaccggcagttccnccactactcngatctagttcggtccacgtcggccgtcgggtcnctgacgagtcngtatcgagtcanacgtcaacgtcaacgtagtactttaccactaactcggacacgtactcgaacgacgaggtacgtgggaggtacgtagacggtaggttacgggttacgggttaccttagtttacgtagtaccgtacctaccgttaaccggttaacccttaacccgtaaaccccgtttccggtaacccggttaccgggtaaccgtaacgggtaaccgtaccggtaacggttaaggtaacggtaaacgttaacggaccgttaacggttacggtacggttccgtacgtaccgtaccgttacg

SEQ ID NO: 181644 - DNA, 704 bp, Homo sapiens
  misc_feature: GYAE6OF02H2DOW.44.70.G04.1.454.CMB.1.raw
  modified_base (278)..(278): a, c, t, g, unknown or other
  misc_feature (278)..(278): n is a, c, g, or t
  modified_base (330)..(330): a, c, t, g, unknown or other
  misc_feature (330)..(330): n is a, c, g, or t
tcagacagtatatacacgaccggtgctcgatttagtgtagtgtgaagggaaaggggactgatcaggacttctcagttcatcttctcaccatgaggctccctgctcagctccgtggggctgctaatgctctggactccctggacccagtgcagatgttgtgctcgacccagacctcccctctctctcgtcccgtccaccccgtggaccacggcccggcctccagtcgtcctgacaagttctagtcaagcgtccctcgtgactagtagtagataggaaanactattatttgtacgtcggtacctgcaggaggtcaggcctacggtcctccgntacgtccctccgtacacttcctaagtgttactttccgttacgaacgtccgtccttcgttcggtaggtacgttcgacctaaggtacgttacgggttacaggttcgggacgtacgggggtacgggggtaccggggaataacggttaccgtttaccaacgttaaccggtaaagtaaacctcgggtaacgggtcccggggtagggtacgggtacgtaggtaacgggtacgtttagggtttaacggttaaattttacgttacgtagtactaaggtacgacgtaaggtcttaacgttccgttaacccggttaccccgtcggttaccggaaccgtaagggacggttacgggtaaacgtaacgtacggacggtacgtaacgg

SEQ ID NO: 181645 - DNA, 559 bp, Homo sapiens
  misc_feature: GYAE6OF02ICWPY.44.70.G04.1.454.CMB.1.raw
  modified_base (213)..(213): a, c, t, g, unknown or other
  misc_feature (213)..(213): n is a, c, g, or t
  modified_base (218)..(218): a, c, t, g, unknown or other
  misc_feature (218)..(218): n is a, c, g, or t
  modified_base (485)..(485): a, c, t, g, unknown or other
  misc_feature (485)..(485): n is a, c, g, or t
  modified_base (497)..(497): a, c, t, g, unknown or other
  misc_feature (497)..(497): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (524)..(530): a, c, t, g, unknown or other
  misc_feature (524)..(530): n is a, c, g, or t
  modified_base (534)..(536): a, c, t, g, unknown or other
  misc_feature (534)..(536): n is a, c, g, or t
  modified_base (538)..(543): a, c, t, g, unknown or other
  misc_feature (538)..(543): n is a, c, g, or t
  modified_base (545)..(547): a, c, t, g, unknown or other
  misc_feature (545)..(547): n is a, c, g, or t
  modified_base (549)..(559): a, c, t, g, unknown or other
  misc_feature (549)..(559): n is a, c, g, or t
tcagacagtatatacacgaccggtgctcgatttagtgtagtgtgaagggaaagggactggagtggattgggcgcatctataacagtggcagcaccaacgtacaaccccgccctcaagagtcgagtcaccatgtcactagacaggtccaagaaccagttctccctgaaacttgacttctgtgaccgccgcggaccacggccgttatattagttntgcgngagattcctatcgatacagtagaggacgggggggcaagtggctcgacccctggggccacgggaccctggtccaccgtcttccgcaggccctcctaccgaacgggccctacgtccggtacctttcccccgtggccctcccgtcctccaagaccgcgtaccgcggtacgggggcaacggacgccggccccgtgggccgtacgccgtaggttccgaaaggtcttaacttcccgttaatactcgttcgtctaggcgtaccggggctacggngtaacgggaccncgtaaacgtacgtgacagtgtncgnannnnnnnacgnnngnnnnnntnnngnnnnnnnnnnn

SEQ ID NO: 181646 - DNA, 669 bp, Homo sapiens
  misc_feature: GYAE6OF02G3F28.44.70.G04.1.454.CMB.1.raw
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatattataatgactcagtcctcccctctccctggccgtcacccctggagagccggcctccatctcctgtaggtctagtgagagttcttggaggtcagaacatctatgtggactggtacttgcagaagaccgggcagtctccacaactcctgatctagtttcgggttccacgtccgggccgtccggggtctcgtgacgtcggttcagtgccagtgcatcacacacgagtactttcactactcgccacactcgagcaaggagggtaggacggtctaggaacgtaggttcgggttcggggtttacttacggtttacgtcggtacctaacgtttacccgttaaacggtttacccgttaaaccccgttaaaacccccggttttccgtaaaccccgggtttacgggtaacccgggtaacgggtaaccgtacccggttaacgttaacggaacggttaaaccgtttaaacggaacccggttaacgttagggttaccgggacgtttccgggtaccctaccgttaaccg

SEQ ID NO: 181647 - DNA, 663 bp, Homo sapiens
  misc_feature: GYAE6OF02JQF6B.44.70.G04.1.454.CMB.1.raw
  modified_base (107)..(107): a, c, t, g, unknown or other
  misc_feature (107)..(107): n is a, c, g, or t
  modified_base (151)..(151): a, c, t, g, unknown or other
  misc_feature (151)..(151): n is a, c, g, or t
  modified_base (159)..(159): a, c, t, g, unknown or other
  misc_feature (159)..(159): n is a, c, g, or t
  modified_base (225)..(225): a, c, t, g, unknown or other
  misc_feature (225)..(225): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (388)..(388): a, c, t, g, unknown or other
  misc_feature (388)..(388): n is a, c, g, or t
  modified_base (567)..(567): a, c, t, g, unknown or other
  misc_feature (567)..(567): n is a, c, g, or t
  modified_base (580)..(580): a, c, t, g, unknown or other
  misc_feature (580)..(580): n is a, c, g, or t
tcagacagtatatacacgaccggtgctcgatttagtgtagtgtgaagggaaaggggactgatcaggactcctcagttcaccttctcacaatgaggctccctgcctcngctcctgggctgctaatgctctggatccctgacccagtcgcagnttggtgtnccgtcgacccagtcctcccctcgtctctacggtccgtcctaccccgtgaccacgcccggctacccngttcgtccgtcgactaacgtcttaacggcacggtactccctcgtacgacctataggttggaactaggaaaaccgtatagttaagttttcaacggttcgtacccgtagacgaaggttccgganaccggaccgtcgttaccggaccncggtactccttccacgtnttacgtgttacgtactttacgtaccgaggtccctacgttcgtagtcgacggtcgaagtacgttacgttagcgtcggtcgcggcggtacggggtacgtatcgtacttcacgtaacaagtacgtcggtacgggtcgtaggtagtcggaggttagtacggtttataagggttacttgtacgnggtaactgtacgngacgttacttcggtacgtcccgtaccggtccgtacgggaccgtacggtccggttaacgcgtaacgaccggtatacgggtctgg

SEQ ID NO: 181648 - DNA, 200 bp, Homo sapiens
  misc_feature: GYAE6OF02GARVM.44.70.G04.1.454.CMB.1.raw
  modified_base (136)..(136): a, c, t, g, unknown or other
  misc_feature (136)..(136): n is a, c, g, or t
  modified_base (152)..(200): a, c, t, g, unknown or other
  misc_feature (152)..(200): n is a, c, g, or t
tcagacagtatatacacgaccggtgctcgatttagtgtagtgtgaagggaaagggacacgacttgagattaagcgaactgtggctgcaccatctgtcttcatctcccgcatctgatatatactggtctgagcgggntggcaaggcgcatagnnnnnnnnnnnnnnnnnnnnnnnnnnnnnnnnnnnnnnnnnnnnnnnnn

SEQ ID NO: 181649 - DNA, 757 bp, Homo sapiens
  misc_feature: GYAE6OF02G6N8D.44.70.G04.1.454.CMB.1.raw
  modified_base (520)..(520): a, c, t, g, unknown or other
  misc_feature (520)..(520): n is a, c, g, or t
  modified_base (643)..(643): a, c, t, g, unknown or other
  misc_feature (643)..(643): n is a, c, g, or t
  modified_base (740)..(740): a, c, t, g, unknown or other
  misc_feature (740)..(740): n is a, c, g, or t
tcagacagtatatacacgaccggtgctcgatttagtgtagtgtgaagggaaaggggactgatcaggactcctcagttcaccttctcacaatgaggctccctgctcagctccgtgggctgctaatcgctcgtggtctcgtacggtcaggtggagtatattaatagtcgactcgtacgtcctcccctcctcccgtcggcccgtaccaccccgtggacgacggcccgtacctccgtacttccgtccgttggttacggttcgtaggtacggtaggttacggttcgttagggacgtacgaacgtaactacgtctaagttcggtaggtacgttacggttacttacggaacgtaaacgggtaacggacccgggtagtaccggttacccgtaaccgtaaccgtaaccgttccgtacgttaacgttttccgtttaacggttttccggtacccgtaccggttcccgggttcccggttccggttcgtcgttacggtacgttcggttaccgacggtccgtaccgaggttacncgtacactaacgaccgtagttactcgtttaacaccgtacgtacgactactcgacgacgtagacggtacggtggtagtcgtacgacgttggtttacgggtacgtttacgttacgttcgttacgngtaacgttactaacgttacctaacccgttaccgttacgaaccgggttccgaacgacgtacgtaacgttcgaacgtacggtaagtacgtcgagtcgtnaacgttcacgttactcg

SEQ ID NO: 181650 - DNA, 229 bp, Homo sapiens
  misc_feature: GYAE6OF02IJMFE.44.70.G04.1.454.CMB.1.raw
  modified_base (168)..(168): a, c, t, g, unknown or other
  misc_feature (168)..(168): n is a, c, g, or t
  modified_base (201)..(201): a, c, t, g, unknown or other
  misc_feature (201)..(201): n is a, c, g, or t
  modified_base (221)..(229): a, c, t, g, unknown or other
  misc_feature (221)..(229): n is a, c, g, or t
tcagacagtatatacacgaccggtgctcgatttagtgtagtgtgaagggaaggggactgatcaggactcctcagttcaccttctcacaatgaggctccctgctcagctcctggggctgctaatgctctgggtctcacgggtcagtggagtatattataaatgactacntcctccctctccctcggcctcacccctggaganccggcctcatctctgtagtnnnnnnnnn

SEQ ID NO: 181651 - DNA, 664 bp, Homo sapiens
  misc_feature: GYAE6OF02F7NEJ.44.70.G04.1.454.CMB.1.raw
  modified_base (164)..(164): a, c, t, g, unknown or other
  misc_feature (164)..(164): n is a, c, g, or t
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
tcagacagtatatacacgaccggtgctcgatttagtgtagtgtgaagggaaaggggactgatcaggactcctcagttcaccttctcacaatgaggctccctgctcagctcctggggctgctaatgctctgggtctcagggtccagtggagatatataatgactnagtcctcccctctcccgtggcccgtccaccccgtggacgacgcccggcctccattctcctggtacggtctagtgagngtcttggagtcagaacntctatgtggactggtacttagcaaggaacgaccgggcaggtacctccaacaaccgtcctagacttacgttagtttcggtcctacgtccgggccgtccggggtctcgtagacgtaggtcacgtcgcgtagtgcgtactacaaccaacacgtagtactttacgactacgtcgacctaacgatacgacgtacaacggtacggtcggtaacggacgtacggaacgtaggttcgggttacggggttacttaggttaccgtcggtactacgttaccgtaacgtttaacccgttaaaccctaaacccgttacccgtaaccgttacgggaaccgtacggtactaaccggtacgttacgaacgttaagttaacggacgttaagttacggtcggtactacgtaccgccgttaacgg

SEQ ID NO: 181652 - DNA, 685 bp, Homo sapiens
  misc_feature: GYAE6OF02HP9WM.44.70.G04.1.454.CMB.1.raw
  modified_base (196)..(196): a, c, t, g, unknown or other
  misc_feature (196)..(196): n is a, c, g, or t
  modified_base (209)..(209): a, c, t, g, unknown or other
  misc_feature (209)..(209): n is a, c, g, or t
  modified_base (585)..(585): a, c, t, g, unknown or other
  misc_feature (585)..(585): n is a, c, g, or t
  modified_base (590)..(590): a, c, t, g, unknown or other
  misc_feature (590)..(590): n is a, c, g, or t
  modified_base (593)..(593): a, c, t, g, unknown or other
  misc_feature (593)..(593): n is a, c, g, or t
  modified_base (598)..(598): a, c, t, g, unknown or other
  misc_feature (598)..(598): n is a, c, g, or t
  modified_base (607)..(607): a, c, t, g, unknown or other
  misc_feature (607)..(607): n is a, c, g, or t
tcagacagtatatacacgaccggtgctcgatttagtgtagtgtgaagggaaagggcctgatgtgggtctcacgtattaacaccgatgggactatcactgttactcagacgccgtgagggccgattcatcatctcagagacaatgtcgaaaacacggtgtatttacaaatgaacagtctaagagtcgaggacacggntgtctactatgtntgactacttatgactttacacgttgggggatttacttccggtttcgggcccacgacgtggggaccgaagggaaccgttgggttcgtcgttacctccctacgacgtccttacccgaaacccgaacggggtacccccaggttcccggtaccccgtttccccccgtacggggccccgtccccgttcgtacccgtacccgtacgggacgtccctaaccccgtcggttcggggggaccaacgacggcccggtacccgttcggggcttcgccgttaggtcgaaacggttaccttactttaccgtattaactcgttacggttccgttaggaccgggtcggggctaggaaccggtaaacggccgtacgtaagttacggcagtcncgagngcncaganagcgacganacacgagagtacacgacgacgtatacgagtaatacgtactactaccgacgtacgtacgtaccgtatagtagtacgacg

SEQ ID NO: 181653 - DNA, 639 bp, Homo sapiens
  misc_feature: GYAE6OF02JD73W.44.70.G04.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (447)..(447): a, c, t, g, unknown or other
  misc_feature (447)..(447): n is a, c, g, or t
  modified_base (593)..(593): a, c, t, g, unknown or other
  misc_feature (593)..(593): n is a, c, g, or t
tcagacagtatatacacgaccggtgctcgatttagtgtagtgtgaagggaaaggggactgatcaggactcctcagttcaccttctcacaatgaggctccctgctcagctcctgggctgctaatgctctgggtctcgagggtccaggtggagatattataatgactcagttcctcccctctccctggcctccaccccgtggaacgcgccggcctccattcctcctggtaggtctagtgagngtcttggagtnaagacntctatgtgacttggtacttgacgaagaacggtaccgggacacgtcctaccaacaccttcctgacttcttagtttcggtaccaccgttccgggtacccgtccggggttctaccgtgtaccgtacggttacacggttcgacctagtcgtacactccaacactacgtagtactttacgactactcgccaatcncgatcggacgaggtacggcgtacgtacggacgttgttcgggttcgtaactttaccgtataccgtcctacgttaacctacgtttacccgtaaaccgtacccgttacgtacccggtacgggtaccacgggtaccaaccgttcggtaanacgttagaacgtacgtacctttggaccgtacgcgtacctacctacg

SEQ ID NO: 181654 - DNA, 753 bp, Homo sapiens
  misc_feature: GYAE6OF02GIDN9.44.70.G04.1.454.CMB.1.raw
  modified_base (209)..(209): a, c, t, g, unknown or other
  misc_feature (209)..(209): n is a, c, g, or t
  modified_base (219)..(219): a, c, t, g, unknown or other
  misc_feature (219)..(219): n is a, c, g, or t
  modified_base (662)..(662): a, c, t, g, unknown or other
  misc_feature (662)..(662): n is a, c, g, or t
  modified_base (669)..(669): a, c, t, g, unknown or other
  misc_feature (669)..(669): n is a, c, g, or t
  modified_base (691)..(691): a, c, t, g, unknown or other
  misc_feature (691)..(691): n is a, c, g, or t
  modified_base (698)..(698): a, c, t, g, unknown or other
  misc_feature (698)..(698): n is a, c, g, or t
  modified_base (703)..(703): a, c, t, g, unknown or other
  misc_feature (703)..(703): n is a, c, g, or t
  modified_base (714)..(714): a, c, t, g, unknown or other
  misc_feature (714)..(714): n is a, c, g, or t
  modified_base (723)..(724): a, c, t, g, unknown or other
  misc_feature (723)..(724): n is a, c, g, or t
  modified_base (747)..(747): a, c, t, g, unknown or other
  misc_feature (747)..(747): n is a, c, g, or t
tcagacagtatatacacgaccggtgctcgatttagtgtagtgtgaagggaaaggggactggagtggattgggcgcatctataacagtggcagcaccaactacaaccccgccctcaagagtccgagtcaccatgcactagacaggtccaagaaccagttctccctgtaaacttgacttctgtcgaccgccgcggacacgggctatacttnttgtgcgagnacttccagtcgatacgagtagaacgggacggggggacaacgcggtccgtacccggtcccggaggggacccgtacggggtaaccccgtacggtacctacccggttcctcccgtcgacccgtaccccgtaccgtaacccgggaaaccgggtccctaccggtttcccgggttcccccgtttaccccccgtacgggtacccctaccccgttaacccctaacccgaggtaccctacccgaccggttcgggaccggggacctaaccggccggtaccccggcccggttgggcccgttacggtaccccggtttagggttaacccgtaaaccgggttaacccctttcgttccccggtaccgttacggtcccgtaccccggttcgtttgggaaccgggttcccgggtcgggttaccgaacccgggtacggcggtaaacctaggtaccggtacnggacagngtagactggatgggaccaggcngcgtacngtgangctacgacacncggtcgacnnctacacgcgcgtagcgtactacncgtacg

SEQ ID NO: 181655 - DNA, 157 bp, Homo sapiens
  misc_feature: GYAE6OF01D0QV0.1.16.B05.1.454.CMB.1.raw
  modified_base (157)..(157): a, c, t, g, unknown or other
  misc_feature (157)..(157): n is a, c, g, or t
tcagacgagtgcgtcacgaccggtgctcgatttagagctcacgtacactttggccagggaccaagctggagatcaaacgaactgtggctgcaccatctgtcttcatcttcccgccctcctcactcactcgtctgagcgggctggcaaggcgcatagn

SEQ ID NO: 181656 - DNA, 159 bp, Homo sapiens
  misc_feature: GYAE6OF01AQK8G.1.16.B05.1.454.CMB.1.raw
  modified_base (159)..(159): a, c, t, g, unknown or other
  misc_feature (159)..(159): n is a, c, g, or t
tcagacgagtgcgtcacgaccggtgctcgatttagagctcacgtacacttttggtcaggggaccaagctggagatcaaacgaactgtggctgcaccatctgtcttcatcttcccaccctcctcacgcactcgtctgagcgggctggcaaggcgcatagn

SEQ ID NO: 181657 - DNA, 160 bp, Homo sapiens
  misc_feature: GYAE6OF01CNVIU.1.16.B05.1.454.CMB.1.raw
  modified_base (159)..(160): a, c, t, g, unknown or other
  misc_feature (159)..(160): n is a, c, g, or t
tcagacgagtgcgtcacgaccggtgctcgatttagagctcacgtacacttttggccaggggaccaagctggagatcaaacgaactgtggctgcaccatctgtcttcatcttcccgccatctgaacgcactcgtctgagcgggctggcaaggcgcatagnn

SEQ ID NO: 181658 - DNA, 160 bp, Homo sapiens; identical to SEQ ID NO: 181657
  misc_feature: GYAE6OF01CIWT4.1.16.B05.1.454.CMB.1.raw
  modified_base (159)..(160): a, c, t, g, unknown or other
  misc_feature (159)..(160): n is a, c, g, or t

SEQ ID NO: 181659 - DNA, 179 bp, Homo sapiens
  misc_feature: GYAE6OF01D5KT1.1.16.B05.1.454.CMB.1.raw
  modified_base (160)..(179): a, c, t, g, unknown or other
  misc_feature (160)..(179): n is a, c, g, or t
tcagacgagtgcgtcacgaccggtgctcgatttagagctcacgtacactttggccgaggggaccaagctggagatcaaacgaactgtggctgcaccatctgtcttcatcttccccgccatctgaacgcactcgtctgagcgggctggcaaggcgcatagnnnnnnnnnnnnnnnnnnnn

SEQ ID NO: 181660 - DNA, 176 bp, Homo sapiens
  misc_feature: GYAE6OF01D41T1.1.16.B05.1.454.CMB.1.raw
  modified_base (159)..(176): a, c, t, g, unknown or other
  misc_feature (159)..(176): n is a, c, g, or t
tcagacgagtgcgtcacgaccggtgctcgatttagagctcacgtacacgtttggccaggggaccaagctggagatcaaacgaactgtggctgcaccatctgtcttcatcttcccgccatctgaacgcactcgtctgagcgggctggcaaggcgcatagnnnnnnnnnnnnnnnnnn

SEQ ID NO: 181661 - DNA, 161 bp, Homo sapiens
  misc_feature: GYAE6OF01DZEDO.1.16.B05.1.454.CMB.1.raw
  modified_base (159)..(161): a, c, t, g, unknown or other
  misc_feature (159)..(161): n is a, c, g, or t
tcagacgagtgcgtcacgaccggtgctcgatttagagctcacgtacacttttggccaggggaccaagctggagatcaaacgaactgtggctgcaccatctgtcttcatcttcccgccatctgaacgcactcgtctgagcgggctggcaaggcgcatagnnn

SEQ ID NO: 181662 - DNA, 184 bp, Homo sapiens
  misc_feature: GYAE6OF02HUGCZ.1.16.B05.1.454.CMB.1.raw
  modified_base (151)..(184): a, c, t, g, unknown or other
  misc_feature (151)..(184): n is a, c, g, or t
tcagacgagtgcgtcacgaccggtgctcgatttagagctcacgtacacttttggccagggaccaagctggagatcaacgactgtggctgcaccatctgtcttcatcttccacctctcaccactcgtctgagcggctggcaaggcgcatagnnnnnnnnnnnnnnnnnnnnnnnnnnnnnnnnnn

SEQ ID NO: 181663 - DNA, 165 bp, Homo sapiens
  misc_feature: GYAE6OF02IWLQ2.1.16.B05.1.454.CMB.1.raw
  modified_base (157)..(165): a, c, t, g, unknown or other
  misc_feature (157)..(165): n is a, c, g, or t
tcagacgagtgcgtcacgaccggtgctcgatttagagctcacgtacactttggccagggaccaagctggagatcaaacgaactgtggctgcaccatctgtcttcatcttcccgccctcctcacgcactcgtctgagcgggctggcaaggcgcatagnnnnnnnnn

SEQ ID NO: 181664 - DNA, 211 bp, Homo sapiens
  misc_feature: GYAE6OF02IE5MF.1.16.B05.1.454.CMB.1.raw
  modified_base (167)..(167): a, c, t, g, unknown or other
  misc_feature (167)..(167): n is a, c, g, or t
  modified_base (169)..(169): a, c, t, g, unknown or other
  misc_feature (169)..(169): n is a, c, g, or t
  modified_base (172)..(172): a, c, t, g, unknown or other
  misc_feature (172)..(172): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (179)..(181): a, c, t, g, unknown or other
  misc_feature (179)..(181): n is a, c, g, or t
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (197)..(211): a, c, t, g, unknown or other
  misc_feature (197)..(211): n is a, c, g, or t
tcagacgagtgcgtcacgaccggtgctcgatttagagctcacgtacacttttggccagggaccaagctggagatcaaacgactgtggctgcaccatctgtcttcatccttcccgcctctcacgcctactccgtctcgagcgggtctggccaaggccgctagtagctncntcngnctncnnnctgntgaacngnatgnnnnnnnnnnnnnnn

SEQ ID NO: 181665 - DNA, 161 bp, Homo sapiens; identical to SEQ ID NO: 181661
  misc_feature: GYAE6OF02IE1X6.1.16.B05.1.454.CMB.1.raw
  modified_base (159)..(161): a, c, t, g, unknown or other
  misc_feature (159)..(161): n is a, c, g, or t

SEQ ID NO: 181666 - DNA, 513 bp, Homo sapiens
  misc_feature: GYAE6OF01DUOW5.2.39.D06.1.454.CMB.1.raw
  modified_base (198)..(198): a, c, t, g, unknown or other
  misc_feature (198)..(198): n is a, c, g, or t
  modified_base (507)..(507): a, c, t, g, unknown or other
  misc_feature (507)..(507): n is a, c, g, or t
  modified_base (509)..(509): a, c, t, g, unknown or other
  misc_feature (509)..(509): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttacaaaccaggaaagcccctaagctcctgatctatgctgcatccagtttacaaagtggggtcccatcaaggttcagtggcagtggatcgtggacagtatttcactctcaccatcagtagtctaacaacctgaagtatttgactaacttactactgtacaacagtacgttacatacccctcgactctaccgtttccggacggacgggaccgaaggtggaagatacgaaacgactgtacggactgacncnttcg

SEQ ID NO: 181667 - DNA, 557 bp, Homo sapiens
  misc_feature: GYAE6OF01EDZFL.2.39.D06.1.454.CMB.1.raw
  modified_base (209)..(209): a, c, t, g, unknown or other
  misc_feature (209)..(209): n is a, c, g, or t
  modified_base (232)..(232): a, c, t, g, unknown or other
  misc_feature (232)..(232): n is a, c, g, or t
  modified_base (391)..(391): a, c, t, g, unknown or other
  misc_feature (391)..(391): n is a, c, g, or t
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
tcagacgctcgacacacgaccggtgctcgatttagtgacatctcgcgacgttcgtttgggggagcccagtctctagtcaggacacaggcagtggacatgagggtccccgctcagctccttgggctcctgctactctggtctccgagatgccagatgtgacacccagatgacccagtctccgatcctccctgtctgcaatctggtggganacagatcatcatctcttgccggnaagtcagagtgttagtattttaatttaaattggtatcgtagttacaaaccgagggaacgacccctaagcctcctgatctatgctgctatcctaagtttacaaaggtgggtacccatcaaggttcagtgcagtgatcgtggactagatttcactctcacntacagtntctaacaactgaagtatttgactaacttactactgtacaanagtagttacgtacttaccccgtctctcctacgtttcgggacggtacgggaaccgtaagggtcggtaagtacgtacgaaaacgtacgtaggtcggtacttacgactacccgtgttaccg

SEQ ID NO: 181668 - DNA, 503 bp, Homo sapiens
  misc_feature: GYAE6OF01BTUEQ.2.39.D06.1.454.CMB.1.raw
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaagcccctaagctcctgatctatgctgcatccagtttacaaagtggggtaccatcaaggttcagtggcagtggatctgggacagtatttcactctcaccatcagtagtctacaacctgaagtatttgactaacttactactgtacaacagtagttacgtactacccctccgctctactttcggcggaggaccaaggtggagactcgaaacgactgtggactaggcncntcg

SEQ ID NO: 181669 - DNA, 510 bp, Homo sapiens
  misc_feature: GYAE6OF01DHGN2.2.39.D06.1.454.CMB.1.raw
  modified_base (507)..(507): a, c, t, g, unknown or other
  misc_feature (507)..(507): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtgcagtgatctggacagattcactctcacatcagtagtctacacctgaagtatttgactaactttactactgtacaacagtagttacgtactaccccctcgtctactacgtttccgggcggtacgggaccaagggtcgagactacgaaacgtactggtcgactgccacgtntcg

SEQ ID NO: 181670 - DNA, 553 bp, Homo sapiens
  misc_feature: GYAE6OF01BHQS4.2.39.D06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttattaaattggtatcagttacaaaccgagggaaacgcccctaagctcctgatctatcgctgctatcctaagtttaacgaaaggtcgggtacccatacgaaaggttcagtggactaggtggatcgtaggaactagtactttcactctacacctatcagtactactaacaactagaagtatttgactaacttactactgtacaacagtacgttacaccttaccctcgtactacgtaccgtttcggcggtaacggaccgtaagggtcgaagactaaccgaaacgtaactgggtacgactagacctacgtgtccg

SEQ ID NO: 181671 - DNA, 507 bp, Homo sapiens
  misc_feature: GYAE6OF01ENFOU.2.39.D06.1.454.CMB.1.raw
  modified_base (275)..(275): a, c, t, g, unknown or other
  misc_feature (275)..(275): n is a, c, g, or t
  modified_base (411)..(411): a, c, t, g, unknown or other
  misc_feature (411)..(411): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaancccctaagctcctgatctatgctgcatccagttacaaagtgggtcccatcaagttcagtggcagtgatctggacagatttcactctcaccatcagtagtctacaacctgaagtattttagactaacttactaactntacaaacagagttacgacttacccctccgtctcgtactttcggcgacggaacaagggtgagataccaaacgtactgtcggctaggccaactgtccg

SEQ ID NO: 181672 - DNA, 547 bp, Homo sapiens
  misc_feature: GYAE6OF01B6AT9.2.39.D06.1.454.CMB.1.raw
  modified_base (223)..(223): a, c, t, g, unknown or other
  misc_feature (223)..(223): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaacaggaagcccctaagctcctgatctatgctgcatccagtttacaaagtgggtcccatcaaggttcagtggcagtggatcgtggacagatttcactctcaccatcagtagtctaacaacctgaagtatttgactaacttactactgtacaacagtaacgttacgacttaacccctccgtccttccaaccgttttccgggaccgggtacgggaaccgtaaagggtggaagtacgtaccgaaaacgtaaaccgttggtacggctaggccctaaccgtgttcccg

SEQ ID NO: 181673 - DNA, 488 bp, Homo sapiens
  misc_feature: GYAE6OF01BT3O5.2.39.D06.1.454.CMB.1.raw
  modified_base (223)..(223): a, c, t, g, unknown or other
  misc_feature (223)..(223): n is a, c, g, or t
  modified_base (485)..(485): a, c, t, g, unknown or other
  misc_feature (485)..(485): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccaggaaagcccctaagctcctgatctatgctgcatccagtttacaaagtggggtccatcaaggttcagtggcagtggatctggacagatttcactctcaccatcagtagtctaacaacctgaagtatttgactaacttactactgtcaacagagttacgatacccctcgctcactttcggcgaggaccaggtgagatcaaacgactgtggctgcaccntcg

SEQ ID NO: 181674 - DNA, 589 bp, Homo sapiens
  misc_feature: GYAE6OF01AEXFV.2.39.D06.1.454.CMB.1.raw
  modified_base (201)..(201): a, c, t, g, unknown or other
  misc_feature (201)..(201): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatccctccctgtctgcatctggtggganacagagtcatcatctctggccggnaagtcagtagtgttagtatttattaaattgtatcagttacaaaccgaggaacncccctaagctcctgatctatgctgactatacctaagtttaacgaaggttcggtacccagtacgtaaggttcgaggtggacgtaggtggacttcggtagggactagttactttaccacttcctacacctattacgtaagttacgtacctaacctaacgtagtaacgttactttacgaccttaacttactactacgtacaacgtacgtacgttaccgtaccctaccctcgtacctacgtacgttcgggacggtacggacgtaagggtcgtaagactacgaacgtacgtcggtcgactagacctacgtcttccg

SEQ ID NO: 181675 - DNA, 536 bp, Homo sapiens
  misc_feature: GYAE6OF01DU395.2.39.D06.1.454.CMB.1.raw
  modified_base (204)..(204): a, c, t, g, unknown or other
  misc_feature (204)..(204): n is a, c, g, or t
tcagacgctcgacacacgaccggtgctcgatttagtgacatctcggacgagttctttgggggacgccagtctcagtcaggacacagcatgggaccatgagggtccccgctcgagctcctgggctcctgctactctggctccgagatgccagatgtgacacccagatgacccagtcctccatcctccctgtctgcatctgtgganacagagtcatcatctcttgccgggacaagtcagagtgttagtatttatttaaattggtagtcacgttacaaaccaggaaagcccctaaagctcctgatcctatcgcttagacagtccagtttacaagtgggtcccatcagtcagtggcagtggatcgtggactagactttcactctcaccatcagtagtctaactaacctgaaagtattttgactaactttactacttgtacaactagtagttaccgtattacccctcgtctcgacgtttcggcggacggaccaaggtggagaagtccgaaagtaacgtagtcggactaggcaccgtgtccg

SEQ ID NO: 181676 - DNA, 521 bp, Homo sapiens
  misc_feature: GYAE6OF01CQVU5.2.39.D06.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (516)..(516): a, c, t, g, unknown or other
  misc_feature (516)..(516): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccgggnaagtcagagtgttagtatttattaaattggtatcagttcaaacaggaaacgcccctaagctcctgatctatgctgcatcctagtttaacaagtcgggtccatcgaaggttcagtggcagtggatgtagggacagtatttcactctcacctatacagtacgtactacactagtaagtatttcgactaacttactactcgtacaacagtacgttacgacttacccctcgctctacgttcggacggacggaccaaggtcgagtactacgaaacgacgtgtacggtctagaccacgtntaccg

SEQ ID NO: 181677 - DNA, 552 bp, Homo sapiens
  misc_feature: GYAE6OF01A8QL3.2.39.D06.1.454.CMB.1.raw
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
  modified_base (397)..(397): a, c, t, g, unknown or other
  misc_feature (397)..(397): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggtatcagttcaaacaggaaancccctaagctcctgatctatgctgcatccaagtttacaagtcggggtccatcaaggttcagtggcagtggatcgtggacagtatttcactctcaccatcagttagtctaacaacctagtaagtntttagactaactttactacttagtacaactaagtacgttacctaactacccctcgtactccgtaacgtttccgggacggacgggtaaccaagggtcggaagacgtacgaaaaccggaacgttaggtacgggacttagccgtaaacctgttacccg

SEQ ID NO: 181678 - DNA, 520 bp, Homo sapiens
  misc_feature: GYAE6OF01AZLRQ.2.39.D06.1.454.CMB.1.raw
  modified_base (223)..(223): a, c, t, g, unknown or other
  misc_feature (223)..(223): n is a, c, g, or t
  modified_base (514)..(514): a, c, t, g, unknown or other
  misc_feature (514)..(514): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccaggaaagcccctaagctcctgatctatgctgcatccagtttacaaagtggggtcccatcaaggttcagtggcagtgatctgggactagatttcactctacaccatcagtagtctacaacctgaagtatttgactaacttactactgtacaacagtagttacgtactacccctccgcctacctacgtttccggcggtaagggaccgtaagggtcggagatcgaaacgtaactgtcggactgcaccgngttccg

SEQ ID NO: 181679 - DNA, 647 bp, Homo sapiens
  misc_feature: GYAE6OF01DCTPF.2.39.D06.1.454.CMB.1.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgctatctggtggganacagagtcatcatctctggccggnaagtcagagttgttagttatttaatttaaagttggtatctagttaccaaacgagggaaactccctaagtcctctagatctatgctgactatccgtaagtttacgaaaggttcgggtacctatacgtaaggtcgaggtggactaggtgtatcggtacggaactagttacttacgtaccttactacaccgtattacgtaagttaccgtacctaaaccgtaaaccgtagttaaaggttatttacgaaccttaacgttaccttatacgtactaaacgtagtaccgttaaccgtaccttaaccccctcgtacgttacgttaccggtttacgggaccggtaaccgggaacgtaaacgggggtacgaaagtaactaaccggaaaacggtacgttacgggtacggtactaggaaccctagtacgtttaccg

SEQ ID NO: 181680 - DNA, 535 bp, Homo sapiens
  misc_feature: GYAE6OF01EX8HX.2.39.D06.1.454.CMB.1.raw
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacaggaancccctaagctcctgatctatgctgcatccagtttacaaagtcgggtccatcaaggttcagtggcagtggatcgtagggactagtatttcactctcacatcagtatctacaacctgaagtatttgactaactttactactgtacaacaagtacgttacgacttaccccgtcgtactccgtacgtttccgggacggtaacgggaacctaagggtcggagaactacgaaacgtaacgtcggtacggactagctaccgtgttaccg

SEQ ID NO: 181681 - DNA, 558 bp, Homo sapiens
  misc_feature: GYAE6OF01A8GG6.2.39.D06.1.454.CMB.1.raw
  modified_base (272)..(272): a, c, t, g, unknown or other
  misc_feature (272)..(272): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccgggcaagtcagagtgttagtatttattaaattggtatcagttcaaacaggaacncccctaagctcctgatctatgctgctatcctagttacaagtcgggtaccatcaaggttcagtggacagtggatgtggacaggtatttcactctccactatctagtactctaacaacctagtaagtatttacgactaactttactactgtacaactagtacgttacgacttaccccgtcgacctactaccgtttcgggaccgggtagggtaaccgtaagggtcggtaagtacgtaaccgtaaaacgacgttacggtacggacttacggaccctaaccgtcgttaccg

SEQ ID NO: 181682 - DNA, 573 bp, Homo sapiens
  misc_feature: GYAE6OF01AZCG2.2.39.D06.1.454.CMB.1.raw
  modified_base (221)..(221): a, c, t, g, unknown or other
  misc_feature (221)..(221): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttgccggnaagtcagagtgttagtatttatttaattggtatcagttcaaacaggaacgcccctaagctcctgatctatgctgctatccagtttacaaagtcggggtacccagtacgtaaggttcagtggcagtggatcgtagggacagtattcacgtctacactatcagttacgtactaactaacctagaagtattttacgactaactttaactacttacgtactaactaaggtacgttacgtacttacccctcgtactctacgtttcggacggtacgggaaccgtaagggtcggtaagtaagtacccgaaaacggtaaccgttaggtacgggtacttaggaccctaccgtagttcccgg

SEQ ID NO: 181683 - DNA, 524 bp, Homo sapiens
  misc_feature: GYAE6OF01EHMBV.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaacaggaaagcccctaagctcctgatctatgctgcatccagtttacaaagtggggtcccatcaaggttcagtgcagtggatctgggacagtatttcacttctcaccatcagtagtctaacaacctgaagtattttgactaactttactaacttgtacaaactagtagttaacgattaaccccctccgactcctactttcgggcggtagggaccctaagggtggaagagtacaaacgaataggtcggactagcaccatccg

SEQ ID NO: 181684 - DNA, 652 bp, Homo sapiens
  misc_feature: GYAE6OF01C7ALB.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgctggcaagtcagagtgttagtatttatttaaattggtatctagttacaaaccgaagggaaacgcccctaagctacctgatctatgctgcataccgtagtttaacaaggtcgggtacccagttacgaaggttacagtcggctaggtaggacgtcgtacggaactaggttactttccaacttcctaccaacctacttacgtaacgttacgtacctaaactaacccgttagtaaacgttacgttttacgaccttaaaccttttactaaccgttagttaaccaaacgtacggttaacgtttaaccgtaacccttacccccttaccgtaccttaccgtaacggtttccgggaaccgggtaacgggtaacccgaaggggttacggaacgtaccgtaaccgaaaacggtaacgttgggtacgtacgtcgaccgtaccgtacg

SEQ ID NO: 181685 - DNA, 523 bp, Homo sapiens
  misc_feature: GYAE6OF01EMEFZ.2.39.D06.1.454.CMB.1.raw
  modified_base (275)..(275): a, c, t, g, unknown or other
  misc_feature (275)..(275): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaaccagggaaancccctaagctcctgatctatgctgcatcagtttacaaagtgggtacccatcaaggttcagtggcagtgatcgtgggacagatttcactctcacatcagtagtctacaacctgaagtatttgactaacttacttactcgtacaaacagtaacgttacgtactacccctccgtactccgtactttcgggacggtacgggaccgaaggtggagagtaccaaacgtaactggtacggctagccaccgtatcg

SEQ ID NO: 181686 - DNA, 488 bp, Homo sapiens
  misc_feature: GYAE6OF01DUOM3.2.39.D06.1.454.CMB.1.raw
  modified_base (223)..(223): a, c, t, g, unknown or other
  misc_feature (223)..(223): n is a, c, g, or t
  modified_base (485)..(485): a, c, t, g, unknown or other
  misc_feature (485)..(485): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccaggaaagcccctaagctcctgatctatgctgcatccagtttacaaagtggggtcccatcaaggttcagtggcagtggatctgggacagatttcactctcaccatcagtagtctacaacctgaagattttgactaacttactactgtacaacagagttacgatacccctcgctcactttcggcgaggaccaggtgagatcaaacgactgtgctgcacntcg

SEQ ID NO: 181687 - DNA, 554 bp, Homo sapiens
  misc_feature: GYAE6OF01C3A53.2.39.D06.1.454.CMB.1.raw
  modified_base (201)..(201): a, c, t, g, unknown or other
  misc_feature (201)..(201): n is a, c, g, or t
  modified_base (547)..(547): a, c, t, g, unknown or other
  misc_feature (547)..(547): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacngagtcatcatctcttgccggcaagtcagagtgttagtatttatttaaattggtatcagttacaaaccaggaaagcccctaagctcctgatctatgctgcatccagtttaacaagttggtccatcaaggttcagtgcagtggatcgtgggacagtatttcacttctcaccatcagtagtctaacaacctgaagtattttgactaactttactacttagtacaacgtaagtacgtttaaccgtacttacccctcgtaccttccaccgttttccgggacgggtaacgggaccgtaaagggtcggaagtacgtacgtaaacgtaacgtgtacgggacctggacctaccgngttaccg

SEQ ID NO: 181688 - DNA, 522 bp, Homo sapiens
  misc_feature: GYAE6OF01CFYBX.2.39.D06.1.454.CMB.1.raw
  modified_base (221)..(221): a, c, t, g, unknown or other
  misc_feature (221)..(221): n is a, c, g, or t
  modified_base (348)..(348): a, c, t, g, unknown or other
  misc_feature (348)..(348): n is a, c, g, or t
  modified_base (393)..(393): a, c, t, g, unknown or other
  misc_feature (393)..(393): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccggnaagtcagagtgttagtatttattaaattggtatctagttacaaaccgaggaaacgcccctaagctcctgatctatgctgcatcagtttacaaagtcgggtccatcaaggttcagtgcagtggatcgnggacagtatttcactctacacatcagtagtactaacaactgaatntttagactaacttactatagtacaactagtacgttactacgtaccccgtaggtaccggttaccggaccgaacggaccgaaggtacgaaacgtacgaaagaactggacggtctcgacacatctgtcttcc

SEQ ID NO: 181689 - DNA, 681 bp, Homo sapiens
  misc_feature: GYAE6OF01C0DUK.2.39.D06.1.454.CMB.1.raw
  modified_base (636)..(636): a, c, t, g, unknown or other
  misc_feature (636)..(636): n is a, c, g, or t
  modified_base (670)..(670): a, c, t, g, unknown or other
  misc_feature (670)..(670): n is a, c, g, or t
tcagacgctcgacacacgaccggtgctcgatttagtgacatctcgcagttctttgggggagccagtctcagtcaggacacagcatggacatggagggtccccgctcagctcctggggctcctgctactctggctccgagatgccagatgtgacacccagatcgacccagtcctccatccctccctgtctgcatcgtggtgggagacagagtcatcatctcgttcggccggtacaagtcagtagttagtttaagttaattttaattaaattggtaatctaagttacaaaacccgaagggtaaaccgacccccgtaaagtccgtacccgtagtaactactagtcggtactcgactaacttacctaagttttaaccgaaaggttccggggtaccctaagttaccgttaaacgggttccgtaaggtcggtacgtaaggttcgggtacgttcggtacgggaactaacggtactttacctaaccgttaccgtacctaacctaacgtacgtaagttacgtactaacctaaccgtagtaagttactttacgaccttaacttactactacgtaacaacgtaagtacgttaacctacctacccctccgtactcgtacgttcggacggtacggacgtaaggtacganacgtaaccgaaacgtacgtagtcgtacgtagacnccgtattaccg

SEQ ID NO: 181690 - DNA, 570 bp, Homo sapiens
  misc_feature: GYAE6OF01EWJM1.2.39.D06.1.454.CMB.1.raw
  modified_base (199)..(199): a, c, t, g, unknown or other
  misc_feature (199)..(199): n is a, c, g, or t
  modified_base (224)..(224): a, c, t, g, unknown or other
  misc_feature (224)..(224): n is a, c, g, or t
  modified_base (564)..(564): a, c, t, g, unknown or other
  misc_feature (564)..(564): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttaatttaaattggtatcagttacaaacagggaaacgcccctaagctcctgatctatgctgcatctaagtttacaaaggtcggggtccagtcgaaggttcagtggcagtgatcgtagggactagtatttcactctacaccatcaagttagtacctaactaacctagaagttattttacgacttaactttactactagtacaactagtaacgttaaccgtaccttaacccctctacctaccttacggtttccgggacggtaacgggaacgtaacgggtggtaagaactaacgaaacgaacgtggtacggctagcctaaccgtnttaccg

SEQ ID NO: 181691 - DNA, 784 bp, Homo sapiens
  misc_feature: GYAE6OF01BYFF1.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccatccctcctgtctgcatcgtggtggagacagatcatcatctcgtcggaccggacaagtcgagtagttagttagttaattttaatttaaagtttggtaattacgtaagtttaccgaaaaaccggtaaggggtaaaacccgtacccctaaaggtcccttacccgtagtaactttaccgttaagtcgtcgttacgacctaacgttacccgtaaagttttaaaccgaaagggttccgggtaccctaagttaccgtaaggtttcagggtcgagtaggtacggtacgttcgtagggaactacgtttactttaccacgttacctaccgtaaccgtacgtacgtaagttaaccgtaacctaaaccgtaaaccgttaagtaaacgtttaacgttttaccgaacctttaaacgtttaaccgttaactaggttaacctaaacggtaacgttaaccggttaaccgtaacccgttacccccttaccgttacccgtaccggttacccggtttacggggaccgggtaaccgggtaaaccgtaaggggtcggtaaagtaaccgtaaaccgaaaccggttaacgtagggttacccgtacgtaacgtacccgtaagttaccgttaccg

SEQ ID NO: 181692 - DNA, 588 bp, Homo sapiens
  misc_feature: GYAE6OF01CB1KO.2.39.D06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
  modified_base (377)..(377): a, c, t, g, unknown or other
  misc_feature (377)..(377): n is a, c, g, or t
  modified_base (575)..(575): a, c, t, g, unknown or other
  misc_feature (575)..(575): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgganacagagtcatcatctcttgccgganaagtcagagtgttagtatttattaaattggtatcagttcaaacgaggaaacnccctaagctcctgatctatgctgcatcctaagtttacaaaggtcgggtaccagtcgaaggttcagtgcagtgatcgtggactgtatttcacgtctcgaaccntacagtagtactaactactagaacgttatttacgaccttaacttactacgttagtaaccaactaacggtaacgtttaccgaaccttacccccgtcgtaccttaccgtaaccgtttcgggacggaacgggtaacccaaggggttcggaactaacggtaacctaaaacgggactttacgggacgtacccgtattaacccnccgtaagtttccg

SEQ ID NO: 181693 - DNA, 551 bp, Homo sapiens
  misc_feature: GYAE6OF01C1Z84.2.39.D06.1.454.CMB.1.raw
  modified_base (223)..(223): a, c, t, g, unknown or other
  misc_feature (223)..(223): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggnaagtcagtagtgttagtattttatttaaattggtatcagttacaacgaggaaacgcccctaagctcctagatctatgctgcatccagtttaacgaaaggtcggggtccagtacgaaggttcgagtggctaggtggatcgtgggactagtatttcacttctctaccatcaagtactactaacactagaatatttacgactaacttactactgtacaactagtagttacgtactacccctcctcttacctaccgtttcggacgggtacgggaccgaagggtcggaagtaacgtacgaaacgtaacgtggtacggactcgaccactgttcg

SEQ ID NO: 181694 - DNA, 629 bp, Homo sapiens
  misc_feature: GYAE6OF01D0X4A.2.39.D06.1.454.CMB.1.raw
  modified_base (397)..(397): a, c, t, g, unknown or other
  misc_feature (397)..(397): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatccctccctgtctgcatctggtgggagacagagtcatcatctcttgcggcaagtcagagtgttagttatttaatttaaattggtatctagttacaaaccgagggaaacgcccctaagctcctgatctatgctgcatcctaagtttacaaacggtcggggtcccatacgtaaggttcaggtggcgtaggtggtatcgtgggacagtatttccactctcaacctntactagtagtacctaacgtaacctagtaagtacttttagactaactttactactacgtacaaacgtagtaacgttaaccgtaccttaccccgtctaccgttaccgtaccggttttccgggaccggggtaacgggtaacccgtaaggggttacggaaggttaacgtaacccgaaaaaccgggttacgttaacgggtacgggttaccctagggtaacccctacgaccgtttacg

SEQ ID NO: 181695 - DNA, 595 bp, Homo sapiens
  misc_feature: GYAE6OF01DS0EV.2.39.D06.1.454.CMB.1.raw
  modified_base (198)..(198): a, c, t, g, unknown or other
  misc_feature (198)..(198): n is a, c, g, or t
  modified_base (379)..(379): a, c, t, g, unknown or other
  misc_feature (379)..(379): n is a, c, g, or t
  modified_base (590)..(590): a, c, t, g, unknown or other
  misc_feature (590)..(590): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctggccggacaagtcagagttgttagttatttaatttaagttggtatcgtaagttaccaaaccgagggaaacgtacccctaagtcctcctagatctatgctgactatacctagttaacgaaggtcgggtacccagtacgtaaggttcgagtggactaggtgatcgnggacagtacttcacttctaccactatcgtagtacgtactaactaaccgtagtaattactttacaacttaactttactacgtagtacaacgtacgtacgttaccgtacctacccctcgtctaccgtacgttccgggacggaccggtaacgaaggtacggaataacgttaaccgaaaccgtacgtaggtacgtaccgaggtaccctaaccgtnttccg

SEQ ID NO: 181696 - DNA, 531 bp, Homo sapiens
  misc_feature: GYAE6OF01ECVJN.2.39.D06.1.454.CMB.1.raw
  modified_base (198)..(198): a, c, t, g, unknown or other
  misc_feature (198)..(198): n is a, c, g, or t
  modified_base (361)..(361): a, c, t, g, unknown or other
  misc_feature (361)..(361): n is a, c, g, or t
  modified_base (526)..(526): a, c, t, g, unknown or other
  misc_feature (526)..(526): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtattttattaaattggtatcagttacaaaccagggaaagcccctaagctcctgatctatgctgcatcctaagtttacaaaggtcggggtccatcaaggttcagtggcaggtggatcgtggganagtattcactctcactatcagttagtctaacaacctagaagtattttacgactaactttactacttgtacaaacagtagttacgtactacccctacgctctacgttcggacggtacgggaccgagggtacggagatacaaacggtactggtggactaggccacgnttccg

SEQ ID NO: 181697 - DNA, 568 bp, Homo sapiens
  misc_feature: GYAE6OF01CSRNF.2.39.D06.1.454.CMB.1.raw
  modified_base (222)..(222): a, c, t, g, unknown or other
  misc_feature (222)..(222): n is a, c, g, or t
  modified_base (276)..(276): a, c, t, g, unknown or other
  misc_feature (276)..(276): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctctgccggnagtcagagtgttagtatttatttaaattggtatcagttacaaaccgaggaaacncccctaagctcctgatctatgctgcatcagtttacaagtcggtccatcaagttcagtgcagtgatcgtggactagtatttcacttctcaccatcagtacgtactaacacctgaagtatttcgacttaacgttactactagtacaaacgtagtaacgtttaaccgaccttaccccttccgaccttccgtaaccgtttccgggacgggtaaacgggtaccgtaagggtacggagtaacgtaaccgaaaacgtaacgttgggtacggaccttaggacctaaccgtcgtttacccg

SEQ ID NO: 181698 - DNA, 689 bp, Homo sapiens
  misc_feature: GYAE6OF01C9IV2.2.39.D06.1.454.CMB.1.raw
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagacgctcgacacacgaccggtgctcgatttagtgacatctcgcaggttctttgggggagccagtctcagtcaggacacagcatggacatgagggtccccgctcagctcctggggctcctgctactctggctccgagatgccagatgtgacacccagatcgacccagtctccatccctccctgtctgcatctgnggganacagagtcatcatctcgtgccggganaagtcagtgtagttagtaattttaattaaattggtatactaagttacaaaaccgaggggaaactacccctaaagctaccgtgactactatggctgctaactcctaagttaacaaacggttcgggtacccaagtacgtaaaggttccaaggtcggtacctaggtacggtacgtaccgtgggaaaccttagttaactttccaaccttcctacctaaccactaaccgtaaggttacgttactaaacctaaccgttagtaaagttaacgttttacgaacttaaacctttaactaacgttacgtaactaaacgtaagtaacgtttaacggacccttaccccgtacgtacctacgttaacggtttaccgggaacgggtaaccgggtaacgtaaacgggtacggtaaggtaacttaaaccgaaaaccgtacgttacgggtacgtactcgtaccctaaccgtcttaccgg

SEQ ID NO: 181699 - DNA, 533 bp, Homo sapiens
  misc_feature: GYAE6OF01BIDYM.2.39.D06.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctcttgccggnaagtcagagtgttagtatttatttaaattggtatcagttcaaacagggaanccctaagctcctgactctatgctgcatcagtttacaagtgggtccagtcaaggtcagtgcagtgatctggacagattcactctacaccatacatagtctacaacctagaatatttgactaacttacttactgtacaaactagtaacttaccgtaacttcccctaccgtctactaccgttcgggacggtacgggaaccgtaagggtggaacgtaataccgaaacgtaagtacgttcgggactagaccaccgtgttacccg

SEQ ID NO: 181700 - DNA, 583 bp, Homo sapiens
  misc_feature: GYAE6OF01E0O77.2.39.D06.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (568)..(568): a, c, t, g, unknown or other
  misc_feature (568)..(568): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatcctcctgtctgcatctggtggganacagagtcatcatctcttggccggganaagtcagtagtgttagttatttaatttaaagttggtatctagttacaaacgaagggaacncccctaagcctctgattctatcgntgctatacctaagtttaacaaaggtcgggtacctagtacgtaaggttcaggtggctaggtgtactcgtaggactagtactttcactctacacatctagttacgtactactaacctgtaacttatttcgaacttaacttactacgtatacaagtaacgtacgttaccacctaccccttcgtccttacgtaccgttcgggaccggtacgggaaccgtagggtcggaagactaccggaaacgtagtcggtacgacgtaccncgtaacctgttaccg

SEQ ID NO: 181701 - DNA, 503 bp, Homo sapiens
  misc_feature: GYAE6OF01A0XQT.2.39.D06.1.454.CMB.1.raw
  modified_base (275)..(275): a, c, t, g, unknown or other
  misc_feature (275)..(275): n is a, c, g, or t
  modified_base (425)..(425): a, c, t, g, unknown or other
  misc_feature (425)..(425): n is a, c, g, or t
  modified_base (481)..(481): a, c, t, g, unknown or other
  misc_feature (481)..(481): n is a, c, g, or t
  modified_base (498)..(498): a, c, t, g, unknown or other
  misc_feature (498)..(498): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaatggtatcagttcaaaccagggaaancccctaagctcctgatctatgctgcatcctagtttacaaagtgggtacccatcaaggttcagtggcagtgatcgtgggacagtatttcactctacaccatcagtagtctaacaacctgtaagtatttcgactaacttactactgtacaanagacgttaacacttacccctcgactcctactttcggcgtaggaccaaggtgagtancaaacgatgtgctagcncatcg

SEQ ID NO: 181702 - DNA, 541 bp, Homo sapiens
  misc_feature: GYAE6OF01E05XM.2.39.D06.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagagtgttagtatttatttaaattggtatnagttcaaacagggaaancccctaagctcctgatctatgctgcatcctagtttacaaaggtcgggtcccatcaaggttcagtggcaggtgatcgtgggactagtatttcactctacaccatcagtactctaacaacctgaagtatttgactaacttactactgtacaagagtacgttaccgacttacccctcgtcctacgtacgttcgggaccggtacgggaccgtaagggtcggaagtaacgtacgaaaacgtacttaggtcggactcggacctacgtgttaccg

SEQ ID NO: 181703 - DNA, 547 bp, Homo sapiens
  misc_feature: GYAE6OF01BVOVQ.2.39.D06.1.454.CMB.1.raw
  modified_base (223)..(223): a, c, t, g, unknown or other
  misc_feature (223)..(223): n is a, c, g, or t
  modified_base (541)..(541): a, c, t, g, unknown or other
  misc_feature (541)..(541): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttattaaattggtatcagttcaaacgaggaacgcccctaagctcctgatctatgctgcatccagtttacaagtcgggtccatacgaagttcaggtggctaggtgatcgtgggacagtatttcactctacacctatacagtagtactacaacctgaagtatttgactaacttactactagtacaacgagtaacgttaccgtacttacccctcgtctcctacgtttcgggacggtaacgggacccgtagggtacggtagaagtaccgaaacggtacgtacggtacggactacggctacccgnttaccg

SEQ ID NO: 181704 - DNA, 631 bp, Homo sapiens
  misc_feature: GYAE6OF01BVY1V.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatcctccctgtctgcatctgtgggagacagatcatcatctcgttgcggcaagtcagagtgttagtatttaattaattggtatctagttacaaaccgaaggaacaccctaagctcctagatctatgctgcatactaagtttacgaaaggttcggggtacctagtacgtaaaggtttcgaaggttggacctaaggtggtacttcggtagggacctaggtactttccaacgttcctacgtaccacgttacgtaagtacgttaccgtaacctaaccgtagtaaagtttctttacgacttaacctttactacgttacgtactaaatacggtaactttacgtaaccccttacccgttcctacttccctaccggtttacgggaccggtacgggaaccgtaagggtcggtaacagttaaacccgaaggtaaccgttggtacgacctagacctaacgtcgttacccg

SEQ ID NO: 181705 - DNA, 597 bp, Homo sapiens
  misc_feature: GYAE6OF01BE874.2.39.D06.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacagggaaacncccctaaagctcctgactctatgctgcatcagtttacaagtgggtccatcgaaggttcacggtggctagtggatcgtggaccagtactttcacttctacgaccatcaagttacgtctaacaacctagtaagtattttagactaactttaacgtacttagtaccaaacgtaacgtagttaaccgtaccttaaccccttcccgtaccgttccttaaccggttttcccggggacgggtaaccgggtaaccgtaaagggtcggtaagtacgtacgtaaaaccgtaacgttggtacgggtacttaggaccctaccgtagttacccg

SEQ ID NO: 181706 - DNA, 607 bp, Homo sapiens
  misc_feature: GYAE6OF01CNMQ1.2.39.D06.1.454.CMB.1.raw
  modified_base (228)..(228): a, c, t, g, unknown or other
  misc_feature (228)..(228): n is a, c, g, or t
  modified_base (599)..(599): a, c, t, g, unknown or other
  misc_feature (599)..(599): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtcctccactccctccctgtctgcatctggtggagacagagtcatcatctcgtggccggnaagtcagtagttgttaagttattttaattaagttggtatcgtaagttacaaaccgtaaggaacctcccctaagtcctacctagactctatgctgactactacctaagttaacgaaggtcggtaccagtacgtaagttcgagtgacgtaggtgtatcgtaggatagtactttcacctctacgacctagtacgtacgttacgtacctaacgtaacgtagtaagttatttacgaacgttaaccttactacgtacgtaacgtaactaagtaccgttaaccaccttacccctcgtacttaccgtaccgttacgggacggaccggtaacgtaggtacggaatacgtacgtaaacgtacgtcgtacgacgaccgtacncgtgtccg

SEQ ID NO: 181707 - DNA, 566 bp, Homo sapiens
  misc_feature: GYAE6OF01CGOX4.2.39.D06.1.454.CMB.1.raw
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (457)..(457): a, c, t, g, unknown or other
  misc_feature (457)..(457): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtgganacagagtcatcatctctgccggnaagtcagagttgttagtatttaattaaattggtatctagttacaaaccgagggaaacgtacccctaagctacctgatcctaatcgactgacatccaagtttaacaaaggttcgggtacccagtacgaaaggttcgaagtggactaagtggatcgttgggaacaggtactttcacgttctacaccattcgaagttacgtactaactaaccgtagtaagtatttgactaacttactagtntaacgaactagtacgtaaccactaccccgtctactcctacgtttacgggacggtaacggaacgaaggttcggagactaacgaaacgaattggacgctagctacgattcg

SEQ ID NO: 181708 - DNA, 574 bp, Homo sapiens
  misc_feature: GYAE6OF01C2MMI.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcagtcagagtgttagtatttatttaaattggtatcagttacaaaccgaggaaacgcccctaagctcctgatctatgctgcactcctaagtttaacgaaggtcggggtacccagtacgtaaggttcgaggtggcaggtggagtcgtagggactagtactttcactctcactatcagtactactacacgtagagttattgactaacttactactgtacaacgtagtacgttacctacgtacccctccgtaccttaccgtacgtttccgggacgggtaacgggtaccggaagggtggaagtacgtaaccgaaaacggtaccgttaggtcggtactaggaccctacgtcgttaccg

SEQ ID NO: 181709 - DNA, 727 bp, Homo sapiens
  misc_feature: GYAE6OF01CW5IB.2.39.D06.1.454.CMB.1.raw
  modified_base (202)..(202): a, c, t, g, unknown or other
  misc_feature (202)..(202): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtctccatccctccctgtctgcatctggtggganacagagtcatcattctcgttcggccgggctaagtcaagtagttgtttaagttattttaatttaaagtttggtaatccgtaagtttaccgaaaaccgacgggaaacgaccccgttaaacgctacctagactacgtatgctacgctaactcctaaggttaacaaggtcggggtacctatacgtaaggttcaggtgacgtaaggtaggcttacggtacgggaactaacgttactttccgtaaccttaccgtaccaccgtaactacgaacggttacgtacctaaacctaccgttaagtaacggttaagttttacgtaacgtaacctttaacctacttaacgttacgtaaacctaaggttaacggttacccgtaccgttaaccccgttacccgtaccgtttccgtaaccggttttaccgggaccgggtacgggaaaccgggtaacgggtaacggttaggaaacttaaccggaaaacggttaccgtaacgggtcggtacggttacgacccggtaacctcggtttaacccgg

SEQ ID NO: 181710 - DNA, 605 bp, Homo sapiens
  misc_feature: GYAE6OF01BO3SU.2.39.D06.1.454.CMB.1.raw
  modified_base (204)..(204): a, c, t, g, unknown or other
  misc_feature (204)..(204): n is a, c, g, or t
tcagacgctcgacacacgaccggtgctcgatttagtgacatctcgctagttctttgggggagccagtctcagtcaggacacagcatggacatgagggtccccgctcagctccgtgggctcctgctactctggctccgagatgccagatgtgaccacccagatcgacccagtcctccatccctccctgtctgcatctggtggganacagatcatcattcctcttcggcccggtacaagtcaagagttaggttaagttaattttaattttaaaatttgggtacttctaagttaccaaaacccgaaggggaaacgccccgtaaagcctaccgtgactctatgctgcatcctaagtttacgaaggtcggggtaccctatctaaggttcagtcggtacaggtcgagtcgtagggactagtactttacacgtctaccactactactagtacgtctaacaacctagtaatatttagactaacttactactagtacaatagtacgttacgtacctaccctcgcctactaccgttcggcgggtaacggaccgtaagggtgaagtactaacgtaaacgacgttaggtacgtaccgtagacccacgtacgttaccg

SEQ ID NO: 181711 - DNA, 502 bp, Homo sapiens
  misc_feature: GYAE6OF01D7X3Y.2.39.D06.1.454.CMB.1.raw
  modified_base (222)..(222): a, c, t, g, unknown or other
  misc_feature (222)..(222): n is a, c, g, or t
  modified_base (419)..(419): a, c, t, g, unknown or other
  misc_feature (419)..(419): n is a, c, g, or t
  modified_base (499)..(499): a, c, t, g, unknown or other
  misc_feature (499)..(499): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctctgccgggnaagtcagagtgttagtatttatttaaattggtatcagttcaaaccagggaaagcccctaagctcctgatctatgctgcatccagtttacaaagtcgggtccatcaaggtcagtgcagtggatctgggacagtatttcactctcaccatcagtacgtctaacaacctgaagtatttgactaacttactactgtacaanagtagttacgactaccccgtcgacttctacgttcggacggacggaccaagggtgagatacgaaacgatgtggctgactcntcg

SEQ ID NO: 181712 - DNA, 588 bp, Homo sapiens
  misc_feature: GYAE6OF01EU7U6.2.39.D06.1.454.CMB.1.raw
  modified_base (198)..(198): a, c, t, g, unknown or other
  misc_feature (198)..(198): n is a, c, g, or t
  modified_base (214)..(214): a, c, t, g, unknown or other
  misc_feature (214)..(214): n is a, c, g, or t
  modified_base (277)..(277): a, c, t, g, unknown or other
  misc_feature (277)..(277): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctnttgccgggcaagtcagagtgttagtatttatttaaattggtatcagttacaaacagggaaacncccctaagctcctgatctatcgctgcatccagtttaacaaaggtcgggtacccatacgaaggttcagtggcaggtggtatcgtagggactagtactttcgacttctccaacctataccgtagttacgtactaactaaaccgtagtaacgttattttacgactaaccttaacttactntacaaactaagtacgttacgacctaccccgttccnctacctacgttccgggacggtacgggaacccgtaagggtacgaagaactaacgaaaccgtaacgtcggtacggtactacgacctaaccgtcgttaaccg

SEQ ID NO: 181713 - DNA, 672 bp, Homo sapiens
  misc_feature: GYAE6OF01BYR2U.2.39.D06.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (664)..(664): a, c, t, g, unknown or other
  misc_feature (664)..(664): n is a, c, g, or t
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtgacacccagatcgacccagtctccatcctcctgtctgcatctggtggganacagagtcatcatctctggccgganaagtcagtagttgttaagttattttaattaaagttgtatactagttacaaacgaggaaacacccctaagcctcgtntatctatgctgcattccgtaagtttaacgaaggttcgggacctagtacgtaaggttcaggtcggacgaggtaggtacttcggtagggtaacctaggttactttaccaccgttctaccgaacctacgttactaacggttacgttacctaaaccgtaacgttagtaaacgtttagtttacgaacttaaccgtttactacgtacgtaactaacgtaggtaaccgtttaaccgtacccttaccccgtacgtaccttaccgttaaccggttccggggaaccgggtaaccggtaacccggtaagggtcggtaaacgaacgttaaccgaaaccggtacgttcggtacggtactaacggacccttaacgtntttacccg

SEQ ID NO: 181714 - DNA, 595 bp, Homo sapiens
  misc_feature: GYAE6OF01EL7X8.2.39.D06.1.454.CMB.1.raw
  modified_base (198)..(198): a, c, t, g, unknown or other
  misc_feature (198)..(198): n is a, c, g, or t
  modified_base (283)..(283): a, c, t, g, unknown or other
  misc_feature (283)..(283): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttggccggcaagtcagagtgttagttatttaatttaaattggtatctagttacaaaccgtagggaaacncccctaagctactgatctatgctgctatcctaagtttaacaaaggtcgggtacccagtacgtaaggttcaggtggacaggtggatcgtaggacagtattcactctcacatacagtactactaacaacgtagtaacgttatttacgaacttaactttaactacttacgaactaaacgtaagtaacgttaaccgtacccttacccctacgtaccgttaccttaccgttcgggaccgggtaacgggaaccgtaagggtacggaagtacgtaaccgaaaacgtacgtacggtagactaggacctacgtcgttaccg

SEQ ID NO: 181715 - DNA, 655 bp, Homo sapiens
  misc_feature: GYAE6OF01C3WC9.2.39.D06.1.454.CMB.1.raw
  modified_base (200)..(200): a, c, t, g, unknown or other
  misc_feature (200)..(200): n is a, c, g, or t
  modified_base (226)..(226): a, c, t, g, unknown or other
  misc_feature (226)..(226): n is a, c, g, or t
  modified_base (309)..(309): a, c, t, g, unknown or other
  misc_feature (309)..(309): n is a, c, g, or t
tcagacgctcgacacacgaccggtgctcgatttagtgacatctcgcagttctttgggggagccagtctcagtcaggacacagcatggacatgagggtccccgctcagctccctggggctcctgctactctggctccgagatgccagatgtgacacccagatcgacccagtctccatcctccctgtctgcatctgtggganacagagtcatcatctcgttgccgggntaagtcagtagtgttagttattttattaaattggtatctagttacaaacgaggaaacgaccctaagctccgtgatctatgctntcactcctaagtttaacgaaggttcgggtacctagtacgtaaacggtctaaggtggacgtaaggtcgtacgttcgtaggggaactaggtactttcgaccttacctacaaccgtactaccgtaggttaactaccgttaaacctaaacccgttagtaaacggttacttttacgaccttaacgtttacctaagtacgtaactaaacgtaaggtaacgttaccgaaccttaccccgtaccgtaccttactaccggtttcgggaaccggacggggtaccgaaagggtcggaaggtaactaaccgtaaaacggtaacgttggtaccggtactacgaccctaccgtagttccg

SEQ ID NO: 181716 - DNA, 614 bp, Homo sapiens
  misc_feature: GYAE6OF01ER5A2.2.39.D06.1.454.CMB.1.raw
  modified_base (418)..(418): a, c, t, g, unknown or other
  misc_feature (418)..(418): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctctcggcgggacaagtcagtagtgttagttatttaatttaagttggtatctagttacaaccgaaggtaacgccctaagcttcctagtatactatgtctgactactacgtaagtttaacgaacggtcgggtacctaagtaccgtaaggttcgaggtcggacgtaggtggtagtcggtaggacgtagtagtttccactcctacaccgtnttacgagtaactacaactaacgtagtaagttctttacgacttaacttactactagtaacaacgtacgtacgttaccctacctacccgtctaccttacgtacgttccggggaacggtacggtaacccggtaagggtacggaagtaacgtaaccgaaacggttacgtggtacgtccgtagacccgtaacttgttacgg

SEQ ID NO: 181717 - DNA, 528 bp, Homo sapiens
  misc_feature: GYAE6OF01ESKW9.2.39.D06.1.454.CMB.1.raw
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (378)..(378): a, c, t, g, unknown or other
  misc_feature (378)..(378): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatccatctcttgccgggcaagtcagagtgttagtatttatttaaattggtatnagttacaaacaggaacnccctaagctcctgatctatgctgcatcctagtttacaagtcgggtacccatctaaggttcagtggcagtggatcgtggactagtactttcacttctacactntactagtagtctaacaacctagtaatatttcactaacttatactagtactaacagtagttacgtactaccctcgtctactaccgttcggacggacggacctaagggtgagagtccgaaacgacgtaggtcgacttacgactacgtgtacg

SEQ ID NO: 181718 - DNA, 629 bp, Homo sapiens
  misc_feature: GYAE6OF01BKEFE.2.39.D06.1.454.CMB.1.raw
  modified_base (285)..(285): a, c, t, g, unknown or other
  misc_feature (285)..(285): n is a, c, g, or t
  modified_base (623)..(623): a, c, t, g, unknown or other
  misc_feature (623)..(623): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatccctccctgtctgcatctggtgggagacagagtcatcatctcttggccgggcaagtcagtagtgttagttatttatttaaattggtatctagttacaaacgagggaaacnccctaagcctctgatctatgctgctatacctaagtttaaccgaaggtccgggtacctagtacgtaaggttctaggtggacgtaggtggtactcgtggaacttagtactttacacttctacctacctatcgtaagttacgtacctaactaaccgtagtaacgttacttttacgaaccttaactttaactacgtacgttaaccaaacgtaacgttacgttaaccgtaccccttaccccttccgaccttaccgtaccgtttcggggaccggtacgggaacctagggtacggagtaacgtaaccgaaacggtacgttacggtcggactacggacctaccgtnttaccg

SEQ ID NO: 181719 - DNA, 652 bp, Homo sapiens
  misc_feature: GYAE6OF01DGETH.2.39.D06.1.454.CMB.1.raw
  modified_base (104)..(104): a, c, t, g, unknown or other
  misc_feature (104)..(104): n is a, c, g, or t
  modified_base (205)..(205): a, c, t, g, unknown or other
  misc_feature (205)..(205): n is a, c, g, or t
  modified_base (435)..(435): a, c, t, g, unknown or other
  misc_feature (435)..(435): n is a, c, g, or t
  modified_base (484)..(484): a, c, t, g, unknown or other
  misc_feature (484)..(484): n is a, c, g, or t
  modified_base (544)..(544): a, c, t, g, unknown or other
  misc_feature (544)..(544): n is a, c, g, or t
tcagacgctcgacacacgaccggtgctcgatttagtgacatctcgcagttctttgggggagccagtctcagtcaggacacagcatggacatgacgggtccccgntcagctccgtggggctcctgctactctggctccgagatgaccagatgtgaccaccagatcgacccagtcctccatccctcctgtctgctatctggtggganaccgagtacgtctatctacttccgttcgtcgggccggtactaagtcgagtaggttagtttaagtttaattttaaattttaagttaggttacttacgtaacgttaaccgaaaaccggtaacgggtaaaccctaccccgttaaggtccttccgtagtactaccttagcgtctcgtactactaccgttaaggttaaccgaagggtccggtacctacgtacggtacggttacgngggtacgagtggtggtactcggtaggactagtcttacacttcacctacncgttactagtactactactacgtaagtacgtttatcaacttactactacgtactacgaanagttaccgtacgtaaccctccctcgtctaccgttcggtacggacggtaccggagtacggtggaactacgaacgtaacgtgtacggtccgataccactacgtgttaccg

SEQ ID NO: 181720 - DNA, 614 bp, Homo sapiens
  misc_feature: GYAE6OF01EG2Z4.2.39.D06.1.454.CMB.1.raw
  modified_base (198)..(198): a, c, t, g, unknown or other
  misc_feature (198)..(198): n is a, c, g, or t
tcagacgctcgacacacgaccggtgctcgatttagtgacatctcgcagttctttgggggagccagtctcagtcaggacatagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagttatttaatttaaattggtatctagttacaaaccgaggaacgcccctaagctcctgatctatgctgacatcctaagtttaacaaaggtcggggtacccaagtacgtaaggttcgaggtggactaggtggtactcgtgggaactagtactttcacttctacacctatctagtacgtactaactaactagtaagttatttacgacttaactttactactacgtacaacgtagtaacgtttaccgaaccttaccccgtccgtaccttaccgttaccggtttccgggaccgggtaaaccgggtaaccgtaaggggtacggaagtaacgtaccgaaaaccgtacgtacggtacggtactacggaccctaaccgtgttaccg

SEQ ID NO: 181721 - DNA, 583 bp, Homo sapiens
  misc_feature: GYAE6OF01EUI4C.2.39.D06.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgaccccagtctccatcctccctgtctgcatctgtggganacagagtcatcatctcttgccggganaagtcagagttgttagtatttaatttaattggtatcagttcaaacgaggaacnccctaagctcctagtattactatgctgactactaccgtagtttaacgaaaggtcgggtaccagtacgtaaggttcaggtgcgtaggtagtaacgtcggtaggactagtactttacactctacacctagtactaagttacgtactactaaccgtagtaagttactttacgactaaccttactactacgtacaacgtagtacgttaacgaccttacccctccgtactacgtaccgttcggacggacggtaaccgaagggtcgaagtactaacgaaacgtacgtacggtacgtacagaccactgtacg

SEQ ID NO: 181722 - DNA, 674 bp, Homo sapiens
  misc_feature: GYAE6OF01C53YO.2.39.D06.1.454.CMB.1.raw
  modified_base (200)..(200): a, c, t, g, unknown or other
  misc_feature (200)..(200): n is a, c, g, or t
  modified_base (223)..(223): a, c, t, g, unknown or other
  misc_feature (223)..(223): n is a, c, g, or t
  modified_base (226)..(226): a, c, t, g, unknown or other
  misc_feature (226)..(226): n is a, c, g, or t
  modified_base (375)..(375): a, c, t, g, unknown or other
  misc_feature (375)..(375): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccattccctccctgtctgcatctgtggganacagagtcatcatctctgccggnagnagtgtagttagtatttaattaattggtatactagttacaaaccgagggaacgtacccctaagctcctagtactctatgctgcacttacctaagtttaacgaaggtcgggtaccctaagtcgtaaggttcgtaggtcggacgaggttagngtcgtaggactagttactttcactcctacaacctatcgtaagttacgtactaactaacccgttagtaacgttaattttacgaccttaaacgttttactaccgttagtaacctaaacgtaaggtaacgtttaacccggtacccttaacccccgtaccgtaccttaccgttaacccggtttccggggaaccggggtaaccgggtaacccggtaaacgggttacgggaacgtaaacgttaacccggaaaacggttaaccgtgggttaccggtaccgtaggaaccctaccgttaacttcccgg

SEQ ID NO: 181723 - DNA, 606 bp, Homo sapiens
  misc_feature: GYAE6OF01CIH36.2.39.D06.1.454.CMB.1.raw
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (390)..(390): a, c, t, g, unknown or other
  misc_feature (390)..(390): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccgggnaagtcagtagtgttagttattttaatttaagttggtatctagttacaaaccgaagggaacgcccctaagcctcctgactctagtcgctgctatcgtagtttaacgaaggtcgggtaccctagtcgaaggttcgagtggcaggtgactgtaggactagtacttacnctctacgacctatcgtagtacgtactaacgtacctagaacgtttagtttacgacttaacctttactacgttacgtacgaacgtaacggtacgtttaaccgacctttaccccgtccgtaccttaccgtaccgtttccgggacgggacgggtaaccgaagggtacggaagtacgtaacgaaacggtacgtggtacgtacgacgtacctacgtcgtccg

SEQ ID NO: 181724 - DNA, 586 bp, Homo sapiens
  misc_feature: GYAE6OF01E3IEH.2.39.D06.1.454.CMB.1.raw
  modified_base (206)..(206): a, c, t, g, unknown or other
  misc_feature (206)..(206): n is a, c, g, or t
  modified_base (231)..(231): a, c, t, g, unknown or other
  misc_feature (231)..(231): n is a, c, g, or t
  modified_base (445)..(445): a, c, t, g, unknown or other
  misc_feature (445)..(445): n is a, c, g, or t
  modified_base (576)..(576): a, c, t, g, unknown or other
  misc_feature (576)..(576): n is a, c, g, or t
tcagacgctcgacacacgaccggtgctcgatttagtgacatctcgcaggtttcgtttgggggagccagtctcagtcagggacacagcatggacatgagggtccccgctcagctcctggggctcctgctactctggctccggagatcgccagatgtgacacccagatgacccagtcctccatccctccctgtctgcatctgtggganacagagtcatcatctcttgccgggnaagtcagagtgttagtatttattaaattggtatctagttacaaacgagggaacgccctaagctacctgatctatgctgcatctagttacaaggtcggtaccagtcgtaaggtcagtggccagtgatcgtggacagtacttcactcctacacatcgaacgtatctaactaacgtgtaagttagttttacgtaaactttacgtacttagtaccaanagtaagttaccgactacccccgtcgtcgtactaccgttcgggaccgggtacgggtaacccgaagggttacggaacgtacgtaacccgaaaaccggtacttcggtagggtacccttaccgaccttaaccctntcccgttacg

SEQ ID NO: 181725 - DNA, 566 bp, Homo sapiens
  misc_feature: GYAE6OF01AZ237.2.39.D06.1.454.CMB.1.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (228)..(228): a, c, t, g, unknown or other
  misc_feature (228)..(228): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttggggagccagtctcagtcaggacacagcatggacatgagggtccccgctcagctcctgggctcctgctactctggctccgagatgccagatgtgacacccagatgacccagtcctccatccctcctgtctgcatctgtgganacagagtcatcatctcttgccggnaagtcagngtgttagtatttattaaattggtatcagttacaaacaggtaaacncccctaagcctacctgatctatcgactgacatcctaagtttaaccgaaagttcggggtacccagtaccgtaaggttcaaggtggacaaggtgagtcgtagggactagttattcacttctacaccatcagtacgtactaactaacgtgaatatttcgactaacctttactaactgtaacacgtaagtaacgttaccgtactaaccccctcgtacctaccgtaccgtttcggacggtacgggaacctaagggtcgaggtacacgaaacgtacgttggacgtcagcctacctgttc

SEQ ID NO: 181726 - DNA, 692 bp, Homo sapiens
  misc_feature: GYAE6OF01ATFX1.2.39.D06.1.454.CMB.1.raw
  modified_base (279)..(279): a, c, t, g, unknown or other
  misc_feature (279)..(279): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttaagttatttaattaaattggtatctagttacaaacagggaacnccctaagctcctgatctatgctgcatcctaagttacgaaggtcgggtaccatacgaaggttcaggtgcgaggtgagttcgtgggaactaggtatttcacgtcctactaccacttacgtaacgttacgtacctaactaaccgtagtaaggttacttttacgaccttaaactttaccttacttacgttaactaacgtaaacggttaacgttaaccggttaacccttaccccgttacctacccgttaccgtttaaccggtttaccgggaacccgggggtaaaccggggtaacccggttaaaacgggggtacggtaaccgggttaaacgttaaacccggtaaaaacccgggtaaacgtttacgggttaccgggtaccgttaaccggtaacccttaaccccggtaaacgtttcccggg

SEQ ID NO: 181727 - DNA, 646 bp, Homo sapiens
  misc_feature: GYAE6OF01ECZ3H.2.39.D06.1.454.CMB.1.raw
  modified_base (202)..(202): a, c, t, g, unknown or other
  misc_feature (202)..(202): n is a, c, g, or t
  modified_base (228)..(228): a, c, t, g, unknown or other
  misc_feature (228)..(228): n is a, c, g, or t
  modified_base (288)..(288): a, c, t, g, unknown or other
  misc_feature (288)..(288): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatccctccctgtctgctatctggtggganacagagtcatcatctcttggccgggnaagtcagtagtgttaagttattttaatttaaagttgtatctagttacaaacgagggaacnccctaagctcctgatctatgctgctacttacctaagtttaacgtaaacggtcgggtaccctagtacgtaacggttctaaggtggacgtaggtacgtaagttcggtaggggaactacgttacgtttccaaccttccgtacaacctagtaccgtaagttaacgttacctaaacgtaacccgttagtaaacgtttactttacgtaaccttaactttactaactagtaaccaacgtaacgtaacgttaccgtacccttaccccgtccgtacttacccgtacgttccgggacgggtaccggaacgtaacgggtcgaagtacgtaacgaaaacgtcgtagggtacgactagcctactgttaccg

SEQ ID NO: 181728 - DNA, 645 bp, Homo sapiens
  misc_feature: GYAE6OF01DLWG1.2.39.D06.1.454.CMB.1.raw
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtgaccacccagatcgacccagtctccacttccctccctgtctgcctatcgtggtagggacgacaggacgtcatcatctcttcggccgggacaagtcagtagttagttagttattttaatttaagttggtatctagttacaaacgagggaactaccctaagcctccgtagacttctatcgctacgctatcctaagttacgaaacggtcggtaccctagtacgtaaggttcgaggtcggacgtaggtaggatcggtaggtaactagtactttacacgttccacaacctatacagttactactaacgtaactacgtaagtttactttcgaaccttaacttacgttacctataccgaaagtacgtacgttaaccgtaccctaccccgtctaccgttcgttaccggttaccgggacggtaacgggaacccgtaaggggtacgaacgtactaacggaaacccgtaggttacggtacggtaccacgtacccacttgttacccg

SEQ ID NO: 181729 - DNA, 549 bp, Homo sapiens
  misc_feature: GYAE6OF01A8OQG.2.39.D06.1.454.CMB.1.raw
  modified_base (222)..(222): a, c, t, g, unknown or other
  misc_feature (222)..(222): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtgggagacagagtcatcatctcttgccgggnaagtcagagtgttagtatttaatttaaattggtatcagttcaaaccaggaacgcccctaagctcctgatcgtatgctgcatccagtttacaagtgggtcccatcaagttcagtggcagtgatcgtggacagtatttcactctcaccgatcagtagtctaactaacctgtaaagtattttacgactaacttacgtactgtacaaacgagtacgttaacgacttacccctccgactacctacgtttccggacggtaacggaccgtaaggtggaagacgttaaccgaaaacgtaacgtggttacgggactacggacctaacctagttccg

SEQ ID NO: 181730 - DNA, 646 bp, Homo sapiens
  misc_feature: GYAE6OF01D75V0.2.39.D06.1.454.CMB.1.raw
  modified_base (198)..(198): a, c, t, g, unknown or other
  misc_feature (198)..(198): n is a, c, g, or t
  modified_base (311)..(311): a, c, t, g, unknown or other
  misc_feature (311)..(311): n is a, c, g, or t
  modified_base (515)..(515): a, c, t, g, unknown or other
  misc_feature (515)..(515): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccatccctccctgtctgcatcgtggngggagacagagtcatcatctcgtcgccgggacaagtcaggtagttagttagttattttaattaagttggtatactagttacaaaccgaaggtaacctccctaagcctaccgtnacgttctaatcgctgacctatacgtaagtttaacaagggtcgggtacctagtacgtagggttactaggtggacgtaggtacggtacgtacggtaggaacgtacggttactttcgaacccgttcctaccaacctagtacgttagtaccgttaacctaccgtaaacgtagttaacgttaagtttcgaacttaacttacttaacgtntaaccaagtacggtacgttaccgtaccttaccccgttcccacttaccggttacgtcgggaaccgggtggtaaccggacgggttcgaagtactaaccgaaacgtcgtagtacgtacgtgaacctcctgtccg

SEQ ID NO: 181731 - DNA, 627 bp, Homo sapiens
  misc_feature: GYAE6OF01CJCKF.2.39.D06.1.454.CMB.1.raw
  modified_base (201)..(201): a, c, t, g, unknown or other
  misc_feature (201)..(201): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtctccatccctccctgtctgcatctgtggganacagagtcatcgatctcgtcggcggacagtcgaggtagttagttagttaattttaaatttaagttggtactactaacgttaccaaaccgaagggaaacctccctaagcctctagactctagtgctgactactcttaagtaacaaggtcggtacccatacgtaaggtcaggtcgataggtgtatcggaggaactagttacttacgaccttacacaacctatacgtaagtacgtacctaaactacgtagtaatttagtttacgaccttaactttacaacgtttacgtaactaaacgtacggttaacgttaaccctaccgtaccccgttctacctacgttaccgttacgggacggtaaccggacgtaaggtaccggaattaccgaaacgaaacgttaggtacgtaggtacctgaaccctatccgttacg

SEQ ID NO: 181732 - DNA, 595 bp, Homo sapiens
  misc_feature: GYAE6OF01ATD65.2.39.D06.1.454.CMB.1.raw
  modified_base (225)..(225): a, c, t, g, unknown or other
  misc_feature (225)..(225): n is a, c, g, or t
  modified_base (277)..(277): a, c, t, g, unknown or other
  misc_feature (277)..(277): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatccctccctgtctgcatctggtggagacagagtcatcatctcttggccggnaagtcagagtgttagttatttaattaattgtatcagttacaaacgaggaacnccccgtaagctcctgatctatcgctgctacttacctagtttaacaaaggttcgggtacccagtacaaggttcagtggcagtggatcgtaggatagtacttcactcctcactatcgacgttagtcaactaactagtaattatttacacttaacttactactacgtacaacgtagtacgttaaccgtacctacccccgtactacctactaccggttccgggaccggtacggggtaacccgtaaggggtacggtaagtacgtaaccgtaaaaccggtagttacgggttacggtaccgtacggaccctaacctgtttacccg

SEQ ID NO: 181733 - DNA, 575 bp, Homo sapiens
  misc_feature: GYAE6OF01ATE3J.2.39.D06.1.454.CMB.1.raw
  modified_base (223)..(223): a, c, t, g, unknown or other
  misc_feature (223)..(223): n is a, c, g, or t
  modified_base (566)..(566): a, c, t, g, unknown or other
  misc_feature (566)..(566): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatcctccctgtctgcatctggtgggagacagagtcatcatctctgccggnaagtcagagtgttagtatttaatttaaattggtatcagttcaaaccgaggaaacgcccctaagctcctgactctatgctgcatcctagtttaacaaagttcgggtaccagtactagttcagtgcaggtggatcgtggactagtattcactctacacatcagtactcaactactgtaattacttagactaattacctaatacgtacaactaacgtacgtttaacgaccttacccctacgtaccttaccgtaaccgtttccgggaccgggaaacgggtaccgtaaagggtcgggaacgtaagtaccgaaaaccggtacgttacggtacgtacgagtccgtaaccngtttaccgg

SEQ ID NO: 181734 - DNA, 566 bp, Homo sapiens
  misc_feature: GYAE6OF01CENEF.2.39.D06.1.454.CMB.1.raw
  modified_base (198)..(198): a, c, t, g, unknown or other
  misc_feature (198)..(198): n is a, c, g, or t
  modified_base (222)..(222): a, c, t, g, unknown or other
  misc_feature (222)..(222): n is a, c, g, or t
  modified_base (279)..(279): a, c, t, g, unknown or other
  misc_feature (279)..(279): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgganacagagtcatcatctctggccggnaagtcagagtgttagtattttaatttaaagttggtatcagttacaaaccgaggaacncccctaagcctacctgactctatgctgcactcctagtttaacgaaggttcggggtacccatacgaacggttcgagtggacgaggtgtatcgtagggtacagtactttcgactctcaccatcagttacgtctaaccaacctagaacgtatttcgactaactttactactacgtctaacgaagtacgttacctaccttacccctccgtactacgacctttaccgggacgggtacgaccgtaagggtcgaagaactacgaaacgtgtacggtcgactagcctacctgtcg

SEQ ID NO: 181735 - DNA, 681 bp, Homo sapiens
  misc_feature: GYAE6OF01D8HET.2.39.D06.1.454.CMB.1.raw
  modified_base (200)..(200): a, c, t, g, unknown or other
  misc_feature (200)..(200): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtcctgcatctgtggganacagatcatcatctctgccggcaagtcagtagtgttagttattttaattaattggtatcgtaacgttacaaaccgaagggaaacgtaccccgtaaagcttccgtagtatactatgctgctactacctaagtttaacgaaaggtcggggtaccctagtacgtaaggttacagggttacggtacgtaaggtgaacgtcggttagggacctaaggttactttaccaccgttaccttaccaacctattacctaacggttaacgtaccgttaaaccaaccgttagtaaacgttactttaccgaaccttaaccgtttaactaccgttagtaacctaaacgtagttaaccggttaaccgtaacccgttaccccctcgttacctaccgttaccgtttaccgggacgggtaaccgggtaaccgtaaggggtcggaagtacgtaaccggaaaaccgtacgttaggtcggactcggacacccgttgtacccg

SEQ ID NO: 181736 - DNA, 751 bp, Homo sapiens
  misc_feature: GYAE6OF01AV9RQ.2.39.D06.1.454.CMB.1.raw
  modified_base (202)..(202): a, c, t, g, unknown or other
  misc_feature (202)..(202): n is a, c, g, or t
  modified_base (230)..(230): a, c, t, g, unknown or other
  misc_feature (230)..(230): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtctccatccctccctgtctgctatctggtgganacagcgtcatcattctcgtcggccgganagtcagtagttgttaagttatttaagttaagttgtatacgtagttaccaaacggaaggaactcccctaagcctacgtgtactctagtcgtctcgtactactacgtaagttaaccgtaacgggttccggtaccctaagttacgtaacggttcgtacggtacgtacgtaggtcgtaacgtcggtaacggtactaggtttaccttaccgaccgttacctaaccacgttacgttaaccgtaacggttccgtaaacctaaccgtaacgtttaagtaaccgttttaacgtttaccgtaaaccctttaaccgtttacgttaacgtaccgttaacgaaaccgttacggttaacccgttaacccgttaaccccttacccccgttaccgttacgttacccggttcccggttaggggaacccggtaaaccgggtaccggttaacgggtacgtaaacggttaacccgtaaaccggttaaaccggtacgttacggtccggtaacctaccgggaaccttacgttcccgttaccgg

SEQ ID NO: 181737 - DNA, 841 bp, Homo sapiens
  misc_feature: GYAE6OF01ED5ZQ.2.39.D06.1.454.CMB.1.raw
  modified_base (208)..(208): a, c, t, g, unknown or other
  misc_feature (208)..(208): n is a, c, g, or t
tcagacgctcgacacacgaccggtgctcgatttagtgacatctcgcagttctttgggggagccagtctcagtcaggacacagcatggacatggacgggtccccgctcagctccgtggggctcctgctactctggctccgagatgccagatgtgaccacccagatcgacccagtcctccacttccctccctgtctgcatcgtggtgganacagtagtcatcattctcgtcggccgggacaaggtcaaggtagttagtttaagttattttaagtttaaagttggttaactcgtaacgttaaccgaaaaccggaacggggtaaaccgtacccccgttaaaggtcccttaccgtagtaactttacgttagtcgtacgtacgtactaacgttaacccgttaaacggttttaaaaccgtaaacgggttcccggggttaacccctaagttaaccggtaaggttacgtaagggttcgggtaacgtaagggttacggtacgttacgggttacgggtaaaccgttaagtttacgttttacccgaaccgtttaccctaaccgtaaacccgtagttaccgttaaaggttaaccgttaaccttaaacccgtaaacgtttacgtaaaacgttttcgtttaaccgtaaccttaaacgtttaccttaacgttacgtaaccgtaaacgtaacggttaaccgttaaccgtaacccttaccccgtaccgtaccttaccgtacccgggttacgggaaccggggtaacgggtaaaccgttaaggggtaccgtaagttaaccgtaaacggtaaaccggttacgcgggttacgtacccgttacaaccgttaccgtacgttaccg

SEQ ID NO: 181738 - DNA, 671 bp, Homo sapiens
  misc_feature: GYAE6OF01B36MD.2.39.D06.1.454.CMB.1.raw
  modified_base (222)..(222): a, c, t, g, unknown or other
  misc_feature (222)..(222): n is a, c, g, or t
tcagacgctcgacacacgaccggtgctcgatttagtgacatctcgcagttctttgggggagccagtctcagtcaggacacagcatggacatgagggtccccgctcagctcctgggctcctgctactctggctccgagatgccagatgtgacacccagatgacccagtctccatccctccctgtctgcatctggtggagacagagtcatcatctcttgccggnaagtcagagtgttagtatttattaattggtatctagttacaaacgaggaacgccctaagctcctgatctatcgctgactacttaccgtaagtttaacgaaaggtcggggtaccctaagttacgtaagggttcaggtcggacgtaggtacggagtcggtagggactaggtactttaccaccgttccgtacctaacctagttactaacggttacgtaccctaacctaaccgtagttaaacgtttagttttaccgacctttaaacctttaccgttacttacgttaacgaaacgttaagtaacgtttaccgtaacccttacccccgttccgtaccttaccgtacggtttccgggacgggtaaccgggaacccgtaagggtacggtaagtaacgttaacccggaaacggtacgtacgggttacggtacctacggtacctaacccgtgttacccg

SEQ ID NO: 181739 - DNA, 692 bp, Homo sapiens
  misc_feature: GYAE6OF01E2BHK.2.39.D06.1.454.CMB.1.raw
tcagacgctcgacacacgaccggtgctcgatttagtgacatctcgctaggtttcgtttgggggagccagtctcacgtcaggacacagcagtggacatggacgggtccccgctcagctccgtggggcctcctcgctactctggctccgagatgccagatgtgacacccagatcgacccagtcctccatccctccctgtctgcatctggtgggagacagagtcatcatctcgtggccggacaagtcagagttagttagttaattttaattaaattggtatactagttaccaaaacgaagggaaacgtacccctaagtccttacctagattacctatcgtcttgctattacctaacgtttaacgaaaacggttcggggtacccctaagttaccgaacgggtttacaggtcggacgtaggtgtaacgtcgagggtactagttacttacgtactacctaccacctactactaacgttactaccgtaactaaccgtagtaacgttagtttacgacttaacttactactacgtaacaacgtaaggtaacgttaaccgtaaccttaccccgtaccgtacttacccgttaccggttacgggaccggttaacgggaacccgttaacgggaggtaaccgaacgttaaccgaaaacccgggtattacgggtacggtcgtaaccgtcctaaaccgtcgttacccg

SEQ ID NO: 181740 - DNA, 732 bp, Homo sapiens
  misc_feature: GYAE6OF01EICII.2.39.D06.1.454.CMB.1.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (726)..(726): a, c, t, g, unknown or other
  misc_feature (726)..(726): n is a, c, g, or t
tcagacgctcgacacacgaccggtgctcgatttagtgacatctcgcagttctttggggggagccagtctcagtcaggacacagcatggacatggagggtccccgctcagctccgtggggctcctgctactctggctccgagatgccagatgtgacaccagatcgacccagtctccatcctcctgtctgcagtctggtaggganaacagtacgtcatcacttctcgtcggaccgganaacgtcgaagtagttagtttaagtttaattttaagtttaaagttggtaacttacgtaaggtttaaaccaaaaccggtaagggggtaaaccctaccccgtaaggtccttacgtagacttctagtcgtctacgactactaccgttaagtaaacgtaacggtcggtaaccagttaacgtaagggttcaggttcggactagggtacgtacgtacgtaaggtaactaacgttacttacctaacgttaccactaaccgtaagtacgtaagttacgtaaccgttaaacgaacgttaagtaacgtttacgtttacaacgttaacctttacgtaactagtaaaccctaagtaacggtttaacgtaacccgtaacccgttaccccgtacgtacccgttaaccgttaccgggttaccgggacggggaacccgtaaacgttaacggggtaggtaaacaacgtaaacgaaacggtacggtaggtcgacttaccgactaacgtnttaccg

SEQ ID NO: 181741 - DNA, 871 bp, Homo sapiens
  misc_feature: GYAE6OF01C75S9.2.39.D06.1.454.CMB.1.raw
tcagacgctcgacacacgaccggtgctcgatttagtgacatctcgcagtttcgtttgggggagccagtctcagtcaggacacagcatggacatggacgggtcccgctcagcctccgtggggcctcctgcctactctggctaccgagatgccagtatgtacgaccaccaggtactacgacccgtagtcctcctacttccctccgtgtcctgacctagtcgtagggtagggaacgtaccgaggtactactactccgtaccgttccgttcgggtaccgggaccggtaacgtaacgtacggtaaggtttaggtttaagttttaagttttaaagttttaaagtttacggttagttactaacgttaacggtaaacccgaaaccggtaaacggtaacccgtaccgtacgtcccgttacgtacttcgttacttggtcctacgtcctaacgttaccgtaacggtttaacggtaccggtaacgggttcccaaacgttcggtaaacgggttacgtacggtaggttccggaaggttacggagttacggtacggggtaacctagtaccgtttaccgtacccttacctacgtaacccgttactacggtttaaacgttacgttaaaccgttaacgttaaaccgggttacttaaggtttaaccgttttacgttaacccgttaactttaaccgttacgtaacgttacgaacttaaaccggtacccgttaaccgtaacccccttacccggttacccgtacgttaccggttacccgggtacgggtaacggggtaaccggtaacggtaacgggtagtaaaccgtaacggttaaccggtaaacgtacggtcggtaccgtaccgtaccgttaacctccttgttccgttaaccg

SEQ ID NO: 181742 - DNA, 629 bp, Homo sapiens
  misc_feature: GYAE6OF01ECMGH.2.39.D06.1.454.CMB.1.raw
  modified_base (204)..(204): a, c, t, g, unknown or other
  misc_feature (204)..(204): n is a, c, g, or t
  modified_base (293)..(293): a, c, t, g, unknown or other
  misc_feature (293)..(293): n is a, c, g, or t
  modified_base (308)..(308): a, c, t, g, unknown or other
  misc_feature (308)..(308): n is a, c, g, or t
  modified_base (613)..(613): a, c, t, g, unknown or other
  misc_feature (613)..(613): n is a, c, g, or t
tcagacgctcgacacacgaccggtgctcgatttagtgacatctcgcagttctttgggggagccagtctcagtcaggacacagcatggacatgagggtccccgctcagcctcctggggctcctgctactctggctccgagatgccagatgtgacacccagatcgacccagtcctccatccctccctgtctgcatcgtggtggganacagtttagcatcattcctcttggccggacaagtcagagttgtttaagttatttaatttaagttggtatctagttacaaacgaggaacnccctaagctctgatntatgctgcatcctaagtttacgaacggtcgggtcccagttacgaacggtttcgaaggtcgtagtacggtaggacttccggtacgggaactacgtaacgtttccaaccttcctaccaaccgtatacgtaagttaactaacctaaacctaaccgtagtaacgttattttacgactaaccgtttactactacgtacaaacgtacgtaacgttaccgtacccttacccccttcgaccttaccgtaccgttcgggaacgggtaccggaacgtaagggtgaacgtagtaccaaacgtccgtaggtcgtacnccgacctacgtctacg

SEQ ID NO: 181743 - DNA, 777 bp, Homo sapiens
  misc_feature: GYAE6OF01CKUOB.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtagaccacccagatcgacccagtcctccactccctcccttgtctgctatcgtggtgggagacagagtcatacacttctcgttcggccgggacaaggtcagtagttagtttaagtttattttaatttaaagttgtattacgtaacgttacgaaacgaacgggaaacctacccctaaggtccttcgtacgtacttactagtcgtctcgacctacttaccgttaacgtttaaccggtaaggttccgggtacctaagtacgttaacgggtcgtagggtcggtacgtagggtagtacgttcggtaagggtaactaagttacctttcgaacccttccgtaaccctaacctacgttaccgttaaacggttaccgttacctaaaccgtacgttaaggttaaacgtttaacgttttaccgaaactttaacccttttaacgtacccttaagtacctaaacgttacggtaaccgttaacccgtacccctttaccccgtcccgttaccgttacccgttaccgggttaccggggaccgggtaaaccggggtaccgtaaaggggtcgtaaacgtaaccgttaaccggtaaaacgttaccggtggtaccggtaccgtaacgtaccctaaacgttcgtttacccg

SEQ ID NO: 181744 - DNA, 544 bp, Homo sapiens
  misc_feature: GYAE6OF01D5B57.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattattaaattggtatcagttcaaacaggaaagcccctaagctcctgatctatgctgcatccagtttacaaagtgggtcccatcaaggttcagtggcagtggatcgtgggacagtatttcactctcaacatacagtagtactaacaacctagaagtatttgactaacttactactgtacaaacgataacgttaacgacttacccccgtccgtacctccgtaaccgtttccgggaccgggaacgggtaaccgaagggtacggaagagtaaccgaaaacgactaggtcggactcgacaccattaccg

SEQ ID NO: 181745 - DNA, 623 bp, Homo sapiens
  misc_feature: GYAE6OF01ALKNU.2.39.D06.1.454.CMB.1.raw
  modified_base (223)..(223): a, c, t, g, unknown or other
  misc_feature (223)..(223): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccggnaagtcagagtgttagtatttattaattggtatctagttacaaacgaggaaacgtcccctaagcctcctagtactctatcgctgctactaccgtagtttaacgaacggttcgggtaccctagtacgtaaggttcgaggtcggacgtaggtggtactcggtaggactagtactttccacttctacctactatacgtagtacgtacctaacgtaacgtagtaacgttacgtttacaacctaacctttacttacgtacgtaaccaacgtaagtaccggttaaccgtaccttacccccgtctaccgttaccgtaccggtttacgggacgggtaaccggtaacggtaggtacggaactacgtaaccgaaacgtacgtcggtaggacctaggcctaacgtcgttacg

SEQ ID NO: 181746 - DNA, 679 bp, Homo sapiens
  misc_feature: GYAE6OF01D8TNO.2.39.D06.1.454.CMB.1.raw
  modified_base (233)..(233): a, c, t, g, unknown or other
  misc_feature (233)..(233): n is a, c, g, or t
  modified_base (634)..(634): a, c, t, g, unknown or other
  misc_feature (634)..(634): n is a, c, g, or t
tcagacgctcgacacacgaccggtgctcgatttagtgacatctcgcagttctttgggggagccagtctcagtcaggacacagcatggacatgagggtccccgctcagctcctgggctcctgctactctggctccgagatgccagatgtcgaccaccagatcgacccagtcctccactccctccctgtctgcatcgtggtggacacagtatcatcatcctcgttcggaccgganaagtcaggtagttgttagttattttaatttaagttggtatacgtacgttaacaaaccgaagggtaaaccgtccccgtaagtcctcctagacttacctagttcgacttgacctacttacccgttaagttttaaccgaaacgggttcggggttacccagttacgtaaggttcgaagggttcgacgtaggtacggacgttcggtaggaactacgttaccgttttacgaccttacctacccaaccttaatcgttaaacgttacgtaaccttaacctaacgtaggtaaacgtttcgtttacgaccttaacctttactacgttactacaactaggtaacgtttacccaaccttcccctacgtcctccggttaccgttccgggaacgtagggtaacctagggacgtanaacacgtaaacgcgttacggtacgtactacaccctactcgttacg

SEQ ID NO: 181747 - DNA, 842 bp, Homo sapiens
  misc_feature: GYAE6OF01BKNX7.2.39.D06.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtagaccacccagatcgacccagtcctccatccctcctgtctgcatctgtgganacagagtcatcatctcgttcggccgggacaagtcgagagttgttagttatttaatttaaattggtatcagttacaaaccgagggaacncccctaagcctctgatctatgctgctactccgtaagtttaacgaaacggtcggggtaccctagttacgtaacgggttcaaggttggacgtaggtaggtattacggtagggtaactaggttactttaccgaaccttccgtacccaaccgtaagttacgtaaacggttaacgttacccttaaaccgtaaacccgttaggtaaacgttttaacgtttttacggtaaacccttaaacctttttaaccgttaacccgtttaacgtttaaacccgtaaaccggtaaacgggtttaaacccgtttaacccggttaaacccctttaacccccccggttaccgtaccccgttttacccgttaaaccccgggttttacccgggggaacccggggttaaacccgggggttaaaacccggttaaacggggggttaacgggtaaaccggttaaacccggttaaaacccgggtaaaaacccgggttaaaccggtttacggggttaaacccgggtacccggttaaacccgggacccccgttaaacccgttaccgttttaacccccggg

SEQ ID NO: 181748 - DNA, 665 bp, Homo sapiens
  misc_feature: GYAE6OF01ACI84.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccactcctccctgtctgcatcgtggtagggagaccgagacgtcatcatcttcgtcggccgggcaaggtcagtagttagttagttatttaatttaaagttgtactacgtagttaccaaacgacggtaacgcccctaagcctacgtgtatctatcgctacgactacgtcctaagtttaacgaacggtccgggtaccctagtacgtacggttacgtagtacggtctaaggttggacgtacggtacggacctagttaccttaccgtacgtacctaccgtaaccgtactacgtaccgtaacgtaaccctaaccgtaaccgtagttaacgttatttaccgaaccttaaccttaaccgtaccgttacgtaaccaacgtaagtaaccgttaacctacccgttacccctcgtacctacgtaccggttcgggacgggtaccggacgaagggtacgaacgacgtaccgaaacgtaggcgtaccgataccgactacgtcgttccg

SEQ ID NO: 181749 - DNA, 704 bp, Homo sapiens
  misc_feature: GYAE6OF01EZOF5.2.39.D06.1.454.CMB.1.raw
  modified_base (203)..(203): a, c, t, g, unknown or other
  misc_feature (203)..(203): n is a, c, g, or t
  modified_base (233)..(233): a, c, t, g, unknown or other
  misc_feature (233)..(233): n is a, c, g, or t
tcagacgctcgacacacgaccggtgctcgatttagtgacatctcgcagtttctttgggggagccagtctcagtcaggacacagcatggacatgagggtccccgctcagctccgtgggctcctgctactctggctccgagatgccagatgtgaccacccagatcgacccagtcctccatccctcctgtctgcatctggtggganacgagagtcatcattctcgttcggccgganaagtcagtagttgttaagttaatttaatttaagttggtatactagttacaaacgacggaaccgtacccctagtcctccgtagacttctatcgtctcgactacttaccgtaacgtttaacgtaaacggtcgggtaccctagttacgtaagggttcgtaggtacggacgtaggttaggtacgtacggttagggtaactaaggttactttacccgtacgttacccttaccacctataccgtaacggtttaacgtaccgttaaacgtaacccgtagtaaacgtttacttttacgaaccttaacgtttaaccgttaccgttacgtaacctaaacgttaacggtaaccgtttacccgtaacccgttacccccttaccgtaccttaccgtaaccgttccgggaccgggtaccgggaaaccgtagggtacgaagaacctacgtaaaccgtagtacggtcggacgttagccactgtaccc

SEQ ID NO: 181750 - DNA, 703 bp, Homo sapiens
  misc_feature: GYAE6OF01CUQEG.2.39.D06.1.454.CMB.1.raw
  modified_base (212)..(212): a, c, t, g, unknown or other
  misc_feature (212)..(212): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (478)..(478): a, c, t, g, unknown or other
  misc_feature (478)..(478): n is a, c, g, or t
  modified_base (502)..(502): a, c, t, g, unknown or other
  misc_feature (502)..(502): n is a, c, g, or t
  modified_base (564)..(564): a, c, t, g, unknown or other
  misc_feature (564)..(564): n is a, c, g, or t
tcagacgctcgacacacgaccggtgctcgatttagtgacatctcgcagttcgtttgggggagccagtctcagtcaggacacagcatggacatggacgggtccccgctcagcctccgtggggctcctgctactcgtggctcgagatcgcagtatgacgaccaccagatcgacccagtcctccactccctcctgtctgctagtcgtggaggaanacagacgtcactcactcttcgtacggccgggaanaagtntaagtaggttagtttagttaattttaaatttaaagttggtaactacgtaagttaaccaaacggaaggtaaaccacccctaagctcctagactactagtcactgactaactaccgtaaggttaacgaaacgggttccggtaaccaagttaacggtaagtactaggacgacgtagtaggatcgtaggtaaccagttacgttcaactcctacaccagttacacggtttanaactaactaacggtataaaggttntttaacaaccgtttaaactacgttaatccggtaaacaaacgggtaacttacggttaaacccnccgttaaaccccttcgaccctaacgttaccggttcggggaaccgtaaccggggaaacgttacgggaggtaactaaacgtaaaccggaaaacgtacggtacggttaccggaccgtagaacccgtacccgtaagttacccg

SEQ ID NO: 181751 - DNA, 516 bp, Homo sapiens
  misc_feature: GYAE6OF01EXELM.2.39.D06.1.454.CMB.1.raw
  modified_base (510)..(510): a, c, t, g, unknown or other
  misc_feature (510)..(510): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggcaagtcagagtgttagtatttatttaaattggtatcagttcaaaccagggaaacgcccctaagctcctgatctatgctgcatccagtttacaagtgggtaccatcaagttcagtggcagtgatcgtggacagtatttcactctcacatcagtacgtctacaacctgaagtatttgactaacttactactgtacaacagtacgttacgacttacccctcgctctacgttcggcggtacgggaccaaggtcggagacgtacgaaacgacgtggtacggactagctaccngttccg

SEQ ID NO: 181752 - DNA, 645 bp, Homo sapiens
  misc_feature: GYAE6OF01CL6L7.2.39.D06.1.454.CMB.1.raw
  modified_base (200)..(200): a, c, t, g, unknown or other
  misc_feature (200)..(200): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatccctccctgtctgcatctggtgganacagacgtcatcatcttcgttggccgggactaagttcaggtaggttagttagttaattttaattaaagtttggtaattcgtaacgttaacaaaccgtaagggaaaccgtccccgtaaagtccttaccctagtaacttctagtcgtaccttgacctactaccgtaagtttaacgaaacggttcgggtaccattacgaagttcaggtacgcgtagtagtacgtagtacggaactagtacttcactcctacgacctatcgatacgtactaacgaccttagtaacgttatttcgaccttaactttacctattaccgtacaacgtaggttaacttaacccgtaccctaccccgtacgtccttaccgttacggttacgggaccggtacggtaaccgaaggggttacgaacacgtaacgaaacgtcgttacggcgactagaccactgttacc

SEQ ID NO: 181753 - DNA, 823 bp, Homo sapiens
  misc_feature: GYAE6OF01CZ88J.2.39.D06.1.454.CMB.1.raw
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtgacacccagatcgacccagtctccatccctccctgtctgcatcgtggtagggacgacgagtagtcatcacttctcgttcggccgggataaggtcaaggtaggttagtttaagttaattttaagtttaaacgtttggtattacgtaacgttaaccgaaaaccgtaacggggaaacgtaccccgtaacgcttcccgttagtacttacgtagtcgtctacgtactacttaccgtaaaggtttaaccgaaaacgggttccgggggttacccctaagttaaccggttaaacgggttacgtaacggggttcgggtacgtaacggggttacgggtacgttaccgggtacggggtaaaccttacggttaaccttttacccggtacctttaccctacccgtaacctaacgttaccgtaacggttaacgttaacccttaaaccgtaacccggttaaggtaaacgtttacgttttaacgacctttaaaccgttttaaccgttaccgttaacgttaactaaacgtacggttaaccggttaacctacccgttacccccgttaccgtacccttacgtaccggtttacccgggaccgggtaaaccggtaacggtaacggggtacggaagtaacggtaaccgtaaaacgtccggttaggtacggtacgtagaaccctacgtacgttccg

SEQ ID NO: 181754 - DNA, 959 bp, Homo sapiens
  misc_feature: GYAE6OF01DDPJ7.2.39.D06.1.454.CMB.1.raw
  modified_base (333)..(333): a, c, t, g, unknown or other
  misc_feature (333)..(333): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcacgttcgtggtgggagacgaggacgtcattccattccttcgttcggcccggggacaaaggtcgaggtaggtttagtttaagttaatttttaacgttttaaaagtttggtattcgtaagttaaccaaaccggtaggggtaaaaccnccccgttaaagccttaccgtaggtaacttcctagtacggcttacgacttaacgtaccgtaaggttttaaccgaaaacggggttccggggttaaccctaagttaaccgggttaaacgggtttaccggaaggggttcggtaccgggtaaggttacggggtacgtttacccggggtagggggttaaaccctaaggggtttaccttttcccgtaacccgtttacccgttaaccgtaaccccgtaactttaacccggtaacggtttaaaccggtaacccgttaaaaccggttaaacccttaagggttaaaccgttttaagttttaacccgttaaaccgtttaaacccgttttaacccgttaaacgtttaccggttaaaccgtaaaccggtaaacggtttaacccggttaacccggttaaaccccgtttacccccgttaacccgttacccgtttacccggtttaaccggttttaacccggggaacccggggttaaaccggggtaaacccgggtaacggggttaacggggaaacccgttaaacggtaaacccggttaaacccgggtaaaccggttaaccgggttacggttacccggtaccggtaacccttaacccggtaaccgttttacccgg

SEQ ID NO: 181755 - DNA, 609 bp, Homo sapiens
  misc_feature: GYAE6OF01CWLX0.2.39.D06.1.454.CMB.1.raw
  modified_base (282)..(282): a, c, t, g, unknown or other
  misc_feature (282)..(282): n is a, c, g, or t
  modified_base (597)..(597): a, c, t, g, unknown or other
  misc_feature (597)..(597): n is a, c, g, or t
  modified_base (603)..(603): a, c, t, g, unknown or other
  misc_feature (603)..(603): n is a, c, g, or t
tcagacgctcgacacacgaccggtgctcgatttagtgacatctcgcagttctttgggggagccagtctcagtcaggacacagcatggacatgacgggtccccgctcagcctccgtggggctcctgctactctggctccgagatgccagatgtgaccacccagatcgacccagtcctccctactccctccctgtcctcgcactcgtcggtgggagacagacgtcatcatctctcggacggctagtcaggtagtagtttagtattttaagttaagttggtactnaacgttacaaaccgagggtaaccacccctagctccgtagtactctatgctcgcctaactccgtaagttaacgaagggtccggtacctagacgtaaggtccgaaggtgacgtaggtacgtacgtcgtaggactagtacttccgactccgtactaccgtatacgtaacgttactacctaacctacgtacgtagttacttaccgaacttaccgttaactaccgtataactaacgaacgttactaccgtactccccgtactcgtactcggtcggtacggacgtaccgaaggtcggacttagaccaacgtagcgtacggntaccgnctgtcc

SEQ ID NO: 181756 - DNA, 829 bp, Homo sapiens
  misc_feature: GYAE6OF01DEGFU.2.39.D06.1.454.CMB.1.raw
  modified_base (809)..(809): a, c, t, g, unknown or other
  misc_feature (809)..(809): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatgacccagtctccatcctccctgtctgcatctggtgggagacagagtcatcattctcgttcggaccggcaagtcaaggtagttagtttaaggttaactttttaagttttaaaagtttggtaattaccgtaacgtttaaccgaaaaaccgtaggggaaaacccgtccccttaaacgccgttacccgttagattacctaagtcggtcttacgtcctaaaccgtttacccgtaaaaggttttaaaccgaaacggggttcccggggttaaccctaaagttacccgttaaagggtttccgtaagggtcgggacgtagggttacgggacgttcgggtagggaaacttacgtttaaccgtttccgtaaccttacctaccgtaacccgtaatacgttaacggttaaccgttacctaaacgtaacccgttagttaaacgtttacttttacgaacctttaaaccgtttaccgtaacttacggttaaaccctaaacggtaacggtttaaccgtttaacccgtaacccgttaacccccctttacgttaccgttacccgttaacgggtttacccgggtacggggaacccggggtaaccgtaaacggggtaggtaaacgttaacggtaacgtaaaacccgtaaggttcggtacggaaccgttntaaccctcgtacgtttaccg

SEQ ID NO: 181757 - DNA, 820 bp, Homo sapiens
  misc_feature: GYAE6OF01DHRYD.2.39.D06.1.454.CMB.1.raw
  modified_base (226)..(226): a, c, t, g, unknown or other
  misc_feature (226)..(226): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacaccagatcgacccagtctccactcctccctgtctgctatctggtggagacagagtcatcatctcgtcgccgganagtcagtagtgttagtattttattaattgtatcagtacaacgaggaacgtccctaagtcctcctagactactatcgtctgactactaccgtaagtttacgaaaggtcggggtaccctaatacggtaacgttcgtaaggtcggtacgtaggttacgggtagttacggtacggggtaactaacgttaacgttttaccgtacctttaccccgtacctaaacccgtacgttaacgttaaacgtttaaccgttaaccttaaacccgttaaaacccgttaagggttaaaccgtttaacgtttttaaccgtaacccgttttaaaaccgttttaaacccttaaccgtttacgttaaccgtaaaaccgttaacggttaaaccggtttaaacccgttaccccgttaacccccgttacccgtaccccgtttaccgttaccgggttttaacccggggaacggggtaacccggggtaaacccgggaacggggttaacgggttaaacgtaaaccggttaaacccggtaaaaccgggttaaacccggttacgggttaaccggggtacccttaacccgggaacccgttaacccgtaccggtttaacccgg

SEQ ID NO: 181758 - DNA, 826 bp, Homo sapiens
  misc_feature: GYAE6OF01DEIVO.2.39.D06.1.454.CMB.1.raw
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtcgaccacccagatcgacccagtcctcctactcccttccctgtctgcctatcgtgggtgggagacgagtacgtcatacattccttcgttcgggcccgggactaggttacaaggttagttaggttttaagttaattttttaaagtttaaagttaggttacttacgttaaggttaaccgaaaacggtaacggggtaaacctacccccgtaaagtcctaccgtagtacttccgtaagcgtacctaggtacctaacgttaccgttaaaacggtttaaccggaaacgggtttccggggtaccctaaaggttaccgtaaagggtttcggacgggtttacggacgggtaaggttcgggtacgttccggtaacggggtaacttaggttaccttttaccgacctttcctaccgtaacctagtaccgtaagttaccgtaaccttaaaccaacccgttaggttaaacgtttctttaaccgaaccctttaaacgtttaccgttaactttaaccgtaaccgtaaacgtaacgttaaccgttaacccgtacccttaccccggtacctttacgtacccggttaacgggttaccgggtacgggaaacccggtacggtaagggttaaccggtaagttaaccgtaaacgggtaaactacggtacggtacggactacccggaactcgttaacttcg

SEQ ID NO: 181759 - DNA, 706 bp, Homo sapiens
  misc_feature: GYAE6OF01C779J.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtctccatccctccctgtctgctatcgtggtaggagacgagacgtcatcattctcgttcggaccgggataagtcgaagtagttagtttaagttaattttaatttaaagttggtaactcgtaagttaaccgaaacggtaacgggaaacctacccccgtaaacgtcccttaccgtaggtaacttcgtacgtcgctacgactaacttaccgtaaagtttaaccggaagggttccggtacctagtaaccggtaggttacgaggtcggacgtaggtcgtcgtaggtacggacttacgtactttccgaccttacctcctaactacgtacgttaaacggttactaacgtaaaccgaccgttaagtaacggttactttacgaacctttaacttacgtactacgtaacaacgtaattacgtaaccctcctaccccgtacttaccgtacgttaccggtacgggtaccggaacgggtaccggtaagggtagtaactaacggtaaacgaaaccgttaggtacgggcctacgtacacctacgttgttaccg

SEQ ID NO: 181760 - DNA, 777 bp, Homo sapiens
  misc_feature: GYAE6OF01D7WTA.2.39.D06.1.454.CMB.1.raw
  modified_base (142)..(142): a, c, t, g, unknown or other
  misc_feature (142)..(142): n is a, c, g, or t
  modified_base (228)..(228): a, c, t, g, unknown or other
  misc_feature (228)..(228): n is a, c, g, or t
  modified_base (345)..(345): a, c, t, g, unknown or other
  misc_feature (345)..(345): n is a, c, g, or t
tcagacgctcgacacacgaccggtgctcgatttagtgacatctcgcagttctttgggggagccagtctcagtcaggacacagcatggacatgacgggtccccgctcagcctccgtggggctcctgctactcgtggctccganatcgccagatgtcgaccacccagatcgaaccctgtcctccactccctccctgtcctcgctatcgtggtaggacgacgagagtaccntaccattcctcgttcggaccggactagtcgacgtagttagtttaagtttaattttaagttaagtttgtacttactaagttaccaaacgacgggaaacctcccctaagtccttcgtanactcgtagtcgtctgactacgtacgttaagttaacggacggtcggtaccagtaacgtacgttgagttggcgtagtaggattccggggtaggtaacgttagttaactccgtaaccttcgtacctacctattaaccggtaacgttacctaacgtaaactaacgttaagttacgttactttacgtaaaccctttaactaccgtttaatacgtaacgtaacggtaccgtttaaaccgttacccgtaacccccgttaacccccgttcgtacccgttaacccggttttaccggttacccgggggaaacgggttaacccggggaaacgtttaacccgggggaataaccggttaaacccggtaaaacccggaaaacggtttacccggtacgggttcggtaacccgtaacgtaaccccgttaaccgtaacgttttccccgg

SEQ ID NO: 181761 - DNA, 173 bp, Homo sapiens
  misc_feature: GYAE6OF01BIP7X.2.39.D06.1.454.CMB.1.raw
  modified_base (167)..(173): a, c, t, g, unknown or other
  misc_feature (167)..(173): n is a, c, g, or t
tcagacgctcgacacacgaccggtgctcgatttagtgacatctcgcagttctttgggggagccagtctcagtcaggacacagcatggacatggagggtccccgctcagctccgtggggctcctgctactctggctccgagatgccagatgtgaccacccagacgtannnnnnn

SEQ ID NO: 181762 - DNA, 816 bp, Homo sapiens
  misc_feature: GYAE6OF01CZ19I.2.39.D06.1.454.CMB.1.raw
tcagacgctcgacacacgaccggtgctcgatttagtgacatctcgcagttctttgggggagccagtctcagtcaggacacagcatggacatgacgggtccccgctcagcctccgtggggctcctgctactcgtggctccgagatgccagatgtcgaaccaccagatcgaccctagtcctacctacgttccctcctgtctcgacctacgtccggtggtagggacgaacgagtacgtactaactctacttccgtccgttcgggacccgggataacggtacgagggttacgttagttttaacgtttatttttaaagtttaaacgttggtaacttacgtaacgttaaccgaaaaccggtaacgggtaaaaccctccccgtaagtcctcccgtagtacttcgtagtcgtctacgtcctaagttaccgttaaggttaacggacgggttccggtacctaagtaccgggtaagttcggaacggtcggtaacgtggttacgggtacgtacgggtacgggaaactttcggtacctttcccaacgtttacccccaccgtaacttacggtaaccgttaacgttaccgtaaaccctaaaccgtacggttaagttaacgttacgtttaaccgacctttaaccgttacgttacctacggtaaacgtaacgttaacgggtaacccttaaacccgtcccgttccccggtaccttaccgttacgggttacccggttaccgggggaaaccggtacgggtaaccgtagggtaacgaacttaaacgaacggtaacccggttatgggtacctacggtacaaccttacgtcttaacccg

SEQ ID NO: 181763 - DNA, 666 bp, Homo sapiens
  misc_feature: GYAE6OF01EYJFD.2.39.D06.1.454.CMB.1.raw
  modified_base (203)..(203): a, c, t, g, unknown or other
  misc_feature (203)..(203): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgaacccagtcctccatcctccctgtctgcatcgtggtggganacagagtcatcattctcgttggccgggacaagtcagtagttagttagttaatttaatttaaagttggtatctaagttacgaaaccgaagggaaccgtaccctaagtccttaccgtagtactacgtatgctagctactacctaagttaacgtaacggtcgggtaccaagtacgtaaggttcgaggtcggacgtaggtcgtacgtcggtaggtactaagttacttaccgtactaccgtacaaccgtactacgaagttacgtacctaacgtaaccgtagtaacgtttacgtttacgaacctaacgtttacttacgtacgtaacctaacgtacgtacgttaaccgacccttaccccgtcgtaccgtaccgttacggtacgggtaccgggaacgggtaaccgtaagggtacggaataccggtaaacgaaaccggtgtacgtacggactacgtaccctacgtgttaccg

SEQ ID NO: 181764 - DNA, 652 bp, Homo sapiens
  misc_feature: GYAE6OF01BD1UV.2.39.D06.1.454.CMB.1.raw
  modified_base (230)..(230): a, c, t, g, unknown or other
  misc_feature (230)..(230): n is a, c, g, or t
  modified_base (332)..(332): a, c, t, g, unknown or other
  misc_feature (332)..(332): n is a, c, g, or t
  modified_base (644)..(644): a, c, t, g, unknown or other
  misc_feature (644)..(644): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtcctgcatctggtgggagacagagtccatcatcttcgttcggccgggnaagtcgaagtaggtgtttagttaattttaatttaaagttggtatctagttaccaaaccgaagggaaactacccctaagtcctccgtgtactctagtgcgtanctactcctaacgtttagaaacggtcgggtaccctagtaccgtaaggttcgaaggtggcgaggtcgagtcggtagggtaacctaggtactttcgacttcctccgaacctatacgagtacgtactaacgaactagaacgttactttacgactaaccgtttaatctagtaccaaagtaggtaaccttaacgtaccttaccccgtcgaccttaccgtaccggtttagggacgggaaacccgggtacggtaagggtcggtaataaccgtaaccgaaaaccggtattcggggtacgtacacggtaccctaacccggtntttacccg

SEQ ID NO: 181765 - DNA, 528 bp, Homo sapiens
  misc_feature: GYAE6OF01A1TWP.2.39.D06.1.454.CMB.1.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcattctcgttggccgggacaagtcagagtgttagtatttattaaattgtatcagttacaaacgagggaaacncccctaaagcctcctagtactctatgctgctactctaagtttaacaaggtcgggtaccagtactaaggttcagtggctaggtgatcgtggaacagtattcactctacactatcaagtacgtctaacactgtaatatttcgactacttatactagacaagagtacgtactactaccctcactctacgttcggcggacggaccgagggtcgagtacacgaaacgtagtgtcggacttacgccacgtgtcg

SEQ ID NO: 181766 - DNA, 807 bp, Homo sapiens
  misc_feature: GYAE6OF01CZVTU.2.39.D06.1.454.CMB.1.raw
  modified_base (792)..(792): a, c, t, g, unknown or other
  misc_feature (792)..(792): n is a, c, g, or t
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtgaccacccagatcgacccagtcctccacttccctccctgtctgctatcgtggtacgggagacagtagtactatacattccttcgttcggccgggactaaggtcaaggtggttagtttaagttaatttttaaagtttaaagtttggttaacttacgttaacgttaaaccgaaaaccggtaacggggaaaacccgttacccccgtaaacggtccttaaccttggtaacttacgttagttcgccttacgtcctaacgttaccgtaaacggttttaaaccggtaaacgggttcccggggttaaccctaagtttaaccggtaaacggggtttaccgaagggtttcgggtaaccggtaagggtttacggtacggtttacgggtaacggggtaacttacggttaacttttcccaacccgtttccaacccggtaaccttaacgttacgtaacggtttaacctaacccgttaaaccgtaccgttaagtaaacgtttactttaacgaactttaaccgttactacgtacgtaacaaagtacgtaacttacccgtaccttaccccgtcgttcctacgttaccggtcgggtacgggaaccgttacggagggttacgaagtaacgtaaccgaaaccggttcgtggtaccgacgtanacccgtagtcttacg

SEQ ID NO: 181767 - DNA, 832 bp, Homo sapiens
  misc_feature: GYAE6OF01DAA9U.2.39.D06.1.454.CMB.1.raw
  modified_base (205)..(205): a, c, t, g, unknown or other
  misc_feature (205)..(205): n is a, c, g, or t
  modified_base (236)..(236): a, c, t, g, unknown or other
  misc_feature (236)..(236): n is a, c, g, or t
tcagacgctcgacacacgaccggtgctcgatttagtgacatctcgcagttctttgggggagccagtctcagtcaggacacagcatggacatggagggtccccgctcagctccgtggggctcctgctactctggctccgagatgccagatgtgacacccagatcgacccagtcctccatccctccctgtctgcatcgtggtggganacagagtcatactatctcgttacggccgganaagtcgaaggtagttagttagttaattttaagttttaaaagtttaggttaatactaagttaaccgaaaaccgaacggggaaacgtaacccccgtaaggtcctacctagtacttacttatagtcgtacgtctaacgtaccttaaggtttaaccggtaaaacggttcgggggttacccctaacttacgggtaaaacggttcgtaagggttacggtacggtaaggtacggggtacgtttaccgggtaaggggtaaacgtaaggtttaacgttttacccgtaaccgtttacccgtaccgtaaaccccttactaacccggttaaagtttaaccggttacccttaaaaccgtaaaccgttaaggtaacgtttaacgttttacgtaaccttaaaccgtttaaccgtttaaccttacgtaaccgtaaaacgtaacggttaaccgtttaaccggtaccttaaccccccttccggtacctaccgttaccggttaccgggtaccgggtaaacgggtaccgtaagggtaacgggaagtaacgtaaaccgtaaaaccggtaacggtacgggtacgtaaccgttgaacccgtaaccgtacgtttacccgg

SEQ ID NO: 181768 - DNA, 875 bp, Homo sapiens
  misc_feature: GYAE6OF01BAB5H.2.39.D06.1.454.CMB.1.raw
  modified_base (101)..(101): a, c, t, g, unknown or other
  misc_feature (101)..(101): n is a, c, g, or t
tcagacgctcgacacacgaccggtgctcgatttagtgacatctcgcagttcttggggagccagtctcagtcaggacacacgcatggacatgaggtccccgntcagctcctagggctcctagctactctggctccgagatgccagatgtgacacccagatcgacccagtctccatcctccctgtctgccatccgtggtcggacgacgacggtacgtccaatcctaacgttccttcgtttcggaccggggacctaaaggtccgtaggtacgtttacggtttaagtttaagtttttaaacgtttaaacgtttcggtaacttaccggttaacgtttaaacccgtaaaacgggtaaaccgggtaaaccccgttaccccgttaaacggttcccttaccggtaacgttaaccgttacgtaacgtcgtaccgtacgtaccgtaaccttaccggtttaaacgttaaaccgggtaacgggttccggggtaaccctagttaaccggttaacgggttaccgtaaggttcggtacgtaggtacgtaacgtcggtaaggtacgtacgttacgttacctaccgtacgtaccaaccgtacgtaccgtaagtaaccgttaccaaacgtaaccggtagttaacgtttaacgttacgtaaccttaaccgttacgttacgtaacttacggaaacgtacggtttaaccggtaaccctaacccgttaaccccggttaccttaccgttaacccggttccgggtttaaccgggacgggtttaaacccgggaaaccggtttacgggaaccgggttaaacgaacccggtttaaaaccggaaacggttacccgttacgggtacccggtaataccccgggtaaccacggtttcccttaaccgg

SEQ ID NO: 181769 - DNA, 597 bp, Homo sapiens
  misc_feature: GYAE6OF01E2BKB.2.39.D06.1.454.CMB.1.raw
  modified_base (281)..(281): a, c, t, g, unknown or other
  misc_feature (281)..(281): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtcctccatcctccctgtctgcatcgtgtgggagacagagtcatcatctcgtggccgggcaagtcagagtgttagtatttaatttaattggtatctagtacaaacgagggaacnccctaagctctgatctatgtctgcatcctagtttaacgaaacggtcgggtacccatacgtaagttcgaggtggcgtaggtggtatcgtagggactaggtactttccactcctaccacctatacgtagttaactacctaacctaaccgtagtaaacgttattttacgaccttaacttaactactagtacaacgtaagtaacgttaaccgtaccttacccccgtctacccttaccgtaccgtttccgggacgggtacgggaaccgtaagggtgtaagacgtacgaaacggacgtggtacggctagcctaactgttacg

SEQ ID NO: 181770 - DNA, 686 bp, Homo sapiens
  misc_feature: GYAE6OF01ATSYH.2.39.D06.1.454.CMB.1.raw
  modified_base (103)..(103): a, c, t, g, unknown or other
  misc_feature (103)..(103): n is a, c, g, or t
  modified_base (639)..(639): a, c, t, g, unknown or other
  misc_feature (639)..(639): n is a, c, g, or t
tcagacgctcgacacacgaccggtgctcgatttagtgacatctcgcagttctttgggggagccagtctcagtcaggacacagcatggacatgagggtccccgntcagctcctggggctcctgctactctggctccgagatgccagatgtgacacccagatcgacccagtcctccctactccctccctgtcctgctatcgtggtgggagtacagacgtcatctatcttcgttggaccgggataagtcgagtagttagttaagtttatttaagtttaaagttggtactacgtaacgttacgaaaaccgaagggtaaacctaccccgtaaggtccttccgtaagtacgttactagtcgccttacgacttacgtaccgttaagtttaacggaaacggttccgggtacctagtaccgttaacggttcgaagggtcggtacgtaggttcgtagtccgtacgggactagtacctttacgaccttactaccaccgttatacgtacgtacgtacttaaccgtaacttagtaacgttgtttacgaaccttaacttactaccgttaacgtacaacgttacgtaacgttaccaccgttaccccttacgtccttacctacgttccgaaggtcggtaacggtaacgtagggtntaacgtaacgaccgtaaaggtccgtgtacgtcacggtccacgttacg

SEQ ID NO: 181771 - DNA, 655 bp, Homo sapiens
  misc_feature: GYAE6OF01AC6YZ.2.39.D06.1.454.CMB.1.raw
  modified_base (197)..(197): a, c, t, g, unknown or other
  misc_feature (197)..(197): n is a, c, g, or t
  modified_base (218)..(218): a, c, t, g, unknown or other
  misc_feature (218)..(218): n is a, c, g, or t
tcagacgctcgacacacgaccggtgctcgatttagtgacatctcgcagttctttggggagccagtctcagtcaggacacagcatggacatgaggtccccgctcagctcctgggctcctgctactctggctccgagatgccagatgtgacacccagatcgacccagtctccatccctcctgtctgcatctggtggacncagatcatcatctctgccggnaagtcagtagtgttagttatttattaagttgtatacgtagttaaccaaacggaaggaaacctccccgtaagtcctaccgtagtactcgtagtcgtctcgactacgttacgtaagtacggtacggtccgacttacgtaagtacggtacgaggtacgtgtaggtcgtacgttacggtagacgttagttacccgttaactcgtaccgtaactacgtagttaccgttaacgtaccgttaacctaacgttacgttacggttaatttacggttaacctaaccggtttaactaacgtaccgtaagtaacccgtagttaaacgtaccgtacccgttacccgttacccgtacttaccgttaccgtccggttacgggacggtaccgtaaggtcggtacgaataccgtaactaggtacgcggtctacgccaacttcccgtgttacccg

SEQ ID NO: 181772 - DNA, 881 bp, Homo sapiens
  misc_feature: GYAE6OF01A8WV8.2.39.D06.1.454.CMB.1.raw
  modified_base (820)..(820): a, c, t, g, unknown or other
  misc_feature (820)..(820): n is a, c, g, or t
tcagacgctcgacacacgaccggtgctcgatttagtgacatctcgcagttctttgggggagccagtctcagtcaggacacagcatggacatggagggtccccgctcagctccgtggggctcctgctactcgtggctccgagatcgccagatgtgaccaccagatcgacccagtcctccacttccctcccgtgtcctcgactacttcgttacggtggggaacgaaccgaggtacgtacctacttacctacttccgttccgttcgggaccccggggtactaaacgggttcgaagggtaacgtttaggttttaaaggttttaactttttttaaaagtttttaaaaaccggtttttaggggttaaactttacccggttaaaacggttttaaaccccgtaaaaaaccccgggtaaaggggggttaaaaaacccccgtaccccccggtttaaaaacgggtcccttttacccgtacgggttaactttaccgtttaacgtcggttaccgtacgtaccgtaaactttaccgtaaacgttttaaaccgaaaacggggtttccggggtaaccctagtaacggtaacggttccggaagtcgggcgttaagggtacggagttcggtagggtaacctagttacgttaccgtacctacttacccaactacgtacgtaagtacgtaaccctacaacgtgtaaattagttttacgaactaaccgtttctaactcgtaaccaagttaccgtaacgttaccgtaacccttccccgttacgttccttaacccgttgggttcccgggaacgggtacccggacggttaacgggaccggtaanacggtaaacccgaacggttaacggttcgtacgggtaccataaccccgtacttcggttaccg

SEQ ID NO: 181773 - DNA, 720 bp, Homo sapiens
  misc_feature: GYAE6OF01B3BPO.2.39.D06.1.454.CMB.1.raw
  modified_base (204)..(204): a, c, t, g, unknown or other
  misc_feature (204)..(204): n is a, c, g, or t
tcagacgctcgacacacgaccggtgctcgatttagtgacatctcgcagttctttgggggagccagtctcagtcaggacacagcatggacatgaggtccccgctcagctcctggggctcctgctactctggctccgagatcgccagatgtcgaccacccagatcgacccagtctccactccctcctgtctgctatcgtggtgganacgagacgtcactcacttcgtcgttcggccggataaggtcaggtagttgtttaagtttaacttttaagttttaaagtttcggttaactacgtaacgtttaacccgaaaaccggaacgggaaaccgtacccccgtaaagtccgttaccgtagtaaccttacgttacgtcggtctacgtacctaacgttaccgttaacggtttaaacggtaacgggttccgggtaccctaagttacgtaacgggttcgaggtacggacgtaggtacggtactcgggtaggtaacttaggttacttacctaccgtacctaccgtacctagtacgtacgttaacgtacctaactaacggtagtaacgtttacgttacgtaccttaacttaccgtatacgtacaacgtacgtacgttacctaccctcccgtacgtccgtccttacggtccgggtacggacgggtaacgtacggtaggtaactacggaacgtaaccggtagttcggcgtactacgccttaacgtcgttaacg

SEQ ID NO: 181774 - DNA, 580 bp, Homo sapiens
  misc_feature: GYAE6OF01CB9EF.2.39.D06.1.454.CMB.1.raw
  modified_base (450)..(450): a, c, t, g, unknown or other
  misc_feature (450)..(450): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctctggccgggcaagtcagagtgttagtatttatttaaattggtatctagttacaaaccgtagggaaacgtacccctaagcctcctagtactctaatgctgcatcctaagtttaacaaagtcggggtacccatacgaaggttcaggtggcaggtggatcgtggactagtatttcactctaccacgtatcgagttacgtactaacaacctgaattatttcgacttaaccttactacgtntacaactagtacgttaaccgacgttaccccctcgtaccttcgtaccgttcgggacgggtaccgggaaccgtaacggggtggaacgtaactaaccgaaacgtaatcgggtacgcgagccaccgtgttaccg

SEQ ID NO: 181775 - DNA, 604 bp, Homo sapiens
  misc_feature: GYAE6OF01AD38R.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatcctccctgtctgcatctggtgggagacagagtcatcatctcgttcgccgggcaagtcagagtgttagttatttaatttaaattggtatcagttacaaaccgaggaaacgcccctaagcctacctgacttctactgctgctactacctagtttaacgaaggtcggggtacccatacgtaaggttacaggtggctaggtggatcggtaggactaggtactttcaccttcacctactatcgtaacgtacgtactaccaacgtgtaagttgtttacgacttaacttactacttacgaacaacgtacggtacgttaaccgtacctaccccttccgtaccttcgtaccgtttcggacggtaacggaaccgtaagggtacggagtaacgtaccgaaaaccggtcgtacggtacggtcctacgcctactcgttaccg

SEQ ID NO: 181776 - DNA, 591 bp, Homo sapiens
  misc_feature: GYAE6OF01BQTW6.2.39.D06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (279)..(279): a, c, t, g, unknown or other
  misc_feature (279)..(279): n is a, c, g, or t
  modified_base (428)..(428): a, c, t, g, unknown or other
  misc_feature (428)..(428): n is a, c, g, or t
  modified_base (586)..(586): a, c, t, g, unknown or other
  misc_feature (586)..(586): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctggccgganaagtcagagtgttagttatttatttaaattggtatctagttacaaaccaggaaacncccctaagctacctgatctatgctgactatacctagtttaacgaaagtcggggtacccagtacgtaaggttcaggtggacaggtgtatcgtaggactagtacttcactctacactatacagttacgtactaaccgtaactagtaagttntttacgacctaactttactactagtacaacgtagtaacgttaccgtaccttaccccgtcgtactccgtaccgtttccgggacgggtaacgggtaaccgtaagggtaggtaacgtaagtaccgaaaacgtacgttacggtcggtactagacctaccgtnttccg

SEQ ID NO: 181777 - DNA, 793 bp, Homo sapiens
  misc_feature: GYAE6OF01AQDUU.2.39.D06.1.454.CMB.1.raw
  modified_base (144)..(144): a, c, t, g, unknown or other
  misc_feature (144)..(144): n is a, c, g, or t
  modified_base (224)..(224): a, c, t, g, unknown or other
  misc_feature (224)..(224): n is a, c, g, or t
tcagacgctcgacacacgaccggtgctcgatttagtgacatctcgcagttctttgggggagccagtctcagtcaggacacagcatggacatggacgggtccccgctcagcctccgtggggctcctgctactctggcctccgagntcgccagtatgtcgaccacccagactcgaccctagtcctccctacttccctcccttgtcctcgctagtcgtggtaggganacgagtagtactactctacttccgtcggtcgggaccgggtactaaggtcgaggttaggtttagttttaagtttaattttaagttaagttggtaacttcgtaacgttaaccgaaaaccggtaacgggtaaccctaccccgtaagtccttacctagtacttcgtacgtcgtactacgtactacttacggtaagttaacggtaacggttccgtaacctagtacgttacggtcgtaaggtcggtacgtaaggtcgtacgtacgggtacggtaatacgttaccttacacccgtactaacgaccttagtaccggtaaagttactaacccgtaacctaaggttacgttaacgtttcctacgtaaaccccttacgtttaaccgtacttaacccgaataaccggttaaccgttacccggtaaccccgttaaccccttacccgtccgttaccggtaaccggtttccgggaaccggggtaacccggaacggttacggtaacggtacggttaaacgtaccggtaaacccggtaaccggttctacggggtaacctcgtaaacccacctttacgtgttacccg

SEQ ID NO: 181778 - DNA, 910 bp, Homo sapiens
  misc_feature: GYAE6OF01CHKWH.2.39.D06.1.454.CMB.1.raw
tcagacgctcgacacacgaccggtgctcgatttagtgacatctcgcagttcgtttgggggagccagtctcagtcaggacacagcatggacatggacgggtccccgctcacgcctccgtgggggcctcccgtgtacttacctcgtcggtccgtaccggagtactcggaccgaagtacgttacggtaccgaacccgaaacccgaagtaaccgtacccggaacccctaaccgttccctaccctaccttccccctccgttcgtctcgtactcgttcggtgggtaacggacgacgtaacgacgtactatcctacgttccgttcggtaccgggccggtacgtaacgtacgtagtttacggttagtttaagtttaattttaaagtttaagttagttaactacgtaacgtaaccggaaacgtaacggaaccctaccgtacgtccgttacgtacgttctacgtacgtcgtacgtactacctacgttacgttaaacggttaaccggtacggttaccgttaacgtaacgttaacgggttacgttcggtaacggtaggtacgtaggtacggtacgtggacggttaactcgttaccgttctacccgtacgtaccaccttacgtactaacgttaccgtaaccgttaactacggttattaacgttacgttaacctaaccgttactttacgtaccgtaactaaccggttaacgtaacccgtttaaccgtaaaccccttaccccgtacccgttacccggttaacccgtttacccgggttaacccggggtaaccggggtaaccggtaaaccggggttaaacgggaccgggtttaaaccgaacgggttaaaacccgttaaaggggaaccccgtttggtaccggtaaccggttaccgttaaccgtaacccgttgttaaccccgtttacgg

SEQ ID NO: 181779 - DNA, 758 bp, Homo sapiens
  misc_feature: GYAE6OF01ENESP.2.39.D06.1.454.CMB.1.raw
  modified_base (207)..(207): a, c, t, g, unknown or other
  misc_feature (207)..(207): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatcgacccagtcctccatccctcctgtctgcatctggtggagacaggntcatctactccttcgttcggccggactaagtcaaggtagttagtttaagtttaattttaattttaagttggttatacgtaacgttaaccgaaaacggaacgggtaaacccgtccccgtaacgtccttaccgttagacttctacgtcgacttcgctacctacgttaacgtttaacggaacggtccgggtacctagtacgtaaggttcgtaggtacggtacgtaggtacggtatacgggtacgggtaactaggtttacttaccctaaccgttcctacccgtaaccgtacttacggtaacgttaaccgtaccttaaaccgtaacgtagttaacgtttacgtttaccgaactttaaccctttagttacccttagtaacgaacgtaacgttaccgttaacctaaccccgttacccccgttacgttaccgtccgtttaaccggtcggggaacccgggtaacggtaaccggtaagggtacggaacgttaaacggtaaccccggtaaaacggttcggtaggttacccggacgttaccgaaccgtacgttcggtttaccg

SEQ ID NO: 181780 - DNA, 725 bp, Homo sapiens
  misc_feature: GYAE6OF01CUK35.2.39.D06.1.454.CMB.1.raw
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (349)..(349): a, c, t, g, unknown or other
  misc_feature (349)..(349): n is a, c, g, or t
tcagacgctcgacacacgaccggtgctcgatttagtgacatctcgcagttctttgggggagccagtctcagtcaggacacagcatggacatgacgggtccccgctcagctccgtggggctcctgctactctggctccgagatcgccagatgtagaccaccagatcgaccagtccnccattccctcctgtcctgcacgtcgtaggtaggganacgtagacgtacatcattcgtcgtcggccggtacaagtcgagtacggttagttaaggttaattttaactttaaggtagtactcgaagttaccaaaacgagggtaaaacctccccgtaatcgtacgtgtacttctaagntcgtagaccttacgtaccgtaagtttaacgaacgggttccgttaccacggtaacgttaagggtactagggtacgtacgtaggacggttacgtcgggtaacgggtaactacttaactttccgaacttaccgtacgtaaccgtactacggtaacttacggttaactaaaccgtaccgtaacgttagtaacgtttacgacctttaaacttacgtacgtttactaacgtaaacgaacggttaacgttaccccgtaacgtacccctacgttacccgttaccgtaaccggtttacgggaaacccgggtaccggtaacggaagggtcgaacggtaccgttaagaaacccgtagttcgaccggtctacgctaccgtagttaccg

SEQ ID NO: 181781 - DNA, 647 bp, Homo sapiens
  misc_feature: GYAE6OF01B0MD6.2.39.D06.1.454.CMB.1.raw
  modified_base (206)..(206): a, c, t, g, unknown or other
  misc_feature (206)..(206): n is a, c, g, or t
  modified_base (211)..(211): a, c, t, g, unknown or other
  misc_feature (211)..(211): n is a, c, g, or t
  modified_base (242)..(242): a, c, t, g, unknown or other
  misc_feature (242)..(242): n is a, c, g, or t
  modified_base (323)..(323): a, c, t, g, unknown or other
  misc_feature (323)..(323): n is a, c, g, or t
  modified_base (331)..(331): a, c, t, g, unknown or other
  misc_feature (331)..(331): n is a, c, g, or t
tcagacgctcgacacacgaccggtgctcgatttagtgacatctcgcagtttctttggggggagccagtctcagtcaggacacagcatggacatggacgggtccccgctcagctccgtggggctcctgctactctggctccgagatgccagatgtgaccacccagatcgacccagtcctccactccctccctgtctgctatcgtggnggganacagagtacatcatcttcgtcggaccggtanaagttcgagtagttagttagttaattttaatttaagttggtatcgtaagttacgaaaaccgaagggaaaccaccccgtaancctccganacttctagtgctgacataccgtaagttaacgaaggtccggtacctagtacgtaaggtatagtggacgtggtagtcgtacgtaggactagttattaccacttacacctaacgtactagtaacgttaactaacgtaacctaacgtaagtaacgtttactttacgaaccttaacgtttaactcttaacgtaactaacgtaagttaaccggtacctaccctacccctacgtaccttaccggtaccgttaggggacccggaggaacgtagggagactaacaacggaaagtacgttcgcgggactacggactacgtctaccg

SEQ ID NO: 181782 - DNA, 882 bp, Homo sapiens
  misc_feature: GYAE6OF01DW4UN.2.39.D06.1.454.CMB.1.raw
  modified_base (202)..(202): a, c, t, g, unknown or other
  misc_feature (202)..(202): n is a, c, g, or t
  modified_base (865)..(865): a, c, t, g, unknown or other
  misc_feature (865)..(865): n is a, c, g, or t
tcagacgctcgacacacgaccggtgctcgatttagtgacatctcgcagttcgtttgggggagccagtctcagtcaggacacagcatggacatgagggtccccgctcagctcctggggctcctgctactctggctccgagatgccagatgtgaccacccagatgacccagtctccatccctccctgtctgcatctggtggganacagacgtcatcattcctcgttcggcccgggataagtcgaaggtaggtttagtttaagtttaacttttaagttttaaaagtttggtaacttacgtaacgtttaaccaaaaacccggaaggggtaaaaccgtccccccgttaaaggtcccttacccggttaggtaacctttacgtaacgttcggtaccttagtaaccgttaatttaaccccggttaaaaggtttttaaaacccgaaaacgggggtttccgggggttaaaccccctaaggttaaccggtttaaaacggggttacctaaggggttacggggtaccttaacggggttagggtaacctttacggggttaaggggaaacccttaagggtttaaacctttttcccgtaccgtttacccttaacccgtaaccgtaacgttaaccgtaacggttaaccgtaaccttaaaccgtaacccgtttaaggtaaacgtttacgttttaaccgaaccttaaacctttaaccgtttaacgtacgttaaccgtaaacgttaaggttaacccgttaaaccggtacccttacccccggtaccgttaccgttacgttacccggtttaccggggaacgggttaaccgggaaccgtaaggggtacggtaactacgtaaccgtaaacggtacgtggtacgacgtanacccgtagtactttccg

SEQ ID NO: 181783 - DNA, 711 bp, Homo sapiens
  misc_feature: GYAE6OF01BG1ON.2.39.D06.1.454.CMB.1.raw
  modified_base (158)..(158): a, c, t, g, unknown or other
  misc_feature (158)..(158): n is a, c, g, or t
  modified_base (209)..(209): a, c, t, g, unknown or other
  misc_feature (209)..(209): n is a, c, g, or t
  modified_base (244)..(244): a, c, t, g, unknown or other
  misc_feature (244)..(244): n is a, c, g, or t
  modified_base (684)..(684): a, c, t, g, unknown or other
  misc_feature (684)..(684): n is a, c, g, or t
  modified_base (691)..(691): a, c, t, g, unknown or other
  misc_feature (691)..(691): n is a, c, g, or t
tcagacgctcgacacacgaccggtgctcgatttagtgacatctcgcgagttcgtttggggggagccagtctcagtcaggacacagcatggacatgacggtccccgctcacgctccgtgggctcctgctactcgtggcctccgagatcgccagatgganacaccagatcgacccagtccacactcctcctgtctgcagtcgtggaggganacgtagtgtacatacacgtctacgttggaccgganaaggtcagtaggttaattagttaatttaagttaaagttggtaactacgtaacgtaacgaaaaccggaacggtaaacgacccgtaacgtacctactaccgtaatacctagtacacctagaacgtaccgttaaccttaaacgttaacggtaacggtaccgggtaacctacgtaagtaaggttaccgaggtacgagtacgtaggtagtaaccggtgggtaactaacggttacttaacctactaaccgtactaaccctagtaccgtaaagttacgtaactaaacccgtaataacgttaacgttatttaccgaacttaaactttacccgtaatacgtaaactactaaagggtaacctaccgttaccctacccgaaccgtcgtacgtaccgggttggaaaccggtagggaaaccggttagaacggtaagaccaacgaacgtaaggngttaacncgttaacacgaactctacgg

SEQ ID NO: 181784 - DNA, 694 bp, Homo sapiens
  misc_feature: GYAE6OF01DVRM8.2.39.D06.1.454.CMB.1.raw
  modified_base (103)..(103): a, c, t, g, unknown or other
  misc_feature (103)..(103): n is a, c, g, or t
  modified_base (354)..(354): a, c, t, g, unknown or other
  misc_feature (354)..(354): n is a, c, g, or t
  modified_base (678)..(678): a, c, t, g, unknown or other
  misc_feature (678)..(678): n is a, c, g, or t
tcagacgctcgacacacgaccggtgctcgatttagtgacatctcgcagttctttgggggagccagtctcagtcaggacacagcatggacatgacgggtcccgntcagctccgtgggctcctgctactctggctccgagatgaccagacttgtcgaaccacccgagtactcgaacccagttcctcctacttccctcctgtctgactatcgtggtaggacacgagactacactctacttcgtcgtcggccggtacagtacgtaggtagttagtttaatttaattttaaacttaagttcggtaatacgtacgtaacaaacggacggtaacctacctaacgctaccgtgtaactctancgtctagctagtactaacgttacgacggtctactagtacgtagtacgacggtgatggtcgtagtgggtaacgacttgttacctacgtactaccgacgtaacctagttacgttaacgtccgtaacttaacaaccggtttaagttaacgtttattttaccgaaaccttaagttttacccgtaatacgttaaacgaacgttaaggttaacccttacccgtaacccttaccccttcgcgtttacccggtacggttaaccggggacggtaaacgggtaaccgtagggtacgaacttacgtaaaccgaacgtggtacgtccaaccgttanaccccgtgtccttacg

SEQ ID NO: 181785 - DNA, 700 bp, Homo sapiens
  misc_feature: GYAE6OF01BGD52.2.39.D06.1.454.CMB.1.raw
  modified_base (214)..(214): a, c, t, g, unknown or other
  misc_feature (214)..(214): n is a, c, g, or t
  modified_base (253)..(253): a, c, t, g, unknown or other
  misc_feature (253)..(253): n is a, c, g, or t
  modified_base (684)..(684): a, c, t, g, unknown or other
  misc_feature (684)..(684): n is a, c, g, or t
tcagacgctcgacacacgaccggtgctcgatttagtgacatctcgcagttctttgggggagccagtctcagtcaggacacagcatggacatgacgggtccccgctcagcctcctggggctcctgctactcgtggctaccgagatgccagatgtagaccacccgagactcgacccagtctccatccctaccctgtctcgcactcgtggtacgganaacgagtagtacataccagttcctagttcggccgggtanaagtcagtagtcgttagttattatttaaagtgtatacgtagtacaaacgtaaggaacctaccgtaagctcctagtatacgtatcgtctgactacgtacctaagttacgtaacggtcggtacctagttacgaacgttgacggtcgtacgtaaggtgtaacgtcggaacggtctaagtacgtttaacgacctcgtaaccaacctagttaccgaacggttaacaccttaaacctaacgtaagttaacggttaatttacaaccctttaacgttaacctaccgtaagaaaccgtaaggtaaccgttaacccgtaaccgtaccccgttaaccccgacgttacccttacgggtacccgtttacccgggacgggttaaaacgggcccgtaaagggtacgtaacggtaactaaacggtaacccgagttacgggtacgacnccgtaacaccgtctcg

SEQ ID NO: 181786 - DNA, 677 bp, Homo sapiens
  misc_feature: GYAE6OF01CX91W.2.39.D06.1.454.CMB.1.raw
  modified_base (207)..(207): a, c, t, g, unknown or other
  misc_feature (207)..(207): n is a, c, g, or t
  modified_base (358)..(358): a, c, t, g, unknown or other
  misc_feature (358)..(358): n is a, c, g, or t
  modified_base (367)..(367): a, c, t, g, unknown or other
  misc_feature (367)..(367): n is a, c, g, or t
tcagacgctcgacacacgaccggtgctcgatttagtgacatctcgcagttctttggggggagccagtctcagtcaggacacagcatggacatgacgggtccccgctcagctccgtggggctcctgctactctggctccgagatgccagatgtgaccacccagatcgacccagtcctccactccctccctgtctgcatctggtggganacagatcatcatctcgtcggcggctaagtcagtagtagtttagttaattttaattaagttgtatctagttacaaacgagggaacaccctaagtctactagactctatgctagctatcctaagttaacgaggtcggtaccagtacgtaagtntagtcgagnggtacgagtggacggataagtctttacaccttactcaacctatacgtaatacgtactaacgtaactagtaattacgtttcaacgttaactttactacgttacgtaactaacgtaacgttaaaccgttacccgtaaccttaacccccgttccgttaaccgttacccggtttaaacggtttcccgggggaaaccggggtacgggtaacccggttaaagggggtccggtaaacgtaaaccggttaaaccgtaaaacggttaacccggttggttaaccgggtacttacccggtaaccgtaaccgtgtttacccg

SEQ ID NO: 181787 - DNA, 758 bp, Homo sapiens
  misc_feature: GYAE6OF01EXGDM.2.39.D06.1.454.CMB.1.raw
  modified_base (521)..(521): a, c, t, g, unknown or other
  misc_feature (521)..(521): n is a, c, g, or t
tcagacgctcgacacacgaccggtgctcgatttagtgacatctcgcagttctttggggggagccagtctcagtcaggacacagcatggacatgacgggtccccgctacagcctccgtggggctcctgactactcgtcggcctacggagagtcgaccgagtatggtacgaaccacccgagtactccgaacccgtagtcctacctaccttccctcccgttgtctcgactacgttcgtagggtagggacgtacgaggtactactactccgtacgttctccggttacgggaccggactaacggttacgaggttaggtttaagtttaatttttaaacgttttaaagtttaacggttcggtaacttaccggtaaacgttaaaccccgaaaacgggtaccgggaaaacccttcccaaggttccttaccggtataccttacgttactggacttagtactaaccgtttacgtaagttaaccggtaacggtccggtaccttaagttaccgtagggtacgaggtcggtaacngggttacagttcgggtaagacttcgtacttactacctctaccgtactacgtacgttaggtactaacctagtaaccgtaagtttacgttaagttactaaccttcgttactacgtactaagtacgtaacttacgttaccctacctacccgtctacggttaccgtcgtacggggtacgaccggtaaggtgaacgtacgtacgaacgtaggtcgttacgcgtacacgtacgtatcggttac

SEQ ID NO: 181788 - DNA, 835 bp, Homo sapiens
  misc_feature: GYAE6OF01ADR7O.2.39.D06.1.454.CMB.1.raw
  modified_base (779)..(779): a, c, t, g, unknown or other
  misc_feature (779)..(779): n is a, c, g, or t
tcagacgctcgacacacgaccggtgctcgatttagtgacatctcgcagtttcgtttgggggagccagtctcagtcaggacacagcatggacatggacgggtccccgctcacgcctccgtcggggcctcctgctactcgtcggcctccggagagttcgacctagtaagttcgtacgaacccaacccgtaagacgtaccgaccgtacttcctaccctaccttcccttccgttcgttctcgcttacgtcggttagggaggaacgacgacggtacgtctactacgtacttccgttacggtcgggaccggtacaacggttaccgtagggtttacgtttaagtttttaaacgttttaaatttttaaacgttttaaaagttcggttaactaaccgtaaacggttaaaccgggaaaaccgggtaacggtaaaccccttaccccgtaggttcctacgttaacggacttagtacgcgtactacgtaccttaacgtttacggttaaaggttaaccggtacgggtccggtaaccgttacgtaaccggtaaggttcggttacgacggtacggttggtacggtacgttcggtaacgtacgtacttttacccgtccaccttccaacgttactaacgtacgtaacctaacgttaacctaactacggttagttaacttacgtaactaactaccttaacgttgaacctacgtaaagccgttaacccggtaccgttacccacccgtttcggaccctttacggtacggtaccgggacggtaaaccgaaggtccggaaanacgttaaccggaacgtcgggtactaccgggatccgtaactcgttacttagttcccg

SEQ ID NO: 181789 - DNA, 917 bp, Homo sapiens
  misc_feature: GYAE6OF01AIBFY.2.39.D06.1.454.CMB.1.raw
tcagacgctcgacacacgaccggtgctcgatttagtgacatctcgcagttcgtttgggggagccagtctcagtcaggacacagcatggacatggacgggtccccgctcgagcctccgtggggcctcctgctactcgtcggcctccggagatcgaccagtatggtacgaacccacccgtaggactaccggaccctacgtcctaccctacttccctcctcgttctcgctacgttcgtgggtaggacacgtagacgtcactactacttcgttcgtaccggaccggtactaaggtcgtaggtagttagtttaagtttaattttaagttaagttcgtactaccgtaacgtaaccgtaaaaccggacggtaaacccgtccccgtagtaccttccgtagtacttacgtgtctacgacgtacctacgttacgttaaggttaaccggacgggttccgaaccgttagtaacggtttaacggtaccggtagggtacgtacggtagggttacgtaacgggttacggtacggggtaactttaccggttactttaacccgtcctaaccgttaacccgtacgttaacgttaccgttaaacggttaacgttaacccttaaaccggttaacggtaacgtttaaccgtttaaccgttttaaaccgaacccgtttaacctttaccgtaacgtttaaccctaaaccggtaacgttaaacccggggttaccgtttaaaccccggttcccccgtttaaccccgaccgggtttaacccttaaccccggggtttacggggtaaccccgggaaggggttaaacccggggacggttaaacggggtccgtaacggttaaaccggtaaacccgggttaacgttaaacggttccggggtaaccgttaacgacccgggtttaaaccccttgtttacccggttaaccg

SEQ ID NO: 181790 - DNA, 802 bp, Homo sapiens
  misc_feature: GYAE6OF01A7E8M.2.39.D06.1.454.CMB.1.raw
tcagacgctcgacacacgaccggtgctcgatttagtgacatctcgcagttctttgggggagccagtctcagtcaggacacagcatggacagtggacgggtccccgctcagcctccgtggggctccgtgctactcgtggctccgagatcgccagatgtacgaccacccagtactcgacccagttcctcctactccctccgttgtcctgcctattcgtgggtagggacacgtagacgttacacgtctacttccgttcgtaccgggacccgggtactaaggtccgtaaggttcggtttaagtttaagttttaattttaaacgttttaaaggtttcgtaacttaccgttaaacgttacccgaaaacggtaacgggtaaacccgtaccgtaacgccgtttaccgacgttaccgttcgttacgttacgtcgtacccgtactaaccgtttacgttaaaacggtttaacggaacggttccggtaaccgtacgttacggtaacggttgtcgggtacgtcggtaaggtacggtataccgggtaaggtacttagttaccttaacgtaccttacctaaccgtaccgtactaccgttagttaccctaacgtaactaacgtagttaacttacgtttacaacgttaacccttaacgtacgttacctaactaaacgtaaccgttacgtaaccctaccctaccgtaccgttccgtacgttaccgggtaccgggtaacgggacccgtaaagggtaggtaaccgtacgaaggttaacccaaggttacccgtgaccggtacgcctaaacgtccttagtaccg

SEQ ID NO: 181791 - DNA, 730 bp, Homo sapiens
  misc_feature: GYAE6OF01CXDAT.2.39.D06.1.454.CMB.1.raw
  modified_base (211)..(212): a, c, t, g, unknown or other
  misc_feature (211)..(212): n is a, c, g, or t
  modified_base (226)..(226): a, c, t, g, unknown or other
  misc_feature (226)..(226): n is a, c, g, or t
  modified_base (238)..(238): a, c, t, g, unknown or other
  misc_feature (238)..(238): n is a, c, g, or t
  modified_base (590)..(590): a, c, t, g, unknown or other
  misc_feature (590)..(590): n is a, c, g, or t
  modified_base (650)..(650): a, c, t, g, unknown or other
  misc_feature (650)..(650): n is a, c, g, or t
  modified_base (690)..(690): a, c, t, g, unknown or other
  misc_feature (690)..(690): n is a, c, g, or t
  modified_base (713)..(713): a, c, t, g, unknown or other
  misc_feature (713)..(713): n is a, c, g, or t
  modified_base (718)..(718): a, c, t, g, unknown or other
  misc_feature (718)..(718): n is a, c, g, or t
tcagacgctcgacacacgaccggtgctcgatttagtgacatctcgcagttctttggggggagccagtctcagtcaggacacagcatggacatggacgggtccccgctcagcctccgtggggctcctgctactgtggctccggagatcgaccgagtatggtacgaaccacccgagacgtacgaccctacgtcctcctactccctccgtgtcnnctatcgtggagganacgagacgtacnctacgtactcgtcgtcggcggatacgtgagttagttagtttagttaactttaagttaagtgtaactacgtaacgtaaccgaaacggtaaacgggtaacccctccgtaagtcccttacgtagttactacgtcgtacgtcctacgtacttaaccgttaaccgttaaacggttaacggtaaccgggttcccggtaacctaagtttaacgggtacgttaccggtagggttcgacgggttaaggtcgggttaaccgtcgggtaaagggtaacttaacgttacctttaacccgaccttaccgtaaccaagtacgtaacgtagtaacctaccctaaacgttaattacggtaaacgtttntaccgtaaactaacttccttagaccgtaaatacggacgttacgaacccctctaccccgtnttcgtaacgtcgggtaggacggtacgtaaggacgacgganactaaaccggaggtgttcaccgntaacncgttctggttcc

SEQ ID NO: 181792 - DNA, 725 bp, Homo sapiens
  misc_feature: GYAE6OF01BUCDD.2.39.D06.1.454.CMB.1.raw
  modified_base (201)..(201): a, c, t, g, unknown or other
  misc_feature (201)..(201): n is a, c, g, or t
  modified_base (206)..(206): a, c, t, g, unknown or other
  misc_feature (206)..(206): n is a, c, g, or t
tcagacgctcgacacacgaccggtgctcgatttagtgacatctcgcagttctttgggggagccagtctcagtcaggacacagcatggacatgagggtcccgctcagctcctggggctcctgctactctggctccgagatgccaggatgtgacaccagatcgaccagtcctccattccgccctgtactgcatctggtcgganacagngtcatcactctcgtcggcggacagtcgaagtcgttagtttaagttaactttaagttaaagttaggtatacgtaacgtttaccgaaaaccggaacggtaaaccgtacccgtaagtcctaccgtgtacttacgtaagtgtacctcgtactactacgtaagtttaacgtaacggtccgggttaccacgtacgtaaggtcgtaacggttcgacgtacggtcgacgtacggtaaggtaactacggttacttacgtaccgttctaccgaactacgttaagtacggttaactaccgaacttaaccgtaagtacgttactttcgaaccttaactacgttacgtacgtaacgtacgtaacgttaacggttaacctacccgtaacccgttctaccgttaccgttaaccggttacccgggaacgggttaccggtaaaccgggtagggtaacggttaacgggtaactaacccgggaaagttacccgggttacgacggttacccgtagacccttaaccggtcgtttacccgg

SEQ ID NO: 181793 - DNA, 646 bp, Homo sapiens
  misc_feature: GYAE6OF01AQEGW.2.39.D06.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctcctgtctgctatcgtggtggganacaggagtcatcatcctcgtggccgganaagtcgagtagttagttaagttatttaatttaagttggtatctagttacgaaacgaggaacgccccgtaagcctccgtgtacttactagtcgacgtcgctacttaccgtaagttaacgtaaggtcgggtaccctagtacgtaggttcgaggtcggtagtaggtgtacgtcggtaggactagtacttcactcctactacgtatactagtacgtactaactaacgtagtaagttacgtttacaaccttaattacctacgtacgtaactaagtaacgtacgtaacctacccgtaaccccttcgtacccttaccgtaccgggtttacgggaccgggtaaacggtacccggtaagggtacgtaacggtacgtaaaccggtaaccgtaagtcggtaccgacgtacgaccctacgtagttaccg

SEQ ID NO: 181794 - DNA, 902 bp, Homo sapiens
  misc_feature: GYAE6OF01DMKLG.2.39.D06.1.454.CMB.1.raw
  modified_base (149)..(149): a, c, t, g, unknown or other
  misc_feature (149)..(149): n is a, c, g, or t
  modified_base (430)..(430): a, c, t, g, unknown or other
  misc_feature (430)..(430): n is a, c, g, or t
tcagacgctcgacacacgaccggtgctcgatttagtgacatctcgcagttcgtttgggggagccagtctcagtcaggacacagcatggacatggacgggtccccgctcagtcctccgtgggctcctgctactcgtcggctccgagtacncgaccagtatcgtacgaccacccgagtactaccggaaccctagtccctaccgtacctcccttcccgttcgttcgtacgtacctattccggtagggagggaacgaacgtagtaacgtactactacctacgttccgttcggtaccgggaccggtaataacggtagtaggttaaggttaggttttaagtttaaatttttaaagttttaaagttggtaaccttacgtaaacggttaacccaaaacgggtaacggaacccgttaccctaacggtccttaaccgttnaactttctacggtcgcgttacgaacctttaacggttaacccgttaaaggtttaaccggaaacgggttcccgtaaccgtaagttaacggttaacgtcggtaacggtcggtaacgtggtagttagaacccgggttaacgtacgttaacttccgtttaaccgacgttacctaccggtaacctacggtaacgttacggtaccctaacgttaaccgttaaattacgtaaacgttacgtttaacgtaaccgttaaccttaacgttatacgtaacgttaaacgtacgttaacccgtaccgttaacccgttaccccgttacgtaacccggttacccggtaaccgggttaccgggtaaacggggtaacccggggttaaacggtaacgggtaacggtaaccgtaaaccggttaaacccgggtaaaccggttaacgtcgggtaaacccgttacgggaaacctacctaccgtaccggtttaccg

SEQ ID NO: 181795 - DNA, 720 bp, Homo sapiens
  misc_feature: GYAE6OF01BGNAD.2.39.D06.1.454.CMB.1.raw
tcagacgctcgacacacgaccggtgctcgatttagtgacatctcgcagtttctttgggggagccagtctcagtcaggacacagcatggacatgagggtccccgctcagctccgtgggctcctgctactctggctccgagatcgccagatgtcgaccacccagtatcgaccctagtcctccactccctccctgtctgctatcgtggtggagacagtagtcatctactcgtcgtcggccggtataacgtcaggtagttgtttaagtttaattttaagtttaaagtttggtactacgtaagttaaccgaaaaccggaacgggtaaaccgtacccctaagtccttacgtacgtaacttcgtagtcgtcgttacgactaacgttaccgttaaaggtttaacggaaacgggtccgggttacctaacgttacgtaggttacgagtcggacgtaggtacggtacgtcggtacggtaactaggtttacttacctacctcgtaccgactacgttacgtacgttacgtacctaacgtaaccgtaggttaactttcgtttaataccttaacttctaacgtactaacgtaacgtaacgttacggttaacccaccgttaacccgtccgttacctaccgtacgggttaccgggacggtaaaccgggtacgtacgggtacgtaacgtaacgaacgtaaggtaccgtagtcggttacacggtacctacgtagttccg

SEQ ID NO: 181796 - DNA, 930 bp, Homo sapiens
  misc_feature: GYAE6OF01BW9WU.2.39.D06.1.454.CMB.1.raw
  modified_base (237)..(237): a, c, t, g, unknown or other
  misc_feature (237)..(237): n is a, c, g, or t
tcagacgctcgacacacgaccggtgctcgatttagtgacatctcgcagttctttgggggagccagtctcagtcaggacacagcatggacatgaggtcccgctcagctccgtgggctcctgctactctcggctccgagatcgccagatcgtgaccacccagactcgacccagtcctccactcctccgtgtctgctatcgtggtcggatacagtgtcatcactcctcgtcggaccgganaacgtcgtagtagttacgttaagttaactttaagtttaagttcggtatcgtaacgttaccgaaaccgtaagggtaacctacccctaaagtccgttaccgtaggtacttacctagtcggtcctagtaccctaacgttaccgttaaaggtttaaaccggtaaacgggtcccgggttaacccaaggtttaaccggtaacggtttaccgaacgggttgggtaacctaagggttacggtaacgtttacgggtacgggtaaacgttacgttacgtttaccctaacgttaccgtaaccccgttacgtaaccgttaaccgtaaaccggtttaaccgttaacccgtaaacccgttaaccggttaacgggttaaacgtttttacggtttaaaccccgtaaaccttttaacccgtttaacccgttaacggttaaccgttaaaaccgaaaccgggttaaccggtttaaacccgggtttaacccccgtttaaccccgttaccccccgtttcccggtaaaccgtttaccccgggtttaaaacccgggtttccggggggaaacccggggttaaaccgggaaacccggggtttaaacggggtacgggttaaacccggtaaaaccgttaaaccgggtaaaaaccggtttccgggttacggtaaccgggttaccctaacggtaccccgttaaccgttacggtttaaccccg

SEQ ID NO: 181797 - DNA, 961 bp, Homo sapiens
  misc_feature: GYAE6OF01BDRKK.2.39.D06.1.454.CMB.1.raw
  modified_base (105)..(105): a, c, t, g, unknown or other
  misc_feature (105)..(105): n is a, c, g, or t
  modified_base (926)..(926): a, c, t, g, unknown or other
  misc_feature (926)..(926): n is a, c, g, or t
tcagacgctcgacacacgaccggtgctcgatttagtgacatctcgcagttctttgggggagccagtctcagtcaggacacagcatggacatggacgggtccccgntcagctccgtggggctcctgctactctggctccgagatgccagtatgtagaccaccctagatcgaccctagtcctccacttccctccctgtctcgacattccgtggtacgggagaacaggtacgtcctaattcctacgtttccttccgttcgggaccccggggtataaacggttaccgtaagggttaaggttttaaggtttttaaacggttttaaaattttttaaacgtttttaaaaacggttttcgggttaaacgtttaccgttaaacggtttaaaaccccggaaaaacccgggtaaacgggggtaaaacccgtaaccccccgtttaaaacggtccccgtttaacccgtacggttaaactttcggtaaacgttcggtacctttacggtaccctaaccgtttaaacccgttaaaacgggttttaaaaccgggtaacggggtttacccggggttaaaccctaggtttaaccggtaaacgggtttacgtacggggttacggtaacggtaaggttcgggtaaaccgttcgggtaagggtaaaccttacggtttacctttaaccgtaacccttaccttacccgaaccgttacgttaccgttaaacgttaaccgttaaaccgttaaaccctaaaccgttaagggttaaactttaacgtttacccgaaacttttaaaccgtttaaccttaccgtaacgtaactaaaccggtaacggttaaccgttaaccttaccccgttacccttaacgtccttaccggttaccgttacggggaccgggtaacggtacgggtaagtaccggtaacgtaacggtaacaaaccgggttnacggtacggtacccaggaccccttacgtcgttacc

SEQ ID NO: 181798 - DNA, 840 bp, Homo sapiens
  misc_feature: GYAE6OF01BRHCR.2.39.D06.1.454.CMB.1.raw
  modified_base (150)..(150): a, c, t, g, unknown or other
  misc_feature (150)..(150): n is a, c, g, or t
  modified_base (153)..(153): a, c, t, g, unknown or other
  misc_feature (153)..(153): n is a, c, g, or t
tcagacgctcgacacacgaccggtgctcgatttagtgacatctcgcagttctttgggggagccagtctcagtcaggacacagcatggacatgacgggtccccgctcagctccgtggggctcctgctactcgtggctccgagatcgccagntgnaccaccagatcgacccagtcctccacttcctcccttgtcctgtactctcggttggacgggacacgtacgtagtactactcacgttctccgttacgggaccggtaacctaaggtaccgtaaggttcggttaagttttaacgtttaattttaacgtttaaagttggtaacttacggtaacgttaaccgaaaccggtaaacgggtaaccctacccgtacgtccttaccggtactacgtttagtacgtcgtacgtcgtaaccgttaaccgttaccggtttaaaggttaaaccggttaaccggggttaccgggtaccctaaaggttaccggtaacggttaccgagggttaccgtcggtaggttaacgtacgttacgggtaggaacctttagttacctttacccgtaacgtccgttaaacctacccggttaagtaaccggttactttaacccggtaacgtaaaccgaaccgtttaagttaaccggtttaagttaaccgttaccgttaaaccctttaccgtacgttaaccgtaaccgtaacgtaaccggtttacggttaacctaacccccgtttcccgaaccgtcgttaaccggttccgtaaccggccgggttaaacgaacccgggtagtaccggaataaccggtaacgtaacggtcgttaacggcgttaccaacggccttaacgtcgtttccg

SEQ ID NO: 181799 - DNA, 896 bp, Homo sapiens
  misc_feature: GYAE6OF01BACXL.2.39.D06.1.454.CMB.1.raw
tcagacgctcgacacacgaccggtgctcgatttagtgacatctcgcagttctttgggggagccagtctcagtcaggacacagcatggacatgacgggtccccgctcagctccgtgggctcctgctactctggctccgagatcgccagtatgcgaccacccagactaccgaccctagttccctacctacttccctcccgttgttcctcgacctagtcgtacgggtacgggaagtaccaggtacgtactactacctacgttccgttcgtcgggccggtactaacggtcaaggttagtttacgtttaagtttaattttaactttaaacggttgtaacttaccgtaaacgtttaaacccggaaaaccggaaacggtaaccctaccccggttaacgtacccgttacgttacgtaccgttacttaacgtccgtaccgtacgtaccctaacgtttaaccggttaaacggtttaaaccgggtaacgggttcccgggtaaccctaacgttaccggtaacggtttcgaagggttccggacgttaagggttcgtacggtaccgggttacggaacttacgtttaaccgttccctacgttacccaacccgttactaaccgttacgtaaccgttaacgttaaccctaaacggtaaccgtaagttaacgttttaccgttaacctaaaccgtttacttacccggttactaaccggttaaacgtaaccgttaaccgttaaccggttaaccctacccccggttacccgtacccgttaccgttaccgggtaccgggttccgggaaccgggttaaaccggtaaggtacggtaccggtaaacgtaacccggttaaagtaacccggggttagttacccggttacgaaccttacccgccgttaaacgtttcggtacccg

SEQ ID NO: 181800 - DNA, 858 bp, Homo sapiens
  misc_feature: GYAE6OF01E2TPQ.2.39.D06.1.454.CMB.1.raw
  modified_base (817)..(817): a, c, t, g, unknown or other
  misc_feature (817)..(817): n is a, c, g, or t
tcagacgctcgacacacgaccggtgctcgatttagtgacatctcgcagtttcgtttgggggagccagtctcagtcaggacacagcatggacatggacgggtccccgctcagcctccgtggggcctccctgcttactcgtggcctccgagatgccagtagtgtcgaccacccgagtatacgacccgagtcctacctaccttcccttcccgttgttcctcgcgtacgttcgttgggtacgggaagacgtaaggtacgtactactctacttcttcggtcggacccggacgtaacggtactaggtagtttaggtttaagttttaagtttttaaagttttaaagtttggttaacgttacttaacggttaaacccgaaaaccggtaaaccggggtaaacccgttaccccgtaaaggtcccttacccgtacgttaacttaccgtttaagtccggtacgttaccgtactttaaaccgttttacccggttaaaacggttttaaaccgggaaacggggtttacccggttaaccctaaacgtttaaccggtaacggggttttacgaacggggtttacggtaacggttaaaggttcgggtttaacccgttcgggttaaaccgggaaactttacgttacccgtttaccacttacccgtaccaaccttacggttacgttaacgttaactacctaaaccgtaacgttattaacgtttacctttagaccctttaacgtaccgtttacgaacttaaccaagtaccgtaacgtacccgtaccgttaccccgttcctcgtaccgttaccggtccgggacgtaacggaactaggganactaacggaagcgtagcggtagcctagccctagtcgttacg

SEQ ID NO: 181801 - DNA, 585 bp, Homo sapiens
  misc_feature: GYAE6OF01C485F.2.39.D06.1.454.CMB.1.raw
  modified_base (202)..(202): a, c, t, g, unknown or other
  misc_feature (202)..(202): n is a, c, g, or t
  modified_base (386)..(386): a, c, t, g, unknown or other
  misc_feature (386)..(386): n is a, c, g, or t
  modified_base (446)..(446): a, c, t, g, unknown or other
  misc_feature (446)..(446): n is a, c, g, or t
  modified_base (572)..(572): a, c, t, g, unknown or other
  misc_feature (572)..(572): n is a, c, g, or t
  modified_base (578)..(578): a, c, t, g, unknown or other
  misc_feature (578)..(578): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtctccatccctccctgtctgcatctggtggganacagagtcatcattctcgttcgaccgggctaagtcaggtagttagtttagttattttaatttaaagttggtattcgagttaccaaaccggtaggaactaccccgtaagcctccgtagatcgtattcgctgctactcgtaagttacgaacggtcggtacctagtacgtagtcagtgcaggtacgntcgaggtactagtctttcactctacactatctacgtactacctaacaccgttagaacttntttacgacttaacgttactactagtaacaacgtagtacgtaacgcctaccccgtctactacgtaccggttacggacggaacggtacgaacgggtgaactacgaacgtaacgtctaggtacacgtanaccctntcgttcg

SEQ ID NO: 181802 - DNA, 864 bp, Homo sapiens
  misc_feature: GYAE6OF01ALCU8.2.39.D06.1.454.CMB.1.raw
tcagacgctcgacacacgaccggtgctcgatttagtgacatctcgcagttcgtttgggggagccagtctcagtcaggacacagcagtggacatggacgggtcccccgctcgacgtcctccggtggggtcctccgtgccgttacgtccttggccgtccggacgtagtcggaccaaggcgttcggtcgaacccacccgaaggtactaccgaacccgtcgttccctacctaccttcccctcccgttgttactcgactacgttcggttcgggagggaaccgtacaaggtacgttacaactctaccgttcctacgttaccggggccggtactaacggtcgtaggttagtttagtttaagttttaatttttaagtttaaacgtttacgttacttacgttaaaccgttaacgaaaccggtaaaccgggaaaccctacccgtaaccgttccgttaacgttacgttaaccttcgttaacgttcgtaccgtacgttactaaccgttaaccgtttaggttaaaccggttaccgggtaccgttacgtaacggtaacgttaaaggtcctagggtaccgtaagggtacggttacgtacggttcgaagtacgtagttaccttaccgttccacgtacgtaccgtagttaaccgtacgtaacgtaccctaaacgttaacggtaacgttattacgttaacgtaacgttacttacgttaacctacgtaacgttacgtaaacggtacgttaaccgttaacccccgtaccgttcttaaccccgttaggttaccccggttacggaaccggtacgggtaaacgtcggtaacgttaagtacgtaacgtaagtacgtaggtacgaccgtgacccttacgttgtacccgg

SEQ ID NO: 181803 - DNA, 757 bp, Homo sapiens
  misc_feature: GYAE6OF01E18FR.2.39.D06.1.454.CMB.1.raw
  modified_base (749)..(749): a, c, t, g, unknown or other
  misc_feature (749)..(749): n is a, c, g, or t
tcagacgctcgacacacgaccggtgctcgatttagtgacatctcgcagttctttgggggagccagtctcagtcaggacacagcatggacatgagggtccccgctcagctccgtggggctcctgctactcgtggctccgagatgccaggctggtacaccacccgagtatcgacccacgtactcctaactccctcctgtctagctatcgtggtagggatacacgtagtcaactctacttcctcgttcggaccgggtactaagtcgaaggtggtttaacggttaagttttaagttttaaacgtttaaagttcggtaacttacggtaaaccgtttaaccgaaaaccggtaagggtaaaccccgtaaccccgttaacggtcccttaccggtagtacttactacgtcggtactacgtaccctaacgttacttaaaccggttaaccggtaacgggttccgggtacctaaggttaccgaagggtttcgaggtcggtaccgtaggtacggacgttcgggtaacggacttagttaccttaccgtaccgtacctaccgaactcggtaacctaagtacccgtaactaccgtaaccgtaagggttaccttacgtttaccgtaaccttaacggttaacttctacgggaactaacggtaattaacccggtactacccttccccggattaccgaccgttacggtcggacggttaaacgacggtaggtcgataaaccgcgtaaaccgacgtgaacgtcacggtacnctagtccg

SEQ ID NO: 181804 - DNA, 490 bp, Homo sapiens
  misc_feature: GYAE6OF02IOOBO.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaaattggtatcagttcaaaccagggaaagcccctaagctcctgatctatgctgcatccagtttacaaagtgggtcccatcaaggttcagtggcagtgatctgggacagatttcactctcacatcagtagtctacaacctgaagtattttgactaacttactactgtacaacagtagttacgataccctcactcacttcgcgaggaccaaggtgagagtacaacgactgtggctgacacatcg

SEQ ID NO: 181805 - DNA, 495 bp, Homo sapiens
  misc_feature: GYAE6OF02H091T.2.39.D06.1.454.CMB.1.raw
  modified_base (271)..(271): a, c, t, g, unknown or other
  misc_feature (271)..(271): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtattatttaaatggtatcagttcaaacaggaancccctaagctcctgatctatgctgcatccagttacaaagtggtccatcaaggttcagtgcagtgatctgggacagatttcactctcacatcagtagtctacaacctgaagtattttgactaacttactactgtacaacagtagttacgactaccctccgtctcaactttcggacgacgggaccaaggtggacgatcgaaacgtactagtggactgactaccatc

SEQ ID NO: 181806 - DNA, 497 bp, Homo sapiens
  misc_feature: GYAE6OF02I5VQN.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagttagtctaacaacctgaagtattttgactaacttactactgtacaacagtagttacgatacccctcgctcacgtttcgcggacggaccaaggtggagatcaaacgactgtggctgcaccatc

SEQ ID NO: 181807 - DNA, 494 bp, Homo sapiens
  misc_feature: GYAE6OF02I8WIL.2.39.D06.1.454.CMB.1.raw
  modified_base (347)..(347): a, c, t, g, unknown or other
  misc_feature (347)..(347): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaaggttcagtggcagtggatcngggacagatttcactctcacatcagtatctacacctgaagtattttgactaacttactactgtcaacagtacgtacgactacccctcgctctacgttcggcggagggtaccaagggtggagatacgaacgactgtggctgcacatcg

SEQ ID NO: 181808 - DNA, 495 bp, Homo sapiens
  misc_feature: GYAE6OF02GKK3X.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtgcagtggatctgggacagatttcactctcaccatcagtagtctacaacctgaatattttgctaacttactactgtcaacagagttacgactaccctccgctcactttcggacgaggaccaggtggagatacaaacgacgtgtggctagcaccataccg

SEQ ID NO: 181809 - DNA, 492 bp, Homo sapiens
  misc_feature: GYAE6OF02G9DWJ.2.39.D06.1.454.CMB.1.raw
  modified_base (346)..(346): a, c, t, g, unknown or other
  misc_feature (346)..(346): n is a, c, g, or t
  modified_base (434)..(434): a, c, t, g, unknown or other
  misc_feature (434)..(434): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagttcagtggcagtgatntgggacagatttcactctcaccatcagtagtctacaacctgaagattttgactaacttactactgtcaacagagttacgataccctcncctcactttcggcgagggaccaaggtggagatcaaacgagtgtggctaggcacgatcg

SEQ ID NO: 181810 - DNA, 534 bp, Homo sapiens
  misc_feature: GYAE6OF02I5PPR.2.39.D06.1.454.CMB.1.raw
  modified_base (223)..(223): a, c, t, g, unknown or other
  misc_feature (223)..(223): n is a, c, g, or t
  modified_base (278)..(278): a, c, t, g, unknown or other
  misc_feature (278)..(278): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttattaaattggtatctagttacaaaccagggaaacncccctaagctcctgatctatgctgcatcctagtttacaaagtgggtacccatcaaggttcagtgcagtgatcgtggacagtattcactctcactatcagtagtactaactaacctgaagtatttgactaacttactactgtacaacagtagttaccgactacccctcgctcgtacgtttcggacggacgggaccgaagggttcggagtaacgtacgaaacgtacgttaggtcggacttacgacctaccgtattccg

SEQ ID NO: 181811 - DNA, 519 bp, Homo sapiens
  misc_feature: GYAE6OF02I28EU.2.39.D06.1.454.CMB.1.raw
  modified_base (276)..(276): a, c, t, g, unknown or other
  misc_feature (276)..(276): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaancccctaagctcctgatctatgctgcatccagtttacaaagtgggtcccatcaaggttcagtggcagtggatcgtgggacagatttcactctcaccatcagtagtctacaacctgaagtattttgactaacttactactgtacaaacagtagtttacgacttacccctccgcttcctacgtttcggcggtacgggaccgtagggtggaagagtacaaacgtactggtggcctggcaccgattcg

SEQ ID NO: 181812 - DNA, 528 bp, Homo sapiens
  misc_feature: GYAE6OF02HQGEF.2.39.D06.1.454.CMB.1.raw
  modified_base (411)..(411): a, c, t, g, unknown or other
  misc_feature (411)..(411): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaagtgggtccatcaagttcagtggcagtgatcgtgggacagatttcactctacaccatcagtagtctacaacctgaagtattttgctaaacttactactntacaactagtagttacgactaccctccgcttcaccgtttcggacggtacgggaccgtaagggtggaagtagtaacgaaaccgtaacgtggtacggcttacggaccacctagttaccg

SEQ ID NO: 181813 - DNA, 496 bp, Homo sapiens
  misc_feature: GYAE6OF02G2C6N.2.39.D06.1.454.CMB.1.raw
  modified_base (276)..(276): a, c, t, g, unknown or other
  misc_feature (276)..(276): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaanccctaaagctcctgatctatgctgcatccagtttacaaagtgggtcccatcaagttcagtgcagtgatctgggacagatttctccctcaccatcagtagtctgcaaactgaggtattttgctaacttacttctgtcaacagagctacactacccgctactacttttcgacccagggacccaaggtcggatctacaaaagactgtcggctggacaccatcg

SEQ ID NO: 181814 - DNA, 494 bp, Homo sapiens
  misc_feature: GYAE6OF02I1RZS.2.39.D06.1.454.CMB.1.raw
  modified_base (491)..(491): a, c, t, g, unknown or other
  misc_feature (491)..(491): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtggggtcccatcaaggttcagtggcagtggatctgggacagatttcactctcacatcagtatctacaacctgaagattttgctaacttactactgtcaacagagttacgatacccctccgctcctactttcggcggaggaccaaggtggagatacaaacgactagtggctgcaccntcg

SEQ ID NO: 181815 - DNA, 526 bp, Homo sapiens
  misc_feature: GYAE6OF02JLA53.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctacctgatctatgctgcatcagttacaaagtgggtccatcaagtcagtgcagtggatcgtggacagtatttcactctcacctatcagtagtactacaacctgaatattttagactaacttactactgtacaactagtagttacgaacttacccgtcgtactacctaacgtttcggacggtacggaaccgtaaggtcggaagtactacgaaacgtacgtagtacggactgacgtaccatacg

SEQ ID NO: 181816 - DNA, 510 bp, Homo sapiens
  misc_feature: GYAE6OF02JCZZB.2.39.D06.1.454.CMB.1.raw
  modified_base (473)..(473): a, c, t, g, unknown or other
  misc_feature (473)..(473): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaagcccctaagctcctgatctatgctgcatccagtttacaaagtgggtccatcaagttcagtggcagtgatcgtgggacagatttcactctcacatcagtagtctacaacctagaagtattttagactaacttactactgtacaacagtacgttacgactacccctcgctctactttcggacggacggaccgaaggtgganagtacaaacgtactggtcggacctggaccacgtatcg

SEQ ID NO: 181817 - DNA, 567 bp, Homo sapiens
  misc_feature: GYAE6OF02IJGP6.2.39.D06.1.454.CMB.1.raw
  modified_base (198)..(198): a, c, t, g, unknown or other
  misc_feature (198)..(198): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatnagttcaaaccagggaaacncccctaagctcctgatctatgctgcatccagtttacaaagtggtccatcaagtcagtgcagtgatcgtggacagtattcatctacactatctagtacgtctaacaactagtaagtattttgactaaacttactactagttacgaaacgtacgttactaacgtaacccgtaccgttacgtaccgttacgaaccgtaacgtaccggtaacggtaagtaacgtaaaccgtaaaccgtacggttacggtacgtacgtacgaacctaccgtacgttacgttacgttacttaaccg

SEQ ID NO: 181818 - DNA, 524 bp, Homo sapiens
  misc_feature: GYAE6OF02JRC5I.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagttacaagtgggtcccatacaaggttcagtggcagtggatcgtgggacagtatttcgactctacacctatcagttacgtactaaccaacctgaagtattttagactaacttactactgtactaacagtagttaaccgactaccctcgctactacgttcggacggacggaccgaaggtggaacagtacgaacgtaactgtacggactagcctacattcg

SEQ ID NO: 181819 - DNA, 552 bp, Homo sapiens
  misc_feature: GYAE6OF02JJDJW.2.39.D06.1.454.CMB.1.raw
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (445)..(445): a, c, t, g, unknown or other
  misc_feature (445)..(445): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaatggtatnagttcaaacaggaacnccctaagctcctagatctatgctgcatcctaagttacaaggtcgggtacccagtaccgtaaggttcaaggtggtacgtagtggatcgtagggactagtactttcacgtctacacctatcgagtatactaacaacctgtaagttatttcgactaacgttactacgtgtacaanagtacgtacgtactaccctccgtctactacgttcggacggtacggtaccgaaggtcgaagtactaaccgaaacgtacgttacgacggtacctaggacctactattcg

SEQ ID NO: 181820 - DNA, 545 bp, Homo sapiens
  misc_feature: GYAE6OF02I3W7H.2.39.D06.1.454.CMB.1.raw
  modified_base (224)..(224): a, c, t, g, unknown or other
  misc_feature (224)..(224): n is a, c, g, or t
  modified_base (433)..(433): a, c, t, g, unknown or other
  misc_feature (433)..(433): n is a, c, g, or t
  modified_base (539)..(539): a, c, t, g, unknown or other
  misc_feature (539)..(539): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctgtgggagacagagtcatcatctcttgccgggnaagtcagagtgttagtatttatttaaattggtatcagttcaaacgagggaaacgcccctaagctcctgatctatgctgcatccagtttacaaggtcggtaccatcaaggttcagtgacagtgatcgtgggactagtatttcacttctacacctatcagtacgtactaacaacgtagaagtattttcgactaacttactactataccaanagtacgttaccgaacttacccctcgtcctactacgtttccgacggacgggaacctaagggtgaagtactaacgaaacgtacgttacggtcggacttacgacctacnttaccg

SEQ ID NO: 181821 - DNA, 497 bp, Homo sapiens
  misc_feature: GYAE6OF02JB1IN.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaaggttcagtggcagtggatctgggacagatttcactctcaccatcagtagtctacaacctgaagtattttgactaacttactactgtacaacagtagttacgactacccctcgctctactttcggcggaggaccaaggtggagatacaaacgacgtgtggctgcaccatcg

SEQ ID NO: 181822 - DNA, 514 bp, Homo sapiens
  misc_feature: GYAE6OF02HM82N.2.39.D06.1.454.CMB.1.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccggcaagtcagagtgttagtatttatttaaattggtatcagttcaaacagggaaancccctaagctcctgatctatgctgcatccagtttacaaagtgggtacccatcaagttcagtgcagtgatcgtggacagtatttcactctcactatcagtagtctacaactgaagtattttgactaacttactactgttacaactagtagttaaccgactacccctccgctactacgtttcggacggacggacctaagggtgtaacgatacgaaacgactggtacggctagctaccattccg

SEQ ID NO: 181823 - DNA, 513 bp, Homo sapiens
  misc_feature: GYAE6OF02I6Z9Y.2.39.D06.1.454.CMB.1.raw
  modified_base (223)..(223): a, c, t, g, unknown or other
  misc_feature (223)..(223): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccaggaaagccctaagctctgatctatgctgcatccagtttacaaagtgggtcccatcaaggttcagtgcagtgatctgggactagatttcactctcacatcagtagtctacaacctgaagtattttgactaacttactactgtacaactagtacgttaacgacttacccctccgtactactacgtttcggcggaggtacctaaggtgaagactacaaacgtactgtcggtctagaccacctatccg

SEQ ID NO: 181824 - DNA, 515 bp, Homo sapiens
  misc_feature: GYAE6OF02HKXVS.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcaggtggatcgtgggacagtatttcactctcaccatcagtagtctacaacctgaagtattttgactaacttactactgtacaactagtagttacactacccctccgtctctactttccggcggacgggaccaaggtcggagactacgaaacgactaggtcggctgacacctatcg

SEQ ID NO: 181825 - DNA, 593 bp, Homo sapiens
  misc_feature: GYAE6OF02IUPIO.2.39.D06.1.454.CMB.1.raw
  modified_base (198)..(198): a, c, t, g, unknown or other
  misc_feature (198)..(198): n is a, c, g, or t
  modified_base (274)..(274): a, c, t, g, unknown or other
  misc_feature (274)..(274): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttaattaaattggtatcagttcaaacgaggaacnccctaagctcctgatctatgctgcatctagtttacaaggtcggtacccatactaaggttcaaggtcggacgtaggtggatcgtagggaacagtatttcactctacacatcagtagtctaacaccgtagtaagttatttacgactaacttaccttatacgtacaaacgtacgtaacgttaaccgtaccttacccccttcgtacttaccgtaaccgttttaccggaccgggtaacgggtaaccgtaagggtacggaacgtaacgtaaccgtaaaccggtaacttcgggtacggtaccgtacggacctaccgacgttaccgg

SEQ ID NO: 181826 - DNA, 496 bp, Homo sapiens
  misc_feature: GYAE6OF02FJY15.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaaggttcagtggcagtggatctgggacagatttcactctcaccatcagtagtctacaacctgaagtattttgactaacttactactgtacaacagtattacgactacccctcgctcactttcggacgaggaccaaggtggagatcgaaacgactgtcggctgacaccatcg

SEQ ID NO: 181827 - DNA, 526 bp, Homo sapiens
  misc_feature: GYAE6OF02H313J.2.39.D06.1.454.CMB.1.raw
  modified_base (272)..(272): a, c, t, g, unknown or other
  misc_feature (272)..(272): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaatggtatcagttcaaacaggaancccctaagctcctgatctatgctgcatccagttacaaagtggtccatcaagtcagtgcagtgatctgggacagtattcactctcacatcagtagtctaacaacctgaagtattttagactaacttactactagtacaactagtacgttacgactaccccctcgtcctactacgtttcgggacggtacgggaccgtaagggtcggaacgtactaacgaaacgacttacggtcggactcggactaccgtattaccg

SEQ ID NO: 181828 - DNA, 540 bp, Homo sapiens
  misc_feature: GYAE6OF02HOP14.2.39.D06.1.454.CMB.1.raw
  modified_base (196)..(196): a, c, t, g, unknown or other
  misc_feature (196)..(196): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtgganacagagtcatcatctcttgccggcaagtcagagtgttagtatttattaaattggtatcagttcaaaccaggaaacgcccctaagctcctgatctatgctgcatccagttacaagtggtccatcagttcagtgcagtgatcgtgggactagtattcactctcaccatcagttagtactaacaaccgtagtaaagtattttacgactaaccttactactgtactaacagtacgttacgactaccctccgtcctacgtaccgtttcgggacggtacgggtacccgtaagggtggaacgtactaccgtaaacgacgttacggtcggtcctaggtcctaccgattaccg

SEQ ID NO: 181829 - DNA, 519 bp, Homo sapiens
  misc_feature: GYAE6OF02JXFG2.2.39.D06.1.454.CMB.1.raw
  modified_base (257)..(257): a, c, t, g, unknown or other
  misc_feature (257)..(257): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattggtatnagttcaaaccaggaacgccctaagctcctgatctatgctgcatcctagtttaacaaggttcgggtccatacaaggttcagtggcagtggatcgtagggactagtatttcactctcactatcagtatactacactagtaagtatttagacttaacttactactgtacaactagtacgttacgactaccctcgtctactacgttcggacggacggactacggtggaactatacgaacgagtgtacggctagcctactagttacg

SEQ ID NO: 181830 - DNA, 532 bp, Homo sapiens
  misc_feature: GYAE6OF02G65WT.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtgatctgggacagatttcactctcaccatcagtagtctaacaacctgaagtattttgactaacttactactgtacaactagtagttacgacttacccctccgtaccttctacgtttcgggcggagggtaccaagggtggaacgtaagtaccgaaacgtaacgttggtacggacctaccgacctattctcg

SEQ ID NO: 181831 - DNA, 536 bp, Homo sapiens
  misc_feature: GYAE6OF02IOKAF.2.39.D06.1.454.CMB.1.raw
  modified_base (255)..(255): a, c, t, g, unknown or other
  misc_feature (255)..(255): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggagacagagtcatcatctcttgcggcaagtcagagtgttagtatttatttaaattggtatnagttcaaacaggaaagccctaagctcctgatctatgctgcatctagttacaaagtgggtcctagtctaaggttcagtggacgagtggatgtagggacagtattcactctacacatcagtagtctacaactagaagtattttagactaacttactatcgtacaactagtacgttaacgtacttaacccctcgacctcgtaaccgtttggaccggtacggaaccgaacggtggaacgtagtaccgaaaacgtacgtacgtaggcctacgactaccgtattccg

SEQ ID NO: 181832 - DNA, 516 bp, Homo sapiens
  misc_feature: GYAE6OF02I8TDT.2.39.D06.1.454.CMB.1.raw
  modified_base (513)..(513): a, c, t, g, unknown or other
  misc_feature (513)..(513): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagccctaagctcctgatctatgctgcatccagtttacaagtcgggtccatcaaggttcagtggcagtggatcgtgggacaggtatttcacttcgtcactatcagttatcctacaacctgaagtatttgctaacttactactgtacaagtagtagttacgacttacccctccgtcttactacgttcggcggtagggacctaagggtcggatagtacaacgtaacgtgtcggactgacactntcg

SEQ ID NO: 181833 - DNA, 578 bp, Homo sapiens
  misc_feature: GYAE6OF02HPT20.2.39.D06.1.454.CMB.1.raw
  modified_base (198)..(198): a, c, t, g, unknown or other
  misc_feature (198)..(198): n is a, c, g, or t
  modified_base (348)..(348): a, c, t, g, unknown or other
  misc_feature (348)..(348): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttatttaaattggttatcagttcaaacaggaaagcccctaagctcctgatctatgctgcatcagtttacaaagtggggtacccatcaaggttcagtggcagtgatcgngggacagtatttcactctcaccatacagttatctaactaacctagtaagtattttagacttaaacttactacttacgtactaactagtacgttaacgaacttacccctccgtcttacctaccgttttcgggaccgggtacggggaacctaaacgggggtggaacggtaagtaacccgaaaacggtaaccgttcgggtacggtaccgtaggaccgtacccgtattacccgg

SEQ ID NO: 181834 - DNA, 565 bp, Homo sapiens
  misc_feature: GYAE6OF02JU47U.2.39.D06.1.454.CMB.1.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggcaagtcagagtgttagtatttattaaatggtatcagttcaaacgagggaaacncccctaagctcctgactctatgctgcatcctagttacaaagtcggtccatactaagttcagtggactagngatcgtggactagtattcacgtctacactatcagtacgtactaactaactagtaagttattttacgacttaacttaactactacgtacaacgtagtacgttaaccgtacttacccctacgtcctaccgtaacgtttccggaccggtacggtaaccgtaacggtggtaacgtactaacgaaaccgtaacgtacgtacggtacctagaccgtacgtacgttcg

SEQ ID NO: 181835 - DNA, 561 bp, Homo sapiens
  misc_feature: GYAE6OF02I354N.2.39.D06.1.454.CMB.1.raw
  modified_base (197)..(197): a, c, t, g, unknown or other
  misc_feature (197)..(197): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccgggcaagtcagagtgttagtatttattaaattggtatcagttacaaaccagggaaacgcccctaagctcctgatctatgctgcatccagtttacaaagtcgggtaccatctaaggttcaggtggactagtggtatcgtaggactagtactttacacgtctacaacctatctaagtatactaaccaacctgaaagttattttagactaaactttacctacttgtaccaagacgtacgttaacgacttacccctaccgtacctactaccgtttcgacggtacgggactaagggtcggagtactaacgaaaccgtacgttcggtaggtctcggactaccgataccg

SEQ ID NO: 181836 - DNA, 525 bp, Homo sapiens
  misc_feature: GYAE6OF02GL4LN.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggcaagtcagagtgttagtatttatttaaattgtatcagttcaacaggaagccctaagctctagatcatgctgcatccagttacaagtggtccatcaaggttcagtgcagtgatcgtgggacagtatttcacttcacactatcagttagtctaacaacctgtaatattttgactaacttactactgtacaacagtagttaacgacttaccctcgcttactacgtttcgggacggacgggacctaagggtcggaagtaacgtacgaaaacgtacgttacggtggtaccgtagaccctacgatttccg

SEQ ID NO: 181837 - DNA, 561 bp, Homo sapiens
  misc_feature: GYAE6OF02I66R5.2.39.D06.1.454.CMB.1.raw
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttcaaacaggaacnccctaagctcctgatctatgctgcatccagttacaagtgggtcccatcaagtcagtggcagtggatctgggacagtatttcactctacacctatacagttacgtactaactaacctagaagttacttttagctaaaccttcttactagtaccaacgtaagtacgttacgaacttaccccttccgacttacctacgtttaccgggaccggtacgggtacccgtaagggttcggaagtacgtaccgaaaacggacgttaggtcggaccgtacgaccctacctacttaccg

SEQ ID NO: 181838 - DNA, 527 bp, Homo sapiens
  misc_feature: GYAE6OF02IW6FX.2.39.D06.1.454.CMB.1.raw
  modified_base (355)..(355): a, c, t, g, unknown or other
  misc_feature (355)..(355): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcattcaaacagggaaagcccctaagctcctgatctatgctgcatccagtttacaaagtggggtaccatcaaggttcagtgcagtgatcgtggacagtnttcactctcaccatcagtagtactacaacctgaagtattttgactaacttactactgtacaacagtacgttacgactacccctcgtcctactaacgtttcggacggtacgggacctaagggtcggacgtaagtacaaaaccgtagtacggtcggactacgactaccattccg

SEQ ID NO: 181839 - DNA, 498 bp, Homo sapiens
  misc_feature: GYAE6OF02HODDR.2.39.D06.1.454.CMB.1.raw
  modified_base (197)..(197): a, c, t, g, unknown or other
  misc_feature (197)..(197): n is a, c, g, or t
  modified_base (350)..(350): a, c, t, g, unknown or other
  misc_feature (350)..(350): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctgtggganacagagtcatcatctcttgccgggcaagtcagagtgttagtatttattaaattggtatcagttcaaacaggaaagcccctaagctcctgatctatgctgcatccagtttacaagtggtaccatcaagttcagtgcagtgatctagggacagtnttcactctcacatacagtacgtctaactacctagaagtattttgactaacttactactgtacaactagtagttacgactaccctcgtctactactttcggacggacggactaggtgacgatacaacgatcgtaggctagactacatcg

SEQ ID NO: 181840 - DNA, 643 bp, Homo sapiens
  misc_feature: GYAE6OF02ITQJF.2.39.D06.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (226)..(226): a, c, t, g, unknown or other
  misc_feature (226)..(226): n is a, c, g, or t
  modified_base (263)..(263): a, c, t, g, unknown or other
  misc_feature (263)..(263): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctggtggganacagagtcatcatcctnttgccgggnaagtcagtagtgttagtatttaatttaaattggtatntagttacaaacgagggaaactaccctaagctcctgtatactatgctgcactacctaagtttaacgaaaggttcgggtacccagttacgtaaaggttcaaggtggcgtaggtgagtcggtacgggaacgtaggttactttacgacttctaccacctatacgtagttacgtactaacctaacgttagtaaacggttaattttacgacttaacctttaacgtacttacgtaactaacgtaacgtacgttaaccaaccttacccctacgttaccttacgtaccgtttcgggaccgggtacgggtaaccgtaacgggtcggaacgtacgtaaaccgaaacggtaaccgttggtacggtactacggtacccgtaccgtagttaccg

SEQ ID NO: 181841 - DNA, 492 bp, Homo sapiens
  misc_feature: GYAE6OF02IFP7Q.2.39.D06.1.454.CMB.1.raw
  modified_base (198)..(198): a, c, t, g, unknown or other
  misc_feature (198)..(198): n is a, c, g, or t
  modified_base (275)..(275): a, c, t, g, unknown or other
  misc_feature (275)..(275): n is a, c, g, or t
  modified_base (418)..(418): a, c, t, g, unknown or other
  misc_feature (418)..(418): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacagggaaancccctaagctcctgatctatgctgcatccagttacaaagtgggtcccatcaaggttcatggcagtgatctgggacagtatttcactctcaccatcagtagtctacaacctagaaagtattttgactaacttactactgtcaanagagtacgataccctcgctcactttcggcggaggaccaaggtgagatacaaacgaactggtggactgacacatc

SEQ ID NO: 181842 - DNA, 642 bp, Homo sapiens
  misc_feature: GYAE6OF02IODV4.2.39.D06.1.454.CMB.1.raw
  modified_base (198)..(198): a, c, t, g, unknown or other
  misc_feature (198)..(198): n is a, c, g, or t
  modified_base (278)..(278): a, c, t, g, unknown or other
  misc_feature (278)..(278): n is a, c, g, or t
tcagacgctcgacacacgaccggtgctcgatttagtgacatctcgcagttcttttggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccggcaagtcagagtgttagtatttattaaagttggtatctagttacaaacgagggaaacnccctaagctcctgattctatgctgcactacctaagtttaacgaaaaggttcggggtaccctattacgtaaaggttcaaggtttggactaggtaggtatcgttagggactagtatttcgaactcttacaacctatactagtagtacctaaactaaccgtagtaaacgtacttttagacttaacctttaactactacgtactaaaccgtagtacgtaactacctacccctaccgtcctactaccgtttacgggacgggtaaccgggtaaccgtaacggggtacgtaacggtaccgtaaaccgtaaaccggttaaacttcgggtaaccggtaccgttacggtaccccgtaaccttaccgtttaccgg

SEQ ID NO: 181843 - DNA, 580 bp, Homo sapiens
  misc_feature: GYAE6OF02FFM2Y.2.39.D06.1.454.CMB.1.raw
  modified_base (224)..(224): a, c, t, g, unknown or other
  misc_feature (224)..(224): n is a, c, g, or t
  modified_base (419)..(419): a, c, t, g, unknown or other
  misc_feature (419)..(419): n is a, c, g, or t
  modified_base (447)..(447): a, c, t, g, unknown or other
  misc_feature (447)..(447): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatctcttgccgggnaagtcagagtgttagtattttattaattggtatcagttacaaaccgaggaacgcccctaagctcctagatctatgctgcatcctaagtttacaaaggtcgggtccatacgaaggttcaggtcggcgagtggacttcgtagggactagtactttcacttcacactatctagtacgtactaacaaccgtgtaagttntttacgactaacttactactagtacaanagtacgttaacaaccttacccctcgcttacgtaccgtttaccgggacgggtacggaccgaagggttaggaacgaacgtaaccgtaaaacggtaacgttacggtacggttaccgtacggacctaccgtattccg

SEQ ID NO: 181844 - DNA, 506 bp, Homo sapiens
  misc_feature: GYAE6OF02G74EK.2.39.D06.1.454.CMB.1.raw
  modified_base (379)..(379): a, c, t, g, unknown or other
  misc_feature (379)..(379): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtggggtccatcaaggttcagtggcagtgatctggacagattcactctcaccatcagtagtctanaacctgaagtattttgctaacttactaactgtacaactagagttacgatacccctccgcctcaccgtttcggcggtaggaccgaaggtgagagtacaaacgtaactacggtggacttgacacatccg

SEQ ID NO: 181845 - DNA, 530 bp, Homo sapiens
  misc_feature: GYAE6OF02G7LYW.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtgatcgtgggacagatttcactctcaccatcagtagtctacaacctgaagtattttgactaacttactactgtcaactagtagttacgatacccctccgtcctctactttccgggcggtacgggaccaagggtggaagtacgtaacgtaaaccgaacgttggtacgggccttcggactaccattccg

SEQ ID NO: 181846 - DNA, 525 bp, Homo sapiens
  misc_feature: GYAE6OF02GRRWS.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaaggtgggtccatcaaggttcagtggcagtggatcgtgggacagtatttcactctcacatcagttagtctacaactgaagtattttgactaacttactactgtacaacagtagttacgactacccctccgctctacgtttccggacggacgggaccaagggtcggaagtacgtacgaaacgtacgtggtacggactaggacctacctattccg

SEQ ID NO: 181847 - DNA, 592 bp, Homo sapiens
  misc_feature: GYAE6OF02GXQ0H.2.39.D06.1.454.CMB.1.raw
  modified_base (198)..(198): a, c, t, g, unknown or other
  misc_feature (198)..(198): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttaatttaaattggtatcagttcaaaccagggaaagcccctaagctcctgatctatgctgcatccagttacaaagtggtccatcaagttcagtgcagtgatcgtagggactagtattcactctccacatcagtagtactacaactgtaagtatttagactaacgttactactcgtacaaacgtagtacgttacgtaactaccccctcgtaccttaccgaaccgttttccgggacgggtaccgggggtaacccgtaaggggttacgggtaacgtaaaccggtaaccgtaaaaaccggtaacggttacgggttacgggtaccgttacggaacccgtacccgtacgtttacccg

SEQ ID NO: 181848 - DNA, 647 bp, Homo sapiens
  misc_feature: GYAE6OF02IVQ8L.2.39.D06.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (258)..(258): a, c, t, g, unknown or other
  misc_feature (258)..(258): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtcctgcatctgtggganacagagtcatcatctcttgccggnaagtcagagtgttagtatttatttaaattggtatnagttacaaacgaggaaacnccctaagctccgtanatctatgctgcatcctaagtttaacgaaacggttcgggtaccctatacgtaaggttcaacggttggacgaggttaggtaacgtccgttagggaactaaggttactttacaccttactacaacctagtactaggtaacgtactaacctaaaccgtagtaaacgttagttttacgaaccttaaacgtttactacgttacgtaactaaacgtacgtaacgttaacgtaaccttaaccccgtccgtacctacctaaccgtttcgggaaccggtacgggtaaccgtaagggttacggaacgtaacgtaaccgtaaacgtaaccgttcggtacggaccttacggacctaaccgacgttacg

SEQ ID NO: 181849 - DNA, 618 bp, Homo sapiens
  misc_feature: GYAE6OF02J0B80.2.39.D06.1.454.CMB.1.raw
  modified_base (101)..(101): a, c, t, g, unknown or other
  misc_feature (101)..(101): n is a, c, g, or t
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (527)..(527): a, c, t, g, unknown or other
  misc_feature (527)..(527): n is a, c, g, or t
  modified_base (550)..(550): a, c, t, g, unknown or other
  misc_feature (550)..(550): n is a, c, g, or t
  modified_base (604)..(604): a, c, t, g, unknown or other
  misc_feature (604)..(604): n is a, c, g, or t
tcagacgctcgacacacgaccggtgctcgatttagtgacatctcgcagttcttggggagccagtctcagtcaggacacagcatggacatgagggtccccgngtcagctcctggggctcctgactactcgtaggctccgagactgcccagatggtcgacacccaggtatggacccagtcctcanccgtcctgtctggcattcctgtcggagtacnaaggttcaatcatctcgttggccgggaagtcngatgtacgtattagttaactaggtatccgtagtcaacgtaggaacgtcccaagtctcctacgatcaagtcgtctgctacgtactagtttaccgaagtaggacccgtatacgtagttccgagtcgactagtcggatcgtggacgaatcgtttcgacttcactaacgactactacggttactaccgtaagtaaccctgaaacggttactttacgaacttaacccgttaactacgttacgttaaccgaacctagtaacgttaaccggaacttacccggttaccnccttaacgttaccgttacccggnggtaaccggacgtaaccgggtgtaacggataccggtaactaacgttagcggtanaggacctagctacg

SEQ ID NO: 181850 - DNA, 580 bp, Homo sapiens
  misc_feature: GYAE6OF02IKLRW.2.39.D06.1.454.CMB.1.raw
  modified_base (255)..(255): a, c, t, g, unknown or other
  misc_feature (255)..(255): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaatggtatnagttacaaacaggaaacnccctaagctctagatctatgctgcatcctagtttaacaaaggttggtccatacaaggttcagtgcagtggatcgtggactagatttcactctcacatcagtagtactaactacctagtaacgttattttacgactaaacttacttactacgtactaacaagtacttaacggtaacctaaccccgttccgtaccgttaacttaccgttacgggtaccgggaacgggtaaccgtaacgggtaacggtaggaactaacggtaaaaccgtacgttaggtacggtaccgtacggtacaaccgttattaccgg

SEQ ID NO: 181851 - DNA, 504 bp, Homo sapiens
  misc_feature: GYAE6OF02F4ANZ.2.39.D06.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
  modified_base (491)..(491): a, c, t, g, unknown or other
  misc_feature (491)..(491): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttattaaattggtatcagttacaaacgagggaacnccctaagctctgatctatgctgcatcctagttacaaggtggtccatcgtaaggttcagtggctagtggagtctggganagtacttcactactcactatacagtacgtctacaactgagtactttgactaactatactntacacagtactacgtactaccctcgactctacgttcggcgacggacgaggtggatactacgaacgactggtacggtntcgactacattcg

SEQ ID NO: 181852 - DNA, 593 bp, Homo sapiens
  misc_feature: GYAE6OF02IHDC8.2.39.D06.1.454.CMB.1.raw
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatccctcctgtctgcatctgtgggagacagagtcatcatctcttcgccgggcaagtcagagtgttagttatttatttaaattggtatcagttacaaacgaggaacaccctaagcctcctgactctatgctgcatcctaagtttaacgaacggtcgggtcccagtacgtaaggttcaggtcggcaggtgagtcgtaggacagtctttacactctacactactcgaagttacgtactaacacgtagtaagttattttcgacttaaccttactactcgttaacaacgtaagtacgttaacctaacctaccccgttacctcctaccttaccgttaccgggaccgggaacggtacgtaaggtcggaacgtaacgtaacgtaaacggtaacgttcggacggtccgtacggacctacctacgttccg

SEQ ID NO: 181853 - DNA, 556 bp, Homo sapiens
  misc_feature: GYAE6OF02JE0YZ.2.39.D06.1.454.CMB.1.raw
  modified_base (198)..(198): a, c, t, g, unknown or other
  misc_feature (198)..(198): n is a, c, g, or t
  modified_base (273)..(273): a, c, t, g, unknown or other
  misc_feature (273)..(273): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacaggaancccctaagctcctgatctatgctgcatcctagtttacaaagtgggtccagtcaaggttcagtggcagtggatcgtaggacagtatttcactctcactatcagtagtctaactaaccctgaaagttatttacgtactaacgttacttactagttacaaacgtacgtacgttaacgacttaacccctccgacttccgtaccgtttcgggacggtacgggaccgaaggttcgggactaacgtacaaaccggtaacgttcggtacggctaggccctacgtacttacg

SEQ ID NO: 181854 - DNA, 557 bp, Homo sapiens
  misc_feature: GYAE6OF02GOE3I.2.39.D06.1.454.CMB.1.raw
  modified_base (552)..(552): a, c, t, g, unknown or other
  misc_feature (552)..(552): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagtagtgttagtatttatttaaattggtatcagttacaaaccgaggaaagcccctaagctcctgatctatgctgacatcctagtttaaccaaaggtcggggtaccctagtacgaaggttcaggtcggacgtaggtaggatcgtagggactagtacttcgacttctaccacatcagttactctaacaacctgaagttatttcgactaacttactactcgtacaacagtacgtacgtaccttaccctcgtcctcgttacgttcgggacggtacgggacaacgggtggaacgtactaaccgaacggactcggtacggctacgcactnttacg

SEQ ID NO: 181855 - DNA, 678 bp, Homo sapiens
  misc_feature: GYAE6OF02JZN13.2.39.D06.1.454.CMB.1.raw
  modified_base (199)..(199): a, c, t, g, unknown or other
  misc_feature (199)..(199): n is a, c, g, or t
  modified_base (374)..(374): a, c, t, g, unknown or other
  misc_feature (374)..(374): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccgggcaagtcagagtgttagtatttatttaaattggtatctagttacaaaccgaggtaaacgccccgtaagctctagatactatggtctgctatccgtaagtttaacgaaaggttcggggtaccagttcgtaaacggtttcgaaggttacgggntacgggttaggagttacggttcgggaactagtactttacgacgttcctaccactactacgaaggttacgtaccgttaacaaccgttaggtaacgttaacttttcggacgtacggttaccttaactaccgttacgtactaaacgtacgtaacggttaaccgaccgtttaacccctccgtacttaccgttaccggtttccgggacgggtaacgggtaaccgaaacggggttacgtaacggtaacgttaaccgtaaaccggttaacggttacggacgggttaccgtaccgtacgtaccctaacccgg

SEQ ID NO: 181856 - DNA, 689 bp, Homo sapiens
  misc_feature: GYAE6OF02JRTM7.2.39.D06.1.454.CMB.1.raw
  modified_base (223)..(223): a, c, t, g, unknown or other
  misc_feature (223)..(223): n is a, c, g, or t
tcagacgctcgacacacgaccggtgctcgatttagtgacatctcgcagttctttggggagccagtctcagtcaggacacagcatggacatgagggtccccgctcagctcctggggctcctgctactctggctccgagatgccagatgtgacacccagatgacccagtctccatcctccctgtctgacatctggtgggacacagatcatcatctcttggccggntaaagtcagtagtgttagtatttatttaattggtatctagttacaaaccgtaggaaacgtccctaagtcttaccgtgtacttctaatcgcttagacacttaccgtaagttttaaccgaaacggttcggggttacccctaagttaccgtaaagggttccaaggttcggacgtaaggttacggtaattccggtagggtaacgtagttaacgttttacgaccttacctaccgtaaccgtaactaccgtaaggttaacgtaccttaacaaacccgttggtaaacgttacgttttacgacttaaccgtttaactaccttaggtacctaaacgtagttaaaccgttaccgtaaccttaccccgttctaacttccgtaacgtttccggacgggtacgtaccgtaagggtagtaacgtaacgtaaccgtaaacgtcgtacggtcggtacctacgggtacctaccgacgtttacg

SEQ ID NO: 181857 - DNA, 569 bp, Homo sapiens
  misc_feature: GYAE6OF02GMJUB.2.39.D06.1.454.CMB.1.raw
  modified_base (222)..(222): a, c, t, g, unknown or other
  misc_feature (222)..(222): n is a, c, g, or t
  modified_base (277)..(277): a, c, t, g, unknown or other
  misc_feature (277)..(277): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccggnaagtcagagtgttagtatttatttaaattggtatcagttacaaaccgagggaacnccctaagctcctgtatctatgctgctatcctagttacaaaggtcgggtacccatcgtaaggttcaggtgcaggtgagtcgtagggactagtatttcactctacactatcgtagttacgtactaacaaccgtagtaagttactttcgactaacttactactagtactaacagtacgttaaccgaccttaccccgtcgtcctactacgtttccgggaccgggtacggaaccgtaagggtcggaagtactaacgtaaacggtacgtggtacggcgtacgacctaccgtattaccg

SEQ ID NO: 181858 - DNA, 581 bp, Homo sapiens
  misc_feature: GYAE6OF02FTUET.2.39.D06.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttggccggcaagtcagngtgttagtatttattaattgtatcagttacaaccgagggaacnccctaagctcctgatctatgctgctatctagtttaacaaggtcgggtacctagtactaaggtcaggtggactaggtgagtcgtagggacagtacttcactctacaccatcgagttactctaacaacctagtaagttatttagactaactttacttctagtacctaagaacgtacgttaaccgtaccttacccccgtccgtacctccgtacgtttaccggggacggtaaccggggtaccaagggggttgaacgtaactaaccgtaaacgtaacgttggtacgggtcctacggaccctaacctgtccg

SEQ ID NO: 181859 - DNA, 616 bp, Homo sapiens
  misc_feature: GYAE6OF02IYEUL.2.39.D06.1.454.CMB.1.raw
  modified_base (198)..(198): a, c, t, g, unknown or other
  misc_feature (198)..(198): n is a, c, g, or t
  modified_base (231)..(231): a, c, t, g, unknown or other
  misc_feature (231)..(231): n is a, c, g, or t
  modified_base (398)..(398): a, c, t, g, unknown or other
  misc_feature (398)..(398): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagngtgttagttatttatttaaattggtatctagttacaaaccgagggaaacgcccctaagcttcctagactctatgctgcattcctaagtttaacaaagtcggggtaccctatacgaaggttcagtggtacgagtaggatcgtgggacagtatttcgacttcacacctntcagtacgtactaacaaccgtagtaattattttcgaaccttaactttaacctactgtaacctaaactaggttaacgttaaccgtaccttacccccgttaccgtccttaccgtaccggtttccgggaccgggtagaacccggtaagggtacgggaagtaaccgtaaccgaaaccggtaagttcggtacggtaccttacggaccctaccgtacttaccgg

SEQ ID NO: 181860 - DNA, 538 bp, Homo sapiens
  misc_feature: GYAE6OF02IYGEX.2.39.D06.1.454.CMB.1.raw
  modified_base (278)..(278): a, c, t, g, unknown or other
  misc_feature (278)..(278): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaaccagggaaacncccctaagctcctgatctatgctgctatccagttaacaagtcgggtaccatcgaagttcagtgcagtgatcgtggacagtattcgacttctacacctatcagtatactaacaacctgaagttatttgactaacttactactgtacaatagtacgttacgacttacccctccgtactccgtaacgttccgggacggtacgggacctaagggtcggaagactaacgaaacgtacgtaggtcgcgtagacctacctattaccg

SEQ ID NO: 181861 - DNA, 634 bp, Homo sapiens
  misc_feature: GYAE6OF02HFS77.2.39.D06.1.454.CMB.1.raw
  modified_base (202)..(202): a, c, t, g, unknown or other
  misc_feature (202)..(202): n is a, c, g, or t
  modified_base (226)..(226): a, c, t, g, unknown or other
  misc_feature (226)..(226): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccatccctccctgtctgcatctggtggganacagagtcatcatctctggccggnaagtcagtagtgttagtatttaatttaaattggtatcagttacaaacgaggaacgccctaagcctctgtactctatcgctcgactactacctaagtttaacgaaggtccggggtacctagtacgtaaggttcaggtggcgtaggtaggtatcggtagggactagtactttaccactctacctaactacgtactagttactacctaacgtaaccgtagtaacgttattttagaaccttaacttactacttacgtactaacgtacgtacgtaaccgtacctacccgtaccgtccttaccgtaccgttacgggaccgggtaccgggtaccggtaacggtcgggtaacgtaacgtaaccgtaaaccggtacgttacggtacgggtaccttacggaccttacccgtgttaccg

SEQ ID NO: 181862 - DNA, 496 bp, Homo sapiens
  misc_feature: GYAE6OF02GQSWR.2.39.D06.1.454.CMB.1.raw
  modified_base (223)..(223): a, c, t, g, unknown or other
  misc_feature (223)..(223): n is a, c, g, or t
  modified_base (369)..(369): a, c, t, g, unknown or other
  misc_feature (369)..(369): n is a, c, g, or t
  modified_base (453)..(453): a, c, t, g, unknown or other
  misc_feature (453)..(453): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggnaagtcagagtgttagtatttatttaaattggtatcagttcaaaccagggaaagcccctaagctcctgatctatgctgcatccagttacaagtcgggtccatcaaggttcagtgcagtgatcgtgggacagtatttcactctcaccntacagtagtctacacctgaagtatttgactaattactactgtacaactagtacttacgacttacccctcgctcgtacttcgggngacggacagggtgagatacaacgtatgtggctgctacgatccg

SEQ ID NO: 181863 - DNA, 638 bp, Homo sapiens
  misc_feature: GYAE6OF02JQ1RX.2.39.D06.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
  modified_base (271)..(271): a, c, t, g, unknown or other
  misc_feature (271)..(271): n is a, c, g, or t
  modified_base (286)..(286): a, c, t, g, unknown or other
  misc_feature (286)..(286): n is a, c, g, or t
  modified_base (314)..(314): a, c, t, g, unknown or other
  misc_feature (314)..(314): n is a, c, g, or t
tcagacgctcgacacacgaccggtgctcgatttagtgacatctcgcagttctttggggagccagtctcagtcaggacacagcatggacatgaggtccccgctcagcctccgtggggcctcctgactacctcgtcggctccgagacgtgcccagactgtgaccacccagacgtgaaccagtcctccactccttcctgtctgcatctgtggacgacagtgtcatcatcctntgccgganaagtcagtagtgttagtattattaatggtatcgnttacaacgaggtaanacccctaagctacctagactcgtatcgntacggctactctaagtttaacgaaggtccggtacccagtactagtctaggtcgactacggagtcacggtgggaaaccttgtacgtttacactacgtcaagtaacgtcctaagttactcgtaacaccgttaagaacgttattttcgaaccttaacgttctaacgtctaacgtaaactggtaaccttaacgtacccgtacccttacgtacctacgtttaacgtaccgggtacggacccggtaagtaaccggggtcgaaattaccgtaacggaaacccggtttaacgttgggtaaccgtctacggtaaccgtaccttaaccgttacg

SEQ ID NO: 181864 - DNA, 562 bp, Homo sapiens
  misc_feature: GYAE6OF02F90XF.2.39.D06.1.454.CMB.1.raw
  modified_base (198)..(198): a, c, t, g, unknown or other
  misc_feature (198)..(198): n is a, c, g, or t
  modified_base (280)..(280): a, c, t, g, unknown or other
  misc_feature (280)..(280): n is a, c, g, or t
  modified_base (340)..(340): a, c, t, g, unknown or other
  misc_feature (340)..(340): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagtagtgttagtatttatttaaattggtatctagttacaaaccagggaaacncccctaagctcctgatctatgctgcatccagtttacaaagtcgggtaccatacaaggttnagtgacgagtggatcgtagggacagtattcactctacacatcacgtagtcctaacaacctgtaaagttatttagaccttaaaccttactactgtaccaaacgtagtaacgttacgtaccttaccccgtccgtactccgtaacgttccgggaacggtacgggtaccgaacgggtggaactacgtaccaaacggtattaggtcggtactcgactaccgattccg

SEQ ID NO: 181865 - DNA, 550 bp, Homo sapiens
  misc_feature: GYAE6OF02G4J65.2.39.D06.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (527)..(527): a, c, t, g, unknown or other
  misc_feature (527)..(527): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttcaaacagggaaacnccctaagctcctgatctatgctgcatcctaagttacaagtgggtaccatcgtaagttcagtgctaggtgtatcgnggacngtactttcatcctcaacctatacagttacgtctaaccaacctgaaagttattttacgacttaaaccttactacgttacgtactaacgagtacgttacgaccttacccctcgtcctctaaccgtttcgggacggtacggacctaagggtcggaagactaaccgaacgtacgnggtacgcgtacgactacattccg

SEQ ID NO: 181866 - DNA, 618 bp, Homo sapiens
  misc_feature: GYAE6OF02HIDJJ.2.39.D06.1.454.CMB.1.raw
  modified_base (198)..(198): a, c, t, g, unknown or other
  misc_feature (198)..(198): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcgttcgccggacaagtcagtagtgttagttaattttatttaaattggtatactagttacaaaccgagggaaacgacccctaagcctcctagtactactatacgctgctactcctaagtttaacgaaaggtcgggtacccatacgtaaggttcaggtgacgtaggtggtaatcgtacgggactagtactttaccacttctaccacctatacaagttacgtactaaccgtaaccttagaacgtttattttacgacctaaattacctacttgtaacctacgaagttactaacgccttaaccctcgtacttcgttaaccgttcggtaccggaacggtaccgtaacgggtggacgtaacgtaacgaaacgtactacgggtacgacgttacgaccgtaaccgtagttaccg

SEQ ID NO: 181867 - DNA, 578 bp, Homo sapiens
  misc_feature: GYAE6OF02FV1G2.2.39.D06.1.454.CMB.1.raw
  modified_base (223)..(223): a, c, t, g, unknown or other
  misc_feature (223)..(223): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (411)..(411): a, c, t, g, unknown or other
  misc_feature (411)..(411): n is a, c, g, or t
  modified_base (426)..(426): a, c, t, g, unknown or other
  misc_feature (426)..(426): n is a, c, g, or t
  modified_base (455)..(455): a, c, t, g, unknown or other
  misc_feature (455)..(455): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctcctgtctgcatctggtgggagacagagtcatcatctcttgccggnaagtcagngtgttagtatttattaaattggtatctagttacaaaccagggaaacgcccctaagctccgtgatctagtnctgctatcctagtttacaaggtcgggtccatcagttcagtgcgtagtgatcgtagggactagtattcactcgtcactatctagttactctaaccaactgaagttatttanacttacttactactntacaaagagtacgtaaccacttaaccccnccgtcttacctaccgttcgggaccggtacgggtaaccgtaagggtcgggtaacgtaacgtaaccgtaaaaccgggtaacgtagggttaccggtaacgtaccggaccctaaccgtagttcccgg

SEQ ID NO: 181868 - DNA, 683 bp, Homo sapiens
  misc_feature: GYAE6OF02J2VJ7.2.39.D06.1.454.CMB.1.raw
  modified_base (201)..(201): a, c, t, g, unknown or other
  misc_feature (201)..(201): n is a, c, g, or t
  modified_base (242)..(242): a, c, t, g, unknown or other
  misc_feature (242)..(242): n is a, c, g, or t
tcagacgctcgacacacgaccggtgctcgatttagtgacatctcgcagttctttgggggagccagtctcagtcaggacacagcatggacatgacgggtccccgctcagctcctggggctcctgctactctggctccgagatgccagatgtgaccacccagatcgaccccagtcctccatccctccctgtctgcatcgtggngggacgacaggtatcatccgatcttcgtcggacccgggtanaacgtcgagtaggttgtttaagttaattttaagttttaaagttcgggttacttacgaacgtttaaccgaaaaaccggaagggtaaaacccgtccccttaaacgtcctaccgtagacttaccgtatcggtactgacttacgtcttaaaggttaacgacgggttcgaccctagtcgtaaggtcaaggtcgtactaggtgacttcgggtagactatcttccactacacctactactacgtattacgtacctaactaactagaattactttacacgttaacctacgtacctacgtaacacgtaacgtacgttaaccacccgttaaccctccgttacctccgttaacgggttccggaaccgggtacggaaccggtaacggtacggtaaccgtacgtaaaccgtacgtacggtaggtaccggaccttagacccgtactcgttaacgg

SEQ ID NO: 181869 - DNA, 661 bp, Homo sapiens
  misc_feature: GYAE6OF02JY3EU.2.39.D06.1.454.CMB.1.raw
  modified_base (201)..(201): a, c, t, g, unknown or other
  misc_feature (201)..(201): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatccctccctgtctgcatctggtggganacagacgtcatcattcctcgttcggccggggactaacggtcaggtagttagtttaagttattttaagttaagttgtatactagttacaaacgaggaacaccctaagctcgtgatactagtgctgactatacctaagttaacgaacggtccggtacctagtacgtagttcgagtacggcgtaaggtgtagtcgtagggtacacgtttattcgtaccgttctaccctactactacgtagttaaccgttacgtaaacgtaacctaggtaagtttacgtttacgaacttaaacttacgttactaagtactaaaacgtcgttaaacgttaccgtaacccgttacccttaccgtccttaacgttcggttaccggacgggtacggttaccgaagggtcggtaaacctcggtaaacccgtaacggtaacggttcggacggtaccgtacgaacccgtataggttacccg

SEQ ID NO: 181870 - DNA, 502 bp, Homo sapiens
  misc_feature: GYAE6OF02I2Q1Z.2.39.D06.1.454.CMB.1.raw
  modified_base (198)..(198): a, c, t, g, unknown or other
  misc_feature (198)..(198): n is a, c, g, or t
  modified_base (276)..(276): a, c, t, g, unknown or other
  misc_feature (276)..(276): n is a, c, g, or t
  modified_base (427)..(427): a, c, t, g, unknown or other
  misc_feature (427)..(427): n is a, c, g, or t
  modified_base (476)..(476): a, c, t, g, unknown or other
  misc_feature (476)..(476): n is a, c, g, or t
  modified_base (492)..(493): a, c, t, g, unknown or other
  misc_feature (492)..(493): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggcaagtcagagtgttagtatttatttaaattggtatcagttacaacgagggaaanccctaagctactgatctatgctgcatctagttacaaggtcgggtccatcgtaagttcaggtggacaggtaggatcgtagggactagtatttcgactctacacatcagtatactaacaacctgaattatttcgactaacttactactgacanagtagtacgactacccgtcctctctacgttcgacggacgacgaggcganagtacaacgatgtcgnngacacatcg

SEQ ID NO: 181871 - DNA, 795 bp, Homo sapiens
  misc_feature: GYAE6OF02G33KN.2.39.D06.1.454.CMB.1.raw
tcagacgctcgacacacgaccggtgctcgatttagtgacatctcgcggagttctttgggggagccagtctcgagtcaggacacaggcatggacgactgaggtcccgctcaggctcctgggctcctgcgtactctggctccgagatgccagatcgtgacacccacgatcgacccagtcctccattccctcctgttctgcagtctaggtaggacgactagacgtctacttcgacgttccgtacgttcggaccgggactaacgttacgtaaggtaacgtttagtttttaaacgttaagtttttaagttttaaacgtttaggttaacttaaccgtaaagggtttaaccgaaaacccccggtaaggggtaaaacccgtccccccgtttaaaggtacctttaccgttacggttaacgtttccttaagtttcggtacctttcggaccttaacgttaccggttaacggttttaacccgaaaagggtttcccgggggttaaccctaagttaccgtaagggtttccgaagggttcggtacgtacgggtaggtacgttacggttacgggtaacctacgttacctttacaccttacctaccacgtagtactaacgtacgtacctaacgtacctagttacgttatttacgactttaacttacgtacttacgtaacgtaacgtacgttaccgtaacgtccttacccgttaccgttccgtaccgttacgtaccggtacggtacggacggtaggtacggaacgttaacgaacgtaacgtacgtggaccgttcgactacgtaccgtattccg

SEQ ID NO: 181872 - DNA, 705 bp, Homo sapiens
  misc_feature: GYAE6OF02IEBUY.2.39.D06.1.454.CMB.1.raw
  modified_base (279)..(279): a, c, t, g, unknown or other
  misc_feature (279)..(279): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgaccaccagatgacccagtctccatcctccctgtctgcatctgtgggagacagagtcatcatctcttgccggcaagtcagagtgttaagttatttatttaaagttgtatctagttacaacgaagggaanacccctaagctactagatctatgtctgcactacctaagtttaacgaaaggtcgggtacctagtactaaggttcgtagtcggacgtaggtaggtacttcggtagggactagttactttccgattccgtaccaaccgtactacgtaagttactaccgtaacctaaccgttaggtaaacgtttaactttttacgaaccttaaacctttaacgttaacgtaacgttaaccgtaaaactaacgggttaccgttaaacccgtaacccgttaccccccgtacgttaccttaccggttaacccgtttaccgggggaccgggtaaaccggggttaccggtaaacggggtacggtaacgtaaaccggtaaaccgtaaaaccggtacggttacggacgggttacccgttaccgaaccgtaacccctgtttaccccgg

SEQ ID NO: 181873 - DNA, 539 bp, Homo sapiens
  misc_feature: GYAE6OF02F5N43.2.39.D06.1.454.CMB.1.raw
  modified_base (222)..(222): a, c, t, g, unknown or other
  misc_feature (222)..(222): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctcctgtctgcatctggtgggagacagagtcatcatctctgccgggnaagtcagagtgttagtatttatttaaattggtatcagttacaaaccgagggtaaacgacccctaaggctcctgatctatgctgcatcctaagtttacaaagtcggggtccagtcaaggttcagtgcagtgatcgtagggactagtatttcacttctacacatcagtacgtactaacgaactagtaagtattttacgactaacttactactgtacaacagtattacgactacccctcgcctacgtacgttcggacggacggacctaagggtggaagtactaaccgaaacgtagtggtcggacctgacctacgcttacg

SEQ ID NO: 181874 - DNA, 565 bp, Homo sapiens
  misc_feature: GYAE6OF02I648U.2.39.D06.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctgccggnaagtcagagtgttagtatttatttaaattggtatcagttcaaacaggaaagccctaagctctgatctatgctgcatcagtttacaaagtggggtcccatcaaggttcagtgcagtgatcgtggacagatttcactctcacatcagttagtctacactgaagtatttgactaacttactacttagtactaaacgtacgtacgttaacgtaccgttacccctccgtccttacccgtaaccgtttccgggaccgggtacgggtacccgtaaaggggttcgggtaacgtacgtaaccgaaaacggtaaccgttcggtacggtccgtacggacctaccgtacgttaccg

SEQ ID NO: 181875 - DNA, 585 bp, Homo sapiens
  misc_feature: GYAE6OF02JS4XE.2.39.D06.1.454.CMB.1.raw
  modified_base (199)..(199): a, c, t, g, unknown or other
  misc_feature (199)..(199): n is a, c, g, or t
  modified_base (496)..(496): a, c, t, g, unknown or other
  misc_feature (496)..(496): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatccctccctgtctgcatctgtggganacagagtcatcatctctgccggcagtcagtagtgtatatttattaattgtatctagttacaacgtaaggaactaccctaagccttacgtactagtactatcgtactgacattacctagtttaacaaggttcgggacctatacgtaagtcagtacggactagtaggtactcgtaagggactaggtactttcacgtcctactaaccgatacgagttaacgtactaccaaccttaaggtacgttaacgttttacgaactaacgtttactctagtacataagtacgtacgtacctaccctntaccgtataccgttcgacgggtacgacgtacgggtagacgaacgttacgtaaacgtcgtaggtacgtcggacgtaccacgtattaccgg

SEQ ID NO: 181876 - DNA, 582 bp, Homo sapiens
  misc_feature: GYAE6OF02ILCLF.2.39.D06.1.454.CMB.1.raw
  modified_base (196)..(196): a, c, t, g, unknown or other
  misc_feature (196)..(196): n is a, c, g, or t
tcagacgctcgacacacgaccggtgctcgatttagtgacatctcgcagttctttggggagccagtctcagtcaggacacagcatggacatgagggtccccgctcagctcctggggctcctgctactctggctccgagatgccagatgtgacacccagatgacccagtctccatcctccctgtctgcatctgtgganacagagtcatcatctcttgccggacagtcagtagtgttagtatttaatttaaagttggtatctagttacaaaccgagggaaacgaccccgtaagcctccgtagactactatcgcgtgacactaccgtaagttaacgtaagtcggggtcctaagtcgtaaggttcaggtaggctaaggtgtacgtacgtggacgtagtacgtttcactctacactatacgtagtacgtctaactaacgtagtaagttatttacgactaaactttactactcgtacaacgtagtacgttacgactacccgtcgcttacgtaccgtttacgggacgtacgggaccgtagggtacgtagacgtacgaacgtacgtagtcggtactcgacctacgtattcg

SEQ ID NO: 181877 - DNA, 544 bp, Homo sapiens
  misc_feature: GYAE6OF02HJY3O.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccaggaaagcccctaagctcctgatctatgctgcatccagtttacaaagtgggtccatcaaggttcagtggcagtggatcgtgggacagtatttcgactctcacctatcagtatctacaactagaagtatttgactaacttactactagtacaactagtaagttacgacttacccctaccgtcctacctaccgtttccgggacggtacgggaacctaagggtcggaagtacgtaaccaaaacggtaacgtggtacggactacggaccacgtattaccg

SEQ ID NO: 181878 - DNA, 638 bp, Homo sapiens
  misc_feature: GYAE6OF02HP5KP.2.39.D06.1.454.CMB.1.raw
tcagacgctcgacacacgaccggtgctcgatttagtgacatctcgcagttctttgggggagccagtctcagtcaggacacagcatggacatgagggtcccccgctcagctcctggggctcctgctactctggctccgagatgccagatgtgacacccagatcgacccagtctccatccctcctgtctgcatctggtgggagacagagtcatcatctcgttcggccggcaagtcagtagttgttaagttattttaatttaaagttggtatcgtaagttaccgaaacgtaagggaaccgtacccctaagtccttaccgtagtactctatgtctagactactacctaagtttaacgaaacggtccgggtacctacgtacgtaacggttcgaggtcgacgtaggtacggtagtcgtaggactagtacttctacgtcctacacctatacgtagtactacctaacgtaacgttagtaaagttcgtttactaaccttaacttaactacgttacgtaacgaaaccgtaagttacgtaacccgtaccttaaccccgtctaccctacttacccggttcgggaaccggacggtaacgaggtaggaatacgtaaccgaaacgtagtcggcggactcgacacctagttccg

SEQ ID NO: 181879 - DNA, 674 bp, Homo sapiens
  misc_feature: GYAE6OF02IXHW6.2.39.D06.1.454.CMB.1.raw
  modified_base (201)..(201): a, c, t, g, unknown or other
  misc_feature (201)..(201): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtcctccatcctccctgtctgcatctgtggganacagagtcatcatctcttggccgggcaagtcagtgtgttagttattttaattaattggtatctagttaccgaaaaccgagggtaaaccgaccccgtaagtccttacctagtaacttctaatcgactgacctattaccgtaagtttaacgaaagggtcggtaccatacgtaacggttcgaggtcggacgtaggtggtaacgttcggtaggggtaactaggttactttaccgtaacttcctaccgtaccctagtcgtaacggtactcgtacgtactaaacgtgggtaacgtttacgtttacgaccttaaccttttacgttcgtacttaaccgaataacgacgtacctaaccgaaccccgttaccccggactaacccgttacgtttacccggacccggtaacggggaacccggtaagggttaccggtactaacgtaacgtaaacgtacgttacggcggtaactcggacctactacg

SEQ ID NO: 181880 - DNA, 568 bp, Homo sapiens
  misc_feature: GYAE6OF02HACWX.2.39.D06.1.454.CMB.1.raw
  modified_base (350)..(350): a, c, t, g, unknown or other
  misc_feature (350)..(350): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgctgggcaagtcagagtgttagtatttatttaaattggtatctagttacaaacagggaacgccctaagctacctgtatctatgctgcattccaagtttacaaaggttcgggtacccagtcaaggttcagtgganagtgatcgtgggatagtattcactcctcacctatcaagtagtctaacaacctagtaagtattttcgactaacttactactcgtacaactagtacgttacgaacttacccctccgtacttaccgtacgtttccgggacggtacgggtaaccgtaagggtacggaagtaacgtaaccgtaaaacgtacgtacggttacggaccgtcggaccaaccgtacg

SEQ ID NO: 181881 - DNA, 532 bp, Homo sapiens
  misc_feature: GYAE6OF02F8APL.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattggtatcagttacaaaccgagggaaacgcccctaagctcctgatctatgctgcatcctattacaagtcgggtccatacaagttcagtgcagtgatcgtggacagtattcacttcgtacacatcagtagtactaacaacctagaagttatttcgactaacttactactgtacaacacgtagtactactaccccgtcacctacctacgttccggacggtacgggaccgtaagggtcggaggaactacgaaacgtaacgttgtcggacctagaccactactaccg

SEQ ID NO: 181882 - DNA, 571 bp, Homo sapiens
  misc_feature: GYAE6OF02JCV8K.2.39.D06.1.454.CMB.1.raw
  modified_base (236)..(236): a, c, t, g, unknown or other
  misc_feature (236)..(236): n is a, c, g, or t
  modified_base (282)..(282): a, c, t, g, unknown or other
  misc_feature (282)..(282): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatcctccctgtctgcatctggtgggagacagagtcatcatcttcttcggccgggcaagtcagngttgttagtatttattaaattggtatcagttacaaacgagggaacnccctaagctcctagatctatgctgcatccgtaagtttacaaggtcggtccatacgtaacgttcagtggctaggtgactcgtggactagtatttcactctacactatctagttactactaactaaccgtagtaagttactttgaccttaacttactaccgtatacgaagtacgtaagttaccgtacctaccccgtccgtacttacgtaccgtttccgggacggtacgggtaacccgagggtacgagttaacgaccgtaaacgacgttggacggtctaggaccacctctcg

SEQ ID NO: 181883 - DNA, 521 bp, Homo sapiens
  misc_feature: GYAE6OF02GDMXZ.2.39.D06.1.454.CMB.1.raw
  modified_base (225)..(225): a, c, t, g, unknown or other
  misc_feature (225)..(225): n is a, c, g, or t
  modified_base (278)..(278): a, c, t, g, unknown or other
  misc_feature (278)..(278): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtcctccatcctccctgtctgcatctgtgggagacagagtcatcatctcttggccgggnaagtcagagtgttagtatttaattaattggtatcagttacaaacgagggaacnccctaagctcctgatctatgctgcatccagtttacgaaaggtcgggtacccagtcaaggttcaggtcgcaggtgagtcgtgggacagtattcactctacaccatcagtactactaccactagtaagttatttagactaacttactactgacatagtattaacgactaccctcgctactacgttcggaggcggacaggtggacgagtaccgaaacgtactaggtcgtctacgacctactagtcg

SEQ ID NO: 181884 - DNA, 715 bp, Homo sapiens
  misc_feature: GYAE6OF02JV1LJ.2.39.D06.1.454.CMB.1.raw
tcagacgctcgacacacgaccggtgctcgatttagtgacatctcgcagttctttgggggagccagtctcagtcaggacacagcatggacatgaggtccccgctcagctcctggggctcctgctactctggctccgagatgccaggtgtgaccacccagactgacccagtctaccactcctcctgtcctgcctatctgtagggacacagagtcatcatcctcttagccgggacaaggtccagacgtgttagtaatttaagtttaatttaggttactacgtacgtacgtaaaaccgagggtaaacgaccccgtaaagtccgttacctaggaacttacgtaacttcgaccgtgtacctaatccgttaaacgtttaacgaaagggttccgggtaccctaacttacggtaaaaggtttccgaagtacgggacgtaggtaggtacgtacgtagggaactacggtatttaaccggtactactaccctactacgttaacctaggtaccttaccgtaaacgtaccgtagttaaacgttaggtttactaacgtaaaccgtttactaacgttcgtactaaaccaggttaccgttaacaccgtttaccctccgtaaccttacgttaaccgttcgggacggtaaccgggtacctaaagggtaccgaggtaacccgtaacgtaaacgtaccgtaggttcgtacgtccgacaacccgtttgacccttagg

SEQ ID NO: 181885 - DNA, 618 bp, Homo sapiens
  misc_feature: GYAE6OF02FX2U3.2.39.D06.1.454.CMB.1.raw
  modified_base (202)..(202): a, c, t, g, unknown or other
  misc_feature (202)..(202): n is a, c, g, or t
  modified_base (227)..(227): a, c, t, g, unknown or other
  misc_feature (227)..(227): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgaccacccagatcgacccagtctccatcctccctgtctgctatctgtggganacagagtcatcatctcttgccgggnaagtcagagtgttagtatttattaattggtatcagttacaaacgagggaacacccctaagctcctagatcgatcgctgctatcctaagttaacaaggttcgggtacccaatctaaggttcgaagtggcgtaggtcggtatcggtagggaactaggtactttaccgacttcgactaccaagttccgtaaggtaacttaccgtaacctaaccctaggtaacgttagttttaccggtacttaaacctttcgttaactgtaacacgtaagtacgttacgtaactacccgtcgtacttcgtacgtttacgggacgggtacggtaccgaagggtgaacgtaacgtaaccgaaacggttacgtacgttaggtaccgtacgacccgtacgacctttacg

SEQ ID NO: 181886 - DNA, 621 bp, Homo sapiens
  misc_feature: GYAE6OF02FXEQZ.2.39.D06.1.454.CMB.1.raw
  modified_base (366)..(366): a, c, t, g, unknown or other
  misc_feature (366)..(366): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagatcatcatctcgttggccgggcaagtcaggtagtgttagttaattttaatttaaagttggtatctagttacaaaccgagggaaactcccctaagtcctctagtatctatgctgcatcctagtttaacgaaggtcggtccatacgaggttcagtcggatggtagntcggtaggactagtactttcgacttcgtaccactacgtctaacgttacgttactaaccgtaacgtagtaacgttactttacgtacttaaaccgttaactacgtaccgtaactaaacgtacggtaccgttaaccgtaacctaccccgttccgtactccggttaccgttaccgggacgggtacggaccgtaagggtcggaaccgtagtaaacccgtaaacgtacgtacgggtacgccgtacgacccgtacgcttccg

SEQ ID NO: 181887 - DNA, 603 bp, Homo sapiens
  misc_feature: GYAE6OF02IFP0Y.2.39.D06.1.454.CMB.1.raw
  modified_base (199)..(199): a, c, t, g, unknown or other
  misc_feature (199)..(199): n is a, c, g, or t
  modified_base (269)..(269): a, c, t, g, unknown or other
  misc_feature (269)..(269): n is a, c, g, or t
  modified_base (290)..(290): a, c, t, g, unknown or other
  misc_feature (290)..(290): n is a, c, g, or t
  modified_base (405)..(405): a, c, t, g, unknown or other
  misc_feature (405)..(405): n is a, c, g, or t
  modified_base (433)..(433): a, c, t, g, unknown or other
  misc_feature (433)..(433): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctggtggganacagagtcaatcaatctcttggccgggacaagtcaggagttgttaagttattttaattaaagttggtatntagttacaaacgagggaaacnccctaagctctagatctatgctgacataccgtaagttaacgaagtcgggaccctagtacgtaggttcagtcggacacggtggatcggtaggactagtcttcactcgtacactatntagtacgtactacactagtaattatttnacttaacttaactctaacgtacaacgtaacgtacgtaacgtaccttaccctaccgtacttacgtaccgtttacgggacgggtaacgggtaaccggtaagggtacggaacgtaacggtaaccgtaaaacgtacggttacggtaacgcgttaacgtacgaccgttattaccg

SEQ ID NO: 181888 - DNA, 540 bp, Homo sapiens
  misc_feature: GYAE6OF02G5HTO.2.39.D06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
  modified_base (341)..(341): a, c, t, g, unknown or other
  misc_feature (341)..(341): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttatttaaatggtatcagttcaaacaggaaacnccctaagctctgatctatgctgcatcctagttacaaggtcggtccatcaagtcagtgcagtgatcgnggacagtattcactctcacatcagtagtactaacaacctagaagttatttagacctaaactttactactgtacaacgtagtaacgttaccgtaactaccccctcgccttacgtacgtttccgggacggtacgggaccgtaagggtcggaacggactaaccgaaacggtacgttggtacggctacggacctacctatccg

SEQ ID NO: 181889 - DNA, 621 bp, Homo sapiens
  misc_feature: GYAE6OF02GMZEB.2.39.D06.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagacgctcgacacacgaccggtgctcgatttagtgacatctcgcagttctttggggagccagtctcagtcaggacacagcatggacatgagggtccccgctcagctcctggggctcctgctactctggctccgagatgccagatgtgaccacccagatcgacccagtctccatcctcctgtctgcatctgtggagacngacgtcatcatctcttggccggganaagtcagagtagttagtatttattaaatttggtatcgtagttacaaacgtaggtaaacgaccctaagactcctagtactctagtgtctagctactccgtagttaactaaacggtcgggtaccctatacgtaagtcaagtggtactagtgtactcgtaggactagtacttcctacgtactctaactactacgagttactacgtaactaaccgtaagtaagttatttacgacttaacctaactatacggtactaacgacgtacgttacaccgttacccctacgaccttacgttaccgttacgggaccggtagaacccgtaagggtcggtaaacgacgttaaaccgaaaccggttaacgtcgggttacgtaccgtacgtaacccgtaccgtacttacgg

SEQ ID NO: 181890 - DNA, 676 bp, Homo sapiens
  misc_feature: GYAE6OF02F8U25.2.39.D06.1.454.CMB.1.raw
  modified_base (203)..(203): a, c, t, g, unknown or other
  misc_feature (203)..(203): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccggatgtgacacccagatgacccagtctccatcctccctgtctgcatctgtgggagacagngtcatcatctctgccggacaagtcagtagtgttagtatttattaatgtatcattacaactaggaacgaccctagctctgatctatgctgctatacctagtttaacaaaggttcgggtacctacgtacgtaaaggttcaaggttcggacgtaaggtcgggaacttcggtaggggtaacgtaggtacttttaccacgtttacctacctaaccctaagttcccgtaaggttaaccgtaccttaaaccgtaaaccgtagtaaacggtttattttaacgacctttaaaaccttaccttaaccgtacttaacgtaaaccgtagtaacgttaacccgtaacctacccccgttacgcccttacgttaccgtttaccgggaccgggttaacgggacctaaggggttacggaaacgtaacgttaacgaaaaccggtacgttagggtacgtcggtacgaaccgtacccgtaagtttccgtaacg

SEQ ID NO: 181891 - DNA, 621 bp, Homo sapiens
  misc_feature: GYAE6OF02HJGNS.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatcctccctgtctgcatctgtgggagacagagtcatcatctcttgccgggacagtcagtagtgttagttatttagtttaaatggtatcagttacaaaccgaggaacgtcccctaagctcctagatctatgctgctatcctagtttaacgaaggtcggtacccagtacgtaaggttcaggtcgcgagtggtagtcgtgggaactagtactttcaccttactcacctatctaagttacgtacctaaccaaacgtgtaattacgtttcgaccttaacttacgttactacgttaccacttacgtaagtttaccctaaccgttacccccgtccgtccttaccgtacccggtttaccgggaccgggtacgggtaccgtaaggggtacgggactaacgtaacccgaaacggtaaccgttgggtacggtaccgttacggaccctacgtacttccgg

SEQ ID NO: 181892 - DNA, 605 bp, Homo sapiens
  misc_feature: GYAE6OF02FR5IQ.2.39.D06.1.454.CMB.1.raw
  modified_base (226)..(226): a, c, t, g, unknown or other
  misc_feature (226)..(226): n is a, c, g, or t
tcagacgctcgacacacgaccggtgctcgatttagtgacatctcgcagttctttgggggagccagtctcagtcagggacacagcatggacatgagggtccccgctcagctcctggggctcctgctactctggctccgagatgccagatgtgacacccagatgacccagtctccatcctccctgtctgcatctggtgggagacagagtcatcatctcttcgccgggnaagtcagagtgttagtatttattaaattggtatcagttacaaaccgaggaacgacccctaagctcctgatctatgctgcatcctagttaacaaaggttcggggtaccatacgtaaggttcgaggtggcagtggtatcgtagggacagtacttcactctcaccatctaagtacgtactaacctaactaggtaagttattttacgtacctaaacctttactaacgttacgtaactaaacgtaagtacggtttaaccgtaaccttacccccgttaccgtaccttaccgttaaccggtttccgggacgggtacgggaccgtagggtagggaactacgtaacgtaaaccgtaggtacgtgggaccttagaccgtactagttccg

SEQ ID NO: 181893 - DNA, 606 bp, Homo sapiens
  misc_feature: GYAE6OF02FSHL6.2.39.D06.1.454.CMB.1.raw
  modified_base (276)..(276): a, c, t, g, unknown or other
  misc_feature (276)..(276): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttattaaattgtatcagttacaaaccgagggaacncccctaagcctcctagacttctatcgctgctatcctaagtttacaaggtcggtccatctaagttcaggtgactagtggtatcgtagggactagtacttcactctccacatcgtagtacgtactaacaactagtaagttactttacgacttaaccttacttacttacgtacctaaagtacgtaacggttaccctaacccttacccccgtcgtccttaccgttaccggtttaccgggaccgggtaacgggtacccgtaaggggtcggtaacgtaacgtaaccgtaaaccgtacgttaggtacggtaccgtacgaccgtaccgtagttacccg

SEQ ID NO: 181894 - DNA, 755 bp, Homo sapiens
  misc_feature: GYAE6OF02HUQA0.2.39.D06.1.454.CMB.1.raw
  modified_base (198)..(198): a, c, t, g, unknown or other
  misc_feature (198)..(198): n is a, c, g, or t
tcagacgctcgacacacgaccggtgctcgatttagtgacatctcgcagttctttggggagccagtctcagtcaggacacagcatggacatgagggtccccgctcagctcctgggctcctgctactctggctccgagatgccagatgtgacacccagatcgacccagtcctccatccctccctgtctgcatctgtgganacagagtcatcattctcgttcggccggactaagtcgagtagttagtttaagttaattttaattttaaagttggttaatcgtaagtttaccaaaaaccgtacggggtaaaacctacccccgttaaagtcccgttacccgttaggtaacttaccgttaagtcgtacgttcgtacctaacgtttacccgttaaagtttaaccggtaaaacgggttccggggttacccctaagttaacccgtaaagggtttccaagggttacggacgtaggtggtaacttcggtacgggtactaggttactttacgtaccttaccgtaccctaccgtacgtacgtagttacgtacctaacctaacgtagtaacgttagttttacgtaacttaactttactaacgtacgtaactaacgtaacgttacgtaccgtaccgttaacccccgtaccgtccgttaccgtaaccgggtttaccgggaccggggtaccgtagggtacggtaacggtacgttaaccgtaaaccgtacgtacgtacggtacgtaccgtaccgtacgtaccgttcgttaccg

SEQ ID NO: 181895 - DNA, 810 bp, Homo sapiens
  misc_feature: GYAE6OF02JW1DY.2.39.D06.1.454.CMB.1.raw
  modified_base (203)..(203): a, c, t, g, unknown or other
  misc_feature (203)..(203): n is a, c, g, or t
tcagacgctcgacacacgaccggtgctcgatttagtgacatctcgcagttctttgggggagccagtctcagtcaggacacagcatggacatgagggtccccgctcagctccgtggggctcctgctactctggctccgagatgccagatgtgaccacccagatcgacccagtctccatccctccctgtctgcatctggtggganacgagagtcatcatctcgtgccggacaagtcagtagtgttagttatttaatttaaagttcggtatactacgttacgaaaaccgaagggtaaaacgtcccctaaagtccttaccgtagtaactactaattcgtacgttcgactaacgttccgtaacggtttaaacgtaaacggtaccggggtaccctaacgttacgtaacggttacgtaaggggtcggaccgtaggtacggtacgttacggtacgggaacgttaacggttattttaacccgaccgtttacttacccgtaaaccgttagttaccgttaagggttacctttaaacccgtaaaccgtaaacccgttaaaggttaacgttttaacgttttaaccggtaaccctttaaaaccgttttaaccgtaacgtttaaccgtaaaccgttaaaccggtaaggttaacccgtttaaaccgtcccgtttaaccccccgttaccgttcttaacccgttaccggttaccgggtaccggggaaccggtaccgggttaacgggtaggtaaaccggtaactaaccggtaaaaccggtaccggttaggtacgggtacgttaccggtacccgtacggttactttacgg

SEQ ID NO: 181896 - DNA, 527 bp, Homo sapiens
  misc_feature: GYAE6OF02GLY6S.2.39.D06.1.454.CMB.1.raw
  modified_base (201)..(201): a, c, t, g, unknown or other
  misc_feature (201)..(201): n is a, c, g, or t
  modified_base (227)..(227): a, c, t, g, unknown or other
  misc_feature (227)..(227): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatgacccagtctccatccctccctgtctgcatctggtggganacagagtcatcatctcttggccgganaagtcagagtgttagtatttattaattggtatcagtacaacgaggaacaccctaagctctgatctatgctgcatcctagttacgaaggtcgggtaccatacgtaggttcaggtgacgagtgatcgtagggactagtattcacttcctacacatacagtactactacaactagattatttcgacttacttactactatacaagagtataccgtacctaccctcgtctactaccgttacggacggtacggtacgagggtcgagtacgaactaagtacgtgtacggtctacgactacgattcg

SEQ ID NO: 181897 - DNA, 660 bp, Homo sapiens
  misc_feature: GYAE6OF02GT7G9.2.39.D06.1.454.CMB.1.raw
  modified_base (469)..(469): a, c, t, g, unknown or other
  misc_feature (469)..(469): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccatccctccctgtctgctatcgtggtgggagacagagtcatcatctcttggccggacaagtcagtagtgttagttatttatttaaattggtatctagttacaaacgtagggaactacccctaagcctaccgtagactctatcgtactgactactcctaagtttaaacgaaacggttcgggtacccagtacgtaaggttcaggtggcgtaggtgtacgttcgaggtacgtagttactttcaccgttcctaccgaacctagtacgtaagttactaccgtaactaaccgtagtaagttntttacggaccttaaacctttactaccttagtaaccaaacgtacggttaacgttacccgtaacccttacccccgtcttacccgttacgttaaccgttccggggacggtaccgggtaaacggtagggtacggaagtacgtaaaccgaaacggtacgttacggtaccgtcgtaccgtacgtaccctagttcccg

SEQ ID NO: 181898 - DNA, 846 bp, Homo sapiens
  misc_feature: GYAE6OF02HLBDP.2.39.D06.1.454.CMB.1.raw
  modified_base (147)..(147): a, c, t, g, unknown or other
  misc_feature (147)..(147): n is a, c, g, or t
  modified_base (200)..(200): a, c, t, g, unknown or other
  misc_feature (200)..(200): n is a, c, g, or t
  modified_base (206)..(206): a, c, t, g, unknown or other
  misc_feature (206)..(206): n is a, c, g, or t
  modified_base (212)..(212): a, c, t, g, unknown or other
  misc_feature (212)..(212): n is a, c, g, or t
tcagacgctcgacacacgaccggtgctcgatttagtgacatctcgcagttctttgggggtagccagtctcagtcaggacacagcatggacatgagggtccccgctcagctcctggggctcctgctactctggctccgagatgccagntgtgacacccagatgacccagtctccatcctcctgtctgcatctggtcggganaccagntcagtnactctcttggccggctaagtcagagtacgttagttatttaatttaagttagtacttatacttacaacgtaaggtaacgacccgtaagtccttaccgtacgtatcttaatcgtctagtctacttacgtaacgtttaacgtaaacggttacggggttaccctagtaaccggtaacggttacgtaacgggttacggtaccgtaagggttacggtaacgtttcgggtaacgggtaaccgtaacgtttacggttttacaacccggtttctaacccggttaaccccttaacgttaaccggtaaacggttccggtttaaacctaaacccggttaaacccgtttaacggaacgtttttaaaccggttttaccgttaccgtttaaaaaccgtttactttaaccctacggtttaaaccgttaaaacccgttaaacggggttaacgtttttaaaccccggaaccctttaaccccccgttacccgtaccccgtttaacccgttaacccgggtttttacccgggaaccggggtttaacggggaaccccggttaagggtttaaccgggaaccggttaattaaccccgaaacggtttaccggttaacggttccggtacgttaacccggaccgttacctacgtttacccg

SEQ ID NO: 181899 - DNA, 706 bp, Homo sapiens
  misc_feature: GYAE6OF02JNGW6.2.39.D06.1.454.CMB.1.raw
  modified_base (166)..(166): a, c, t, g, unknown or other
  misc_feature (166)..(166): n is a, c, g, or t
  modified_base (201)..(201): a, c, t, g, unknown or other
  misc_feature (201)..(201): n is a, c, g, or t
  modified_base (207)..(207): a, c, t, g, unknown or other
  misc_feature (207)..(207): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggcctccgagatgccagatgtgacaccagatgacccngtcctccatcctcctgtcctgctatctggtggganactagngtcatcactctcgttcgaccgggtctaaagtcagtagttagttagtatttatttaaacttggtatctagttacaaacgagggaaacgccctaaagcctacgtagtactacttaacgcgtcgtagtcctacgtaccgttaagtttaaccgaagggtccggggttaacccacttaacgtaacggttccgtaggttacggacgtacgggttgtaacgttacgttacggggaactagtaacttttccgtactccgtacctaacgtacgtacgttaaggtacgttacctaacctaacgtagttaacgttacgtttacaccgttaacttaccgtacttagtacttaaacgtaacgttacggttaacctacccgttacccttacccgtaccttaaccgttaccgttacgggaccggttaaggaccgtagggtcggaaaccttaacgtaaccggtaaaccggtacggtaacgtgggtaaccgtacggtacctaccgttaacgttccg

SEQ ID NO: 181900 - DNA, 957 bp, Homo sapiens
  misc_feature: GYAE6OF02HY8XN.2.39.D06.1.454.CMB.1.raw
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtcgacacccagatcgacccagtctccattccctccctgtctcgctatctggtgggagacgagacgtacatctatccttacgtcgggtacccgggacgtaacggtccgaaggttaggttaggtttaaaagtttaagtttttaaaacgttttaaaagtttaggggttaatttaaccgttaacggtttaacccgaaaaacccgggtaaaacgggggttaaaaacccgtacccccccgttaaacggtaccccgttacccggttaacggtaacttaacttacgttaccggtccgttacgtaccccgttaactttacccggttaaaccggttttaaacggtaaaaaccggggttttacccggggggttaacccctaacggttaacccggtttaaagggtttacccgttaggggtaaccgggttaccggtaaggggttacgggtaacgtttacgggttacggggtaaaccgttaacgtttacccgtttaccgtaaccctaccctttaacccgaaaccgttaacgttacggttaaacggttaaccgtttaaccctaaacccggtaaccgttaaaggttaaaccggtttaccgtttttagaacccgttttaaaccttaaccggttacttaacccgtaacgtaaacgtaacgggttaaccgttaacccgtaacccttacccccgttccgtaccgttaccgttacccgggttacgggtaccggggtaaccggtaccggtaaaggggtcgtaacgtaaacggtaacctaaaggaccgtttgggaacggtcccgtaacggaaccttaccgtacgtttcccg

SEQ ID NO: 181901 - DNA, 638 bp, Homo sapiens
  misc_feature: GYAE6OF02IOZB0.2.39.D06.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (225)..(225): a, c, t, g, unknown or other
  misc_feature (225)..(225): n is a, c, g, or t
tcagacgctcgacacacgaccggtgctcgatttagtgacatctcgcagttctttggggagccagtctcagtcaggacacagcatggacatgaggtccccgctcagctcctggggctcctgctactctggctccgagatgccagatgtgacacccagatcgacccagtcctccatccctccctgtcngcatcgtgtggganacngagtcatcatctctggccgganaagtcagtagtagttagtactttagttaaagttggtatacgtagttacgaaaccgtaggaaacgtccctaagtcctccgtagactctagtcgctgacacttcgtaagttaacgaagtcggggtaccagttacgtaacgttcgaacgtggctaagtggatcggtaggactacgtacttacgacctcgtaccaacgtacgtacaaggtactactaactaaccctagtaagttattcgtacctaaactcgttactacgtactaagtacgtaacgttaacctaaccgttccccgtaccgtaccgttcttaacgggttccgggttaccggaacgggtaacccgtaagggtcggtaagtaacctaccggaaaacgttaccgtaggtccggtaccgtaggtacccttaccgtgtttaccg

SEQ ID NO: 181902 - DNA, 594 bp, Homo sapiens
  misc_feature: GYAE6OF02GIMXP.2.39.D06.1.454.CMB.1.raw
  modified_base (199)..(199): a, c, t, g, unknown or other
  misc_feature (199)..(199): n is a, c, g, or t
  modified_base (223)..(223): a, c, t, g, unknown or other
  misc_feature (223)..(223): n is a, c, g, or t
  modified_base (368)..(368): a, c, t, g, unknown or other
  misc_feature (368)..(368): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctctggccggnaagtcagagtgttagtatttaattaaattggtatcagttacaaacgaggaacgcccctaagcctctagattctatgctgctatcctaagttaacgtaaggtcggggtaccctatacgtaaggtctaggtggcgtagtggtatcgngggtactagtactttacactactaccacatactagtactactaacaaccgtagtaattagtttacgtactaacttaactacttacgtaactaacgtagtaacgttacgtaaccttaccccgtcgtacctacgttacgttaccgggacgggacgggtaccgtagggtcggaacgtacgtaacgtaaaccgtaagtcggtacggtaccgttcggacctactagtaccg

SEQ ID NO: 181903 - DNA, 683 bp, Homo sapiens
  misc_feature: GYAE6OF02J22BB.2.39.D06.1.454.CMB.1.raw
  modified_base (166)..(166): a, c, t, g, unknown or other
  misc_feature (166)..(166): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (306)..(306): a, c, t, g, unknown or other
  misc_feature (306)..(306): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccngtctccatcctccctgtctgcatctgtggganacngagtcatcatctctggccggcaagtcagngtgttagtatttattaattggtatactagttacaaacctagggtaaacgtccctaagactctagtatctatgtctncgactcctatttaacgaaaggttcggggtaccctagtacaaaggttctagtcggactacgtggtactacgtgggactagtattttaccgaacgtcctaccgtaacctacgtacccgtaagttacgttaccgttaacctaaacccgttaggtaacgttaactttttacgaaccttaaactttaccgttaaccgtactaccgtaaaccttaaggtaaacgtttacccggtaaccttacccccgttaaccgaccttaccgtaaccgttttaaccgggccgggtaacggtaaccggttaacgggtacggtaacgtaagtaaaccgtaacccggtaagttaccgggtagtaccggtagtaccccgtacgtacgtttacccgg

SEQ ID NO: 181904 - DNA, 872 bp, Homo sapiens
  misc_feature: GYAE6OF02H1SNJ.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtcgaccacccagatcgacccagtcctccactccctcccgtgtctgcatcgtggtgggagacagtagtcatctatcctcgttcggccgggacaaggtcagtagttgttagttatttaatttaagttggtatctaacgttacgaaaccgtaaaggggaaaccgtaccccgtaacgtccttaccgtcgtaacttcttacgtcgtaccgttcggacctacgtttaccccgttaaaggttttaaaccggaaaaccgggtttcccggggtacccctaacgttaaccggttaagggtttaaccgacgggttacgggtccggtaaaggtacgggttacggttacggtacggggggtaactacggtttaccttttaacccgacctttaccctacccgtaacccttaacttaccgtacgttaaccgtttaaccctaaacccggttaaccccgttaaaggttaaaccgtttacggttttttaaccgtaaccctttaaaccgttttaaccttaacgtttacggttaaaccccgtaaaacggttaaaccggttaccgtttaaacccgtaccccctttaacccccggtcctttaaccccggtactttaaaccccgggggttccggtaaccgggggtaaccggtacccgggtaaagggtacggtaaccgtaaccgtaaccgtaaaaccggtaccgttagggtccggtaccggtaccgtacctaccggtctttacccggg

SEQ ID NO: 181905 - DNA, 790 bp, Homo sapiens
  misc_feature: GYAE6OF02I8DDA.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctgggctcctgctactctggctccgagatgccagatgtgacacccagatcgaccagtctccatcctcctgtctgcatctgtggagacagtacgtcatcatctcgttcggaccggcaagtcgagagttagttagttatttaagttttaaattggtatcgtagttacaaacgaggaaaccgtcccctaagtccttccgtagtacttacgtacgtcgaccgttgactacttaccgttaaggtttaaaccgaaagggttccggggtaccctaggttaaccgtaaagggtttccgaaggtttacggaccgtaggttaccggtagttaccggtagggtaaccgtagtttaaccgtttccgtaaccgtttacccgtacccgtaacccgtagtaccggtaacgttacggttacccgtaaaccgtaacccgttaggtaaacgtttacgttttaccgaacctttaaaccgtttaaccgttaaccgttacgtaaacccgttaaactaacggtttaaccgtaaaccgttaaccccgttacccccgtacccgttacccgttaccctttaaccgggtttacccggacggggttaaccgtaaccggtaaacggggtcggttaaaccggtacgtaacccggaaacgttacggttcggtaaccggttacctaccggtaaccctacgtacgtttaccg

SEQ ID NO: 181906 - DNA, 776 bp, Homo sapiens
  misc_feature: GYAE6OF02HOXMH.2.39.D06.1.454.CMB.1.raw
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatcgacccagtctccatcctcctgtctgcatctggtggagacagagtcatcatctctcggcggcaagtcagtagtagttaagttatttaattaaagttgtatctaagttacaaaccgaagggaactaccctaagtcctacctagactactatgctacgctacgtactaagttaacgtaaaggtcgggtaccctagtaacgaaggtttacgaggtcggtacgaaggttaggtaactacggttacgggaagtaacgtacgtttacgaaccttacgtacctaaccgtactaacgtaaggttaacgttaacctaaaccgtaaaccgtaaggttaaaccgttaacggtttttaacaaacccgtttaaaccttaaaccgttaaccgtaacgttaaaccgtaaacggtaaacggttaaccgtttaaacccggtaacccgttaaccccccgttaccggtaacccgtttacgttaaccgggtttacccgggtaaccgggggtaaccgggtaaacccggttaaggggtaacggtaaaccggttaacgttaaaacccggtaaaacggttaaccgttagggtaccggttaccggttaccggtaaacccgtaaccgttaccggtttaccg

SEQ ID NO: 181907 - DNA, 559 bp, Homo sapiens
  misc_feature: GYAE6OF02F40EA.2.39.D06.1.454.CMB.1.raw
  modified_base (198)..(198): a, c, t, g, unknown or other
  misc_feature (198)..(198): n is a, c, g, or t
  modified_base (223)..(223): a, c, t, g, unknown or other
  misc_feature (223)..(223): n is a, c, g, or t
  modified_base (275)..(275): a, c, t, g, unknown or other
  misc_feature (275)..(275): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagagtcatcatctcttgccgggnaagtcagagtgttagtatttattaaattggtatcagttcaaaccagggaacnccctaagctcctgatctatgctgcatcagtttacaagtcggtccatcagttcagtgcagtgatcgtggacagtacttcactctacacctatcagtacgtactactaacctagtaagtattttacgactaaactttactacttagtacaactagtacgttaccgacttaccccgtctaccttacgtaccgtttacgggccggtaacgggtaccgaagggttcggaacggtaactaaccgaaacgtacgttaggtacggtacctacggacctaaccgtagttaccg

SEQ ID NO: 181908 - DNA, 892 bp, Homo sapiens
  misc_feature: GYAE6OF02IJCIJ.2.39.D06.1.454.CMB.1.raw
  modified_base (104)..(104): a, c, t, g, unknown or other
  misc_feature (104)..(104): n is a, c, g, or t
tcagacgctcgacacacgaccggtgctcgatttagtgacatctcgcagttctttgggggagccagtctcagtcaggacacagcatggacatggagggtccccgntcagctccgtggggctcctgctactctggctccgagatgccagatgtgaccacccagatcgacccagtcctccactcctcctgtctgcatcgtggtggagacagtagtcaatcacttcgtcgttcggaccgggactaaggtcgaggtagttagtttaagtttaattttaagttttaaaagttggtaacttacgtaaggtttaaccgaaaaaccggtaacgggtaaaacctccccgttaaacgtcccttacgtagtaacttccgtattcgcgtacgacctacttaacccgttaaggtttaaaccggaacgggttccggggttaacccctaaggtaaccgtttaaaccgggttcgtagggttacgggtaacgtacgggttacggtaacgttaccgggtaggggaacctttaaccggtttaacgttttaacccttaacccgttaacccgtttaacccgtaaacccgttaaccggttaaccggtaaccggttttaaacgttaaccccgttaaaacccgttaaacccgtttaagggttaaaccgttttaacgtttttaaccgggaaacctttaaaccgtttaaccttaccgttaccgttaaaccgtaaacgtaacgtttaaccgtttaaacccgtaaccccgtttacccctaccgttaaccttacccggtttaaccggttaccggggaaaccggggtaccggtaaccggtacggggtacggtaacgtaaccgtaaaccgtaaaccgttacgtacggtacggtacgtaccgggtacttaccgttacgttaccgg

SEQ ID NO: 181909 - DNA, 680 bp, Homo sapiens
  misc_feature: GYAE6OF02I5RDZ.2.39.D06.1.454.CMB.1.raw
  modified_base (142)..(142): a, c, t, g, unknown or other
  misc_feature (142)..(142): n is a, c, g, or t
  modified_base (334)..(334): a, c, t, g, unknown or other
  misc_feature (334)..(334): n is a, c, g, or t
  modified_base (661)..(661): a, c, t, g, unknown or other
  misc_feature (661)..(661): n is a, c, g, or t
  modified_base (675)..(675): a, c, t, g, unknown or other
  misc_feature (675)..(675): n is a, c, g, or t
tcagacgctcgacacacgaccggtgctcgatttagtgacatctcgcagttcgtttgggggagccagtctcagtcaggacacagcatggacatgacgggtccccgctcagctccgtggggctcctgctactctggctccgagntcgccagactgtcgacaccagatcgacctagtctccatccctcctgtctgctacgtctggtagggacgactagtagtcatcacttctcgtcggccggataacgtgaagtgttagttaatttatttaacgttaagttcgtatacgtacgttaaccgaaacggtaaggaaacctacccgtaagtcctacggtanacttagtactggtcctagtactacgttaaccgttaagttaaacggaacgggttaccggaccttaacgtactagggttaccaggtacgtcgaagtcggtagttcgggaggtaactacgttactttcgacctactacgtaactacgtacgtaacgttacgtaaccttaacgtaccgtagttaacgttacgtttacctacttaaaccttacgtacttaacgtaacgtaacgttaccgttaactaaccgttaccctaccgttaccttccgtaccgttagtaccgggaagaccgggtaagtacgggtataccgagtacgaacgttgcgtacncgtacgctacggtnttacg

SEQ ID NO: 181910 - DNA, 871 bp, Homo sapiens
  misc_feature: GYAE6OF02IT3IC.2.39.D06.1.454.CMB.1.raw
  modified_base (184)..(184): a, c, t, g, unknown or other
  misc_feature (184)..(184): n is a, c, g, or t
  modified_base (202)..(202): a, c, t, g, unknown or other
  misc_feature (202)..(202): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccaccagatcgacccagtcctccatccctcctntctgcattctggtggganacgagtagtcctatacctattccttcgttcggacccgggtactaacgtccgaagtagttagtttagtttaatttttaaacttttaaagttggttaactcgttaacgtttaccgaaaaccgtaaggggaaaccgtacccctaaggtccttccgtagtaaccttactaacgtcggtctacgtactaacgttacccgtttaaagtttaacgaaacggggtttaccgggtaccctagtaacggtttaacgggtacgtaacgggttcggtacggtaaggttacgggtaacgtttcggtaaacggggtacctaagggtttacctttaaccgtactttaccccgttaaacctaacttaaccgttacgttaagttaccgtttaaccgtaaactaaacccgttagtaaaacgttttcgtttaacgttaaccgtaaaccttttacccgttaattaaccgtacgtaaaccgttaaacgttaacttaaccccggtaaccctttaaccccgtcccgttaacgtttacccgttaaccgggtttacccggggaaccggggttaaccggtaaaccggggtttaacgggaaccgggtttaaccgtaacggttaaaaaccctaaacccggggttaacgttaacggttccgggaacgtttacccggaacttaaccgtccgtttaccgg

SEQ ID NO: 181911 - DNA, 764 bp, Homo sapiens
  misc_feature: GYAE6OF02JVDE5.2.39.D06.1.454.CMB.1.raw
tcagacgctcgacacacgaccggtgctcgatttagtgacatctcgcagttctttggggagccagtctcagtcaggacacagcatggacatgaggtccccgctcagctcctggggctcctgctactctggctccgagatgccaggctggtgacacccagatcgacccagtctccatccctccctgtcctgctactctggtcgggagtaccagtagtcaattccacttctcgttcggacccggtacaacgttccaggtagttcgttagttaattttatttaaagtcggtatctacgttacaaaccgtaggaaaccgccctaagtcctaccgtgactccttagtcgctacgtctaatcctaacgtttacgaaacggttcgggaccttacggtacgtaaggtctaacggtggaccgtaaggtggtaactccggttagggaccgtaagttaccgttacctaccgttacctactacccgtagtaccggtaagttaccgtacctaaccgtaaccgtagttaaacgtacgttttaccgaactttaaaccttaacttacctaacgttaccaaaccgttaacggttaaccgtttaaccggtaacccgtacccccgtttaccgtacccgttaacccgttaaccgggtttaccgggaaccgggttaccgggaaacccggttaacggggtaacggttaaacggttaaaccgtaacgtaaacccggttacgttaacgggtcgttacccggtaactaccgtaaccctacgtttacccgg

SEQ ID NO: 181912 - DNA, 634 bp, Homo sapiens
  misc_feature: GYAE6OF02I414N.2.39.D06.1.454.CMB.1.raw
  modified_base (229)..(229): a, c, t, g, unknown or other
  misc_feature (229)..(229): n is a, c, g, or t
  modified_base (293)..(293): a, c, t, g, unknown or other
  misc_feature (293)..(293): n is a, c, g, or t
  modified_base (512)..(512): a, c, t, g, unknown or other
  misc_feature (512)..(512): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatgacccagtctccatccctccctgtctgctatctggtgggagacagagtcatcatctcttcggccgggnaagtcagagtgttaagttatttaatttaattggtatctagttcaaacgaggaacaccccgtaanctacagtactctatagctcgctactcgtaacgtttaacgaaaggttcgggacctagtacgtaaggttcaggtcgacgtaagtggtactacgtagggactaagtacttacgacctcgtacctaactatcgtaacggttataccgtaaacctaacgtacgaagttattacggtacttaaactttacgtactacggtactaacgaagttacggttaaacccncccgttaaccccgtacgtaccttaccgtaccggtttaccgggacggtaacgggtaacccggaagggtaacgtaagtaactaaacggaacgtaacgtggacgtgtacacccgtactacttacg

SEQ ID NO: 181913 - DNA, 658 bp, Homo sapiens
  misc_feature: GYAE6OF02H3HH0.2.39.D06.1.454.CMB.1.raw
  modified_base (106)..(106): a, c, t, g, unknown or other
  misc_feature (106)..(106): n is a, c, g, or t
  modified_base (171)..(171): a, c, t, g, unknown or other
  misc_feature (171)..(171): n is a, c, g, or t
  modified_base (320)..(320): a, c, t, g, unknown or other
  misc_feature (320)..(320): n is a, c, g, or t
  modified_base (346)..(346): a, c, t, g, unknown or other
  misc_feature (346)..(346): n is a, c, g, or t
  modified_base (432)..(432): a, c, t, g, unknown or other
  misc_feature (432)..(432): n is a, c, g, or t
tcagacgctcgacacacgaccggtgctcgatttagtgacatctcgcagttctttggggggagccagtctcagtcaggacacagcatggacatggacgggtccccgntcagctccgtggggctcctgctactctggctccgagatgccagatgtgacacccagatcgacccngtctccatccctccgtcgtctcgctatcgtagggtgggactacgaggacttacatacattctcggttcgccggacaagtcagagttagttagttaattttaattaagttggtaacttcaagttacaaaacgaacggaaactcccgtaancctactagaacctagtatcgtacgtnaacacttaccgttaaaggttaacgaagggtccggttaccagttaacgaagtttcgagtggacgtagtgacgttcgaggtgaacttnttacaacctctacctactatacgtaagttctaaccgtaataaccgtagtaaattcgtttaacgacttaacggttaactacgttactaacgtaaaccgtagtaacgtaccttaaccgtaccctaccgttcgtacgttaaccggttacggccgggtaacggtaacggtagggtaacgtaacgacgtaaccgtaaacgagttgaccggtacacggtactacctagtccg

SEQ ID NO: 181914 - DNA, 604 bp, Homo sapiens
  misc_feature: GYAE6OF02G2NS7.2.39.D06.1.454.CMB.1.raw
  modified_base (321)..(321): a, c, t, g, unknown or other
  misc_feature (321)..(321): n is a, c, g, or t
  modified_base (413)..(413): a, c, t, g, unknown or other
  misc_feature (413)..(413): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtcctccactcctccctgtctgcatcgtggtgggagacagagtcatcactctcgttcggccgggacaagtcagtagttgttagttattttaatttaaagttggtatctagttacaaaccgaaggaaaccgcccctaagcctcgtgatctagtgntgctatccgtaagtttaacgaagggtccggtacctatacgtaggttcaggtgcgaggtgtatcggaggactagtacttcactcctccactanctagtatctaacactagaattagtttgacttaacttactactactacaacgtagtacgtacctaccttaccctcctaccgttcctaacgggtttccgggacgggtaacccgggtacggtaacggggtcggaaccgtaacgtaaccggaaacgttaacgtcgggtagtccgtacggacctacgtacgttccg

SEQ ID NO: 181915 - DNA, 653 bp, Homo sapiens
  misc_feature: GYAE6OF02HZKL7.2.39.D06.1.454.CMB.1.raw
  modified_base (102)..(102): a, c, t, g, unknown or other
  misc_feature (102)..(102): n is a, c, g, or t
  modified_base (198)..(198): a, c, t, g, unknown or other
  misc_feature (198)..(198): n is a, c, g, or t
tcagacgctcgacacacgaccggtgctcgatttagtgacatctcgcagttctttgggggagccagtctcagtcaggacacagcatggacatgaggtccccgntcagctcctggggctcctgctactctggctccgagatgccagatgtgacacccagatcgacccagtctccatcctcctgtctgcatcgtgtggganacagagtcatcatctcgttcggccggcagtcgagagtgttagttatttatttaaagttgttatactagttacaacgaaggaacgacccgtaagtcgtccgtagtatactagtcgtatcgctactacctacgttacgtaagtccggggggtacctacgtacgtaacggttcgtagtacggtacgtaggtagtacgtcggtaggtacgtagtacgtttacctaccttcctaccgaaccgtaacgtacgtaacgttacgttacctaaccgtaaccgttagtaacgtttacgtttacgtaacgttaaccgttaaccttacgtaacgtacgtaacgtacgttaacgtaccgttaaccgtacccgtaccgtaccgtccttaccgttacggtacggtacggtacgacggtacgtacgtacgtaaccgaacgtacgtgttacgacgtacgcgtactattaccg

SEQ ID NO: 181916 - DNA, 518 bp, Homo sapiens
  misc_feature: GYAE6OF02I96Q8.2.39.D06.1.454.CMB.1.raw
  modified_base (198)..(198): a, c, t, g, unknown or other
  misc_feature (198)..(198): n is a, c, g, or t
  modified_base (203)..(203): a, c, t, g, unknown or other
  misc_feature (203)..(203): n is a, c, g, or t
  modified_base (275)..(275): a, c, t, g, unknown or other
  misc_feature (275)..(275): n is a, c, g, or t
  modified_base (354)..(354): a, c, t, g, unknown or other
  misc_feature (354)..(354): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgcatctgtggganacagngtcatcatctcttgccgggcaagtcagagtgttagtatttattaaattggtatcagttacaaacgaggaacncccctaagctacctgatctatgctgcatctagttacaaggtggtaccatcgaagtcagtgacagtgatcgtggacagtnttcactctcactatcatacgtctacacctagaagttatttcgtactaacttactactagtacaactagtattaccgactacccgcgtactcctacgttcggacggacgacggtaacggtgacgtaagtacgtaacgtacgtggtcgactcggactactacttcg

SEQ ID NO: 181917 - DNA, 658 bp, Homo sapiens
  misc_feature: GYAE6OF02HKA65.2.39.D06.1.454.CMB.1.raw
  modified_base (201)..(201): a, c, t, g, unknown or other
  misc_feature (201)..(201): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatccctccctgtctgcatctggtggganacagagtcatcatctcttggccggcaagtcagagttgttagttatttattaagttggtatctagttacaaaccgaggaactacccctagcctcctgtatctagtcgctgctactacctagttaacgaaacggttcggggtaccctacgtactaacggttcgtaaggtcgacggtaggttacggtacgttcgtagggacgtaagtactttacgtaccttcctacgaaccgttatccgtaaggttaccttactaaccgtaacctaggttaaacgttcttttacgaacctttaaaccttacgttactacgtactaaacgtaggttaacgttaaccgtaaccctaccccgtacccgtaccttaccggttacgttccgggtaacgggtaccggtaacggtaacggtggaaccgagtaaaccgaagtacgtcggtacgtccgttaccgactactacgttaccg

SEQ ID NO: 181918 - DNA, 921 bp, Homo sapiens
  misc_feature: GYAE6OF02JQ6W0.2.39.D06.1.454.CMB.1.raw
tcagacgctcgacacacgaccggtgctcgatttagtgacatctcgcagttctttgggggagccagtctcagtcaggacacagcatggacatgacgggtccccgctcagctccgtggggctcctgctactcgtggctccgagatcgccagatcgtgaccacccgagacgtcgaaccctacgtcctaccactccccttcccgtgtcctcgctacttcgtgggtggacgacgacggacgtacactactcttccttcggtacgggaccggactaacgtcgtaaggtacgttagtttaagttttaattttaagttttaaacggttacggttaacttacgtaaacggtttaaacccgaaaaccgggtaacgggtaaaacccgtaccccgtaaagtcccgttaccgtaacgtaccttaacgtacgtggtaccttaggtacccttaaccgtaaccttttaaaccggtaaacgggtaaaccgggtttaccggtcccgttaaagttaaccgggtagtttaccggaacggtttacgggtacgttaacggttacgggtacgtacggtacgggtacgtaactttacgttccgtaccctactaccgtaacacgttaacgcgttaaccgtaccgttaacctaaggtaaccgtttagttaacgtttaccgtaacctttaccgttaaacgttacgtaacgtaacccgttaaagtaaccggttaaccgttaaccccgtaacccgttacccccgttagtttacccggttacccgtttaaccgggttaacccggggtaaccggggtaaccgttaaacccggggtacgggttaaaccggtaacggtttaaaccgaaaaccccggtttaaccgggtaacgtttacccgggtaacggttaccgtaacccccgggtacgttacccggttagttttaccccccggg

SEQ ID NO: 181919 - DNA, 624 bp, Homo sapiens
  misc_feature: GYAE6OF02FW1VB.2.39.D06.1.454.CMB.1.raw
  modified_base (203)..(203): a, c, t, g, unknown or other
  misc_feature (203)..(203): n is a, c, g, or t
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (469)..(469): a, c, t, g, unknown or other
  misc_feature (469)..(469): n is a, c, g, or t
tcagacgctcgacacacgaccggtgctcgatttagtgacatctcgcgagttctttgggggagccagtctcagtcaggacacagcatggacatgagggtccccgctcagctcctggggctcctgctactctggctccgagatgccagatgtgacacccagatcgacccagtcctccatcctccctgtctgcatcgtggtggganacgagagtcatctatctcgttggccgggacaggtcagtagtgttagttatttaattaaattggacttnacgttacaaaccgagggaacnccctaagtcctctagtactctatgtctgctacgtccgtaagttttaaacgaaagggttccgggtaacccagtacgtaacggttacagggttcgacgtaggtaggtacgtcgtagggaactagtacttcacgttcaccacgtactacgtagtaccgtacctaacacgtagttaaggtntttaccactttaacctacgtactacgacaacgtagtaaccgtaactcctaccccgttacgctaccttacgggttacgccggacggtacctaggggtcgtaaagtaacgttccgaaacgttacgtcggtacggacctaccgacctacctgttaccc

SEQ ID NO: 181920 - DNA, 867 bp, Homo sapiens
  misc_feature: GYAE6OF02IFR5N.2.39.D06.1.454.CMB.1.raw
tcagacgctcgacacacgaccggtgctcgatttagtgacatctcgcagttctttgggggagccagtctcagtcaggacacagcatggacatgagggtccccgctcagctccgtggggctcctgctactctggctccgagatcgccagatgtcgaccacccagtatcgaccctagtcctccatccctcctgtctgctagtcgtaggtgggatacgagtacgtctactcacgttccttcgttccgggccggtacgtaacggttccgaaggttacgtttaggttttaacgttttaaagtttttaagttttaaaaggttcgggttacttaaccgttaaccggtttaaaccgaaaacccgggtaaacggggtaaaacccgtccccgttaaacggtcccttaccgtaggttaaccttacgttacgttcgaccgttagaccttaacgttacccgttaaagttttaacggaaaccgggttcgggtaaccctagttaaccgaacgggtttacgacggtttcggacgttaggtacggttaaccgtcggtaagggaccttacggtttaacgtttcccgaaccgtttccgtaacccgtaaccgttaagtaccggttaacggttaccgtaacccgttaaaccgtaacccggttagtaacggtttacgtttaacgtaacccgttaaactttacgtacgtacgttaacgaaacgttacggtacgttaaccctacccttacccggttacctaccgtttaccgtaccggtttaccggggaccggtaaccggtacggtaacgggtaacggtaacgttaacctaaaccggtaaacggttaacgtcggttaccggtacaacccggtaccctacgtacgtttacccgg

SEQ ID NO: 181921 - DNA, 1059 bp, Homo sapiens
  misc_feature: GYAE6OF02JYPKM.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgaccctagtcctccactccctccctgtctcgcactcgtggtagggagacagacgtcatctactcgttacgttccggaccgggacaacgtaccgtaaggtaggtttagttaacgttaagttttaatttaaagttcggtaactacgtaacgttaaccaaaaccggtaaacgggtaaacccgtaccccgtaaaggtccttacccgtagtaaaccttcgtacgttagtcccgttacggtacccttaaaccgttacccggtttaaaacgggtttaaacccgtaaaacgggggtttacccccggggttaacccgttaaacgttttaaaccggtaaaccggggttttacgggtaaaccggtttaccggggttacggttaaccgggttaacggggttaacgtttaacccgggggttaacggggtaaacttaaacgtttttaccggttttaccccgtaacccggttttaacctaacccccgggtttaaactaaccgggtttaacgtaaaccggggttttaaacccttaaaccccgggttaaacccgttaaaaccggtttacggttaaacggtttttaccgtttttaaacgggaaacccccttttaaaccggtttaacccgttttagaaaccgttaaaccggttaaaaccggttaaccggggtttaaaccctttaaacccgggttaacccccttaccccccggtttaaccggtttaccccgttaaacccggttttaaccgggggttttacccgggggaaaacccgggggttaccggttaaaccgggtaacgggtttaaaccggggtaaccttaaaccgtaaaccccgggttaaacccggtttaacgggtaacgggttcccggtaaccgttacccggtaaaccggttaccccgtttaacctttccgggg

SEQ ID NO: 181922 - DNA, 637 bp, Homo sapiens
  misc_feature: GYAE6OF02HSKMD.2.39.D06.1.454.CMB.1.raw
  modified_base (139)..(139): a, c, t, g, unknown or other
  misc_feature (139)..(139): n is a, c, g, or t
  modified_base (200)..(200): a, c, t, g, unknown or other
  misc_feature (200)..(200): n is a, c, g, or t
  modified_base (228)..(228): a, c, t, g, unknown or other
  misc_feature (228)..(228): n is a, c, g, or t
  modified_base (275)..(275): a, c, t, g, unknown or other
  misc_feature (275)..(275): n is a, c, g, or t
  modified_base (291)..(291): a, c, t, g, unknown or other
  misc_feature (291)..(291): n is a, c, g, or t
tcagacgctcgacacacgaccggtgctcgatttagtgacatctcgcagttctttgggggagccagtctcagtcaggacacagcatggacatgaggtccccgctcagcctcctggggctcctgctactctggctccgagntgccagatgtgacacccagatcgacccagtcctccatcctccctgtctgcatctgtggganacagagtcatcactctcgttggccgganaagtcagtagttgttattattattaatggtatcagtcaacgagaacnccagctcgagatctangactgctatacgtaagtttacgaaggtccggaccagtacgaacggtttcaagggttgacgtaggtacggtacgtcggtacgggactacggtatttaccgacttcctaccgaactacgtagtacgttacgaaccgttacaacccgttaggtaacgtttaacgtttacgaaccgtttaacttaacctacgttaccgtaactaaacgtacgttaacgttaaccgtacccgtaccccgttaccgtaccgttccgtaaacggttcgggaacggtaccgggtaactaacgggtagaacgtacgtaaacggtaaccgttaggtcgtaccggtctacggtacccaacgtctacg

SEQ ID NO: 181923 - DNA, 776 bp, Homo sapiens
  misc_feature: GYAE6OF02HGT4Z.2.39.D06.1.454.CMB.1.raw
  modified_base (151)..(151): a, c, t, g, unknown or other
  misc_feature (151)..(151): n is a, c, g, or t
  modified_base (202)..(202): a, c, t, g, unknown or other
  misc_feature (202)..(202): n is a, c, g, or t
  modified_base (207)..(207): a, c, t, g, unknown or other
  misc_feature (207)..(207): n is a, c, g, or t
tcagacgctcgacacacgaccggtgctcgatttagtgacatctcgcagttctttgggggagccagtctcagtcaggacacagcatggacatgagggtccccgctcagctcctggggctcctgactctctggctccgagatcgccagagtgngaccacccagactcgaccagtctccactccctcctgtctgacactcgtggnggganacgagtagtcactctagtccttcgtcggaccgggacaacgttcaggtaggtcgtttaagttaattttagtttaaagtggttaacttactaagttacccgaaacggaacgggaaccgtacccctaagtccgtaccttagaccttcttaagtcgtacttcgacttaccgttaccgttaacgtttaaccggaaacgggtttccggggtaccaacgttacgtaaacgggtttccgagggttaggaacgtttaacgggtcggttaaagtcgggttacgggaaccgtaagttacccgtttacctaccttaccgtacctaaccgtacgttaccgtaagttaccggttaactaacccggttaaacctaggttaaacgtttacgtttacgtaacctttaaaccgttaacttacccgtaataaccgttaaacgtaaccgttaacggtaacccttaccccgtacccgtaccgtcccttaagttaccccggttagggtacccggacggtaccgggaggtacggtaagaactaaccgtaacggtaactcgggtaacgtcgtacccgacgtacctacgttccg

SEQ ID NO: 181924 - DNA, 759 bp, Homo sapiens
  misc_feature: GYAE6OF02I1STH.2.39.D06.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
tcagacgctcgacacacgaccggtgctcgatttagtgacatctcgcagttctttgggggagccagtctcagtcaggacacagcatggacatgagggtccccgctcacgctccgtggggctcctgcctactctggctccgagatgccagatgtgacacccagatcgacccagtctccgatccctccctgtctcgactntcgtggtggganacagactcgatcactctcgtcggccggganaacgtcgagtgttacgttagtaattttaacttaagtcggttatccgtaaggtaccaaaaccggagggaaccgtccctaacgtccttaccgtagacttactgtacggtctacgactaacttacccggtaaggttttaacgaagggtttcccggggtactaaggttaccggtaacggttacctagggttacggacggtaggttacggtactttaacgggtgggaaccttaggttaaccttccacgttaccaccgtacgtactacggtaaacttaccgtactaaaccgtaacgttaacggtagttacggttttaccaaccgtttaaaccgtttacacgtttaccgaaaccgtaacggtacgttacgtttaaccctacccggttacccccttcgtaccgtttacgtaccgggtttacgggaacccggggtagtaaccccggttaaggggtccggaaattaacccgaacggtaaccgtacgggttacgggttaccgagtaacccggtcctaaccgtgtttacccg

SEQ ID NO: 181925 - DNA, 704 bp, Homo sapiens
  misc_feature: GYAE6OF02IJSJK.2.39.D06.1.454.CMB.1.raw
  modified_base (102)..(102): a, c, t, g, unknown or other
  misc_feature (102)..(102): n is a, c, g, or t
  modified_base (367)..(367): a, c, t, g, unknown or other
  misc_feature (367)..(367): n is a, c, g, or t
  modified_base (536)..(536): a, c, t, g, unknown or other
  misc_feature (536)..(536): n is a, c, g, or t
tcagacgctcgacacacgaccggtgctcgatttagtgacatctcgcagttctttgggggagccagtctcagtcaggacacagcatggacatgaggtccccgntcagctccgtgggcctcctgctactcgtgcctccgagatgccagatgtgaacctacccagtacgtcgaccctagtcctccactccctcctgtcctacgctactcgtggtagggacacgaggtacgtcactctacttcctcggttcggacccggtataacggtcgtaggtacgtttaggtttaactttaagttttaagttttaagtacggttactacgtaacgttaaccgaaaccggaacggtaacctaccccgaagtcctacgtnacttacctatcgtactgtacctacgttaccgtaaagttaacgggaacggtccggtacctaatacggtagtacgacgtcggacgtaggtgaacgtcggtaagacgttacgttctactactctaacctcaacgtcgtaagttacgaacctacgtaaccgtagtaacgtttnttacgtacctacgttaaccgttcgtaacgtaactaacgttacgtacgtaacccttacccgtacccgtcttaccgtacgttacccgttggggacctacgggtaacggtagtacggtaataccgtaacggtaagtacgtcgtaccggccgtacgtcctagtccgttacgg

SEQ ID NO: 181926 - DNA, 778 bp, Homo sapiens
  misc_feature: GYAE6OF02GP3YO.2.39.D06.1.454.CMB.1.raw
  modified_base (103)..(103): a, c, t, g, unknown or other
  misc_feature (103)..(103): n is a, c, g, or t
tcagacgctcgacacacgaccggtgctcgatttagtgacatctcgcagttctttgggggagccagtctcagtcaggacacagcatggacatgagggtccccgntcagctccgtggggctcctgctactctggctccgagatgccagatgtgaccaccagatcgacccagtctccatccctccgtgtctgcatcgtggtgggacgtacaggagtcaatctacttcctacgttcgggcccgggtaataggtccgaggtaggttagttaagtttaattttaagttttaaaagttgggtaactaccgtaaggttaaccaaaaccggtaaaggggtaaaccgtaccccgtaaggtccttaccgtaaggtacttaccgtaagtcggtcctcgactacttaccgttaagttaaccgaaacgggttccggtaccctaagttaccgtaaggtcgtaacggtggtacgtaaggtacgtagttcggtaacggggtaactacgtttaacgtttccgaaccgtttaccctaccgtaaccgtaacgtaacgtacggttactaacccgtaaacgtacccgtaaggttaacgttaacgttttaccgaacctttaaactttacccgttaacgtactaaccgtaacgtaaccgtttaacgttaccctaacccgttacccgaccttctacccgttaccggtgggtaccggaggtaccggtaagggtcggtaaccttaacggaaccgtaacggttaacttcgggtaaccgtgtaaccgaccggtacccttaggttccc

SEQ ID NO: 181927 - DNA, 607 bp, Homo sapiens
  misc_feature: GYAE6OF02IN0ND.2.39.D06.1.454.CMB.1.raw
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (350)..(350): a, c, t, g, unknown or other
  misc_feature (350)..(350): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatcctccctgtctgcatctgtgggagacagagcatccatctctgccgggacaagtcagtatgttagttatttaatttaaatgtatctagttacaaacgaggaaactccctaagctctgatctangcngcatctaagttaagaaggttcggaccagtactaaggtcagtgataggtgntcgtaggaactagtacttcacgtactaccgactatactaggttactctaaactaaccgtagtaaagttatttacgaacgtaaccttaacgtactagtaacctaaagtaacgtaagttaaaccaccgttaccccctcgtaaccttacgttacgttaccgggacgggacggtaaccggttaaggtcggtaaacgtaacctaaaggtaaaaccccggtagttacggtacggtaccgtacggaccctaacctacgttaccg

SEQ ID NO: 181928 - DNA, 684 bp, Homo sapiens
  misc_feature: GYAE6OF02HHT0E.2.39.D06.1.454.CMB.1.raw
  modified_base (203)..(203): a, c, t, g, unknown or other
  misc_feature (203)..(203): n is a, c, g, or t
  modified_base (272)..(272): a, c, t, g, unknown or other
  misc_feature (272)..(272): n is a, c, g, or t
  modified_base (293)..(293): a, c, t, g, unknown or other
  misc_feature (293)..(293): n is a, c, g, or t
tcagacgctcgacacacgaccggtgctcgatttagtgacatctcgcagttctttggggggagcaagtctcagtcaggacacagcatggacatgagggtccccgctcagctcctggggctcctgctactctggctccgagatgccagatgtgacacccagatcgacccagtcctccatccctccctgtctgcatctggtggganacagagtcatcatctcttcggccgggcaagtcagtagttgttagttattttaatttaaagttggttatntagttacaaaccgagggaacncccctaagcctcctagacttctagtcgactcgactactaccgttaagtttaaaccgaaacggttcggggtaccctagtacgtaaggttacaggtggacgtaggtgtacgtcggtagggactagtactttacaccttcgtaccacctatacgtagttacgtacctaacctacgtagtaacgtttatttacgacttaaccgttacttacgtacgtaaccaacgtaacgttacgttaaccgtacccttaccccgtaccgttcctaccgttaaccggttaccgggaccgggtacgggtaaccggtaacggggttacggaacggttaaccgtaaccggtaaaccgtacgggttacggtacgggtacccgtaccgtaccgtaccgtacgtttaccgg

SEQ ID NO: 181929 - DNA, 589 bp, Homo sapiens
  misc_feature: GYAE6OF02IY62U.2.39.D06.1.454.CMB.1.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (302)..(302): a, c, t, g, unknown or other
  misc_feature (302)..(302): n is a, c, g, or t
  modified_base (310)..(310): a, c, t, g, unknown or other
  misc_feature (310)..(310): n is a, c, g, or t
  modified_base (364)..(364): a, c, t, g, unknown or other
  misc_feature (364)..(364): n is a, c, g, or t
  modified_base (494)..(494): a, c, t, g, unknown or other
  misc_feature (494)..(494): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtcctccatccctccctgtctgcatcgtgtaggganacagagtcatcatctctggccggcaagtcagntgttagtattttaattaagttgtatcgtagttacaaacgacggaacgcccctaagcctcctgatctntgctgctntacctagttacgaacggtcgggaccctagtacgtaagtcgaggtgcgagtagtntcgaggacagttattcactccgtacacctatctagttacgtacctaactaacctaggtaagttacgtttcgtaaccttaaatttacctacgttactaacgaacttaggtaacgttacccaaccttacccnccgtcttcctacggttcggacgggtacggaccgagggtacgacgtaacgtaccgtaaacgcgttacgggtctaaccgtgaccctagcgtttaccg

SEQ ID NO: 181930 - DNA, 729 bp, Homo sapiens
  misc_feature: GYAE6OF02HS725.2.39.D06.1.454.CMB.1.raw
  modified_base (106)..(106): a, c, t, g, unknown or other
  misc_feature (106)..(106): n is a, c, g, or t
tcagacgctcgacacacgaccggtgctcgatttagtgacatctcgcagttctttgggggagccagtctcagtcaggacacagcatggacagtgacgggtcccccgntcagcctccgtggggcctccctgactactcgtggcctccgagatcgaccagtatggtacgacccaacccgagacgtaccgacccgtacgttccctacccgactcccttcctcgttcctagcctacgttcgttgggtacgggaataccgaggtacctatacctcacgttcctcgtccgggaccggatacgtgtaagtagttagttaagttaattttacgttaagtggtactagtacttaacgaaacgtacggtaaccctacccgtaatcccttagacgtatacgtagtacgtgtacgtaccgttaataccgttaaagttaacggtaccgggtccgtaaccttacgtaacggttacgtgtacgtcggtacgacggttgtaccgttggaacgtactagttacttccgacctacgtctaaccgtagtacgtattacgtactaacgtacgtaattacgttattacctacgttaaccttaacgtataaccgtaacgtaacgtacgtaacgtccgtaaccttacccgcgttaccgtacgttaccgtacggtacggaccgtaggtaaccgggtaagaccgtaactacgaaccgtacggtcgttcggaccgttaccgtcgtacgtattccgg

SEQ ID NO: 181931 - DNA, 722 bp, Homo sapiens
  misc_feature: GYAE6OF02HG7X9.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctgggctcctgctactctggctccgagatgccagatgtgacacccagatgacccagtctccatcctccctgtctgcatctggtaggagacagagtcatcatctacttcggccgggcaaggtcagtagttgttagttaattttaagtttaaattggttataccgtaagtttaccaaaaccggtaggggaaacctaccccgtaaacgtccgtaccttaggtacttacgtattcggtccttacgctaacgttcccgtaaagttttaaccggtaaaggtaccgggggtaccctaagttaccgtaaacgggtttaccgaaggtttcggacgtaggtcggtaacgttcggtacgggaactaacgtttacgtttacctaccgttccgttacaaaccttacgttacgtaacgttacgttaaccttaaccctaaacgttacgtaaacgtttaactttttaccgaccttaaacttacgtacgttacgtactaacgtaagtacgttaaccgtaccttaccccgtaccgtacgttaccttacgttaccggtccggaacgggtaccgtaagggtacgacgtaactaaccgaacgtaacgttggtacgtcgactacacgtacttcg

SEQ ID NO: 181932 - DNA, 667 bp, Homo sapiens
  misc_feature: GYAE6OF02JL1B2.2.39.D06.1.454.CMB.1.raw
  modified_base (182)..(182): a, c, t, g, unknown or other
  misc_feature (182)..(182): n is a, c, g, or t
  modified_base (198)..(198): a, c, t, g, unknown or other
  misc_feature (198)..(198): n is a, c, g, or t
  modified_base (610)..(610): a, c, t, g, unknown or other
  misc_feature (610)..(610): n is a, c, g, or t
tcagacgctcgacacacgaccggtgctcgatttagtgacatctcgcagttctttgggggagccagtctcagtcaggacacagcatggacatgaggtccccgctcagctcctggggctcctgctactctggctccgagatgccagatgtgacaccagactcgacccagtctccactcctcctntctgcatctggtgganacagatcatcatcctcttcggaccggactaagtcaaggtgttagtagttatttaatttaatggtactacgtacgttaccaaacggagggtaaactccccggtaatccgttctacgacttacgttacgtcgactcgaactacgtacgttattaacggaacggttcgggtacccaggttacctaaggttcgacggtcgtacgtagggtactcgttaggtcgggaaactcggtacttacacgttcgtacaaccgtagtaccgtagttacgtaactaacgtaaccgtagtaagttacgtttcgaaccttaacgttactacgtacgaacctaaggtacggtaaccgtacttacccgttacccctcttaccgtaccgttacgtacgggaaccggtcgaaccgggtagtacgggtaacngttaaccgaaggttaacccgtggttaccgccgtaacgtaccggactaccggttaccg

SEQ ID NO: 181933 - DNA, 600 bp, Homo sapiens
  misc_feature: GYAE6OF02GSBJX.2.39.D06.1.454.CMB.1.raw
  modified_base (201)..(201): a, c, t, g, unknown or other
  misc_feature (201)..(201): n is a, c, g, or t
  modified_base (281)..(281): a, c, t, g, unknown or other
  misc_feature (281)..(281): n is a, c, g, or t
  modified_base (293)..(293): a, c, t, g, unknown or other
  misc_feature (293)..(293): n is a, c, g, or t
  modified_base (386)..(386): a, c, t, g, unknown or other
  misc_feature (386)..(386): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatccctccctgtctgcatcgtggtgganacagagtcatcatctctcggccggacagtcagagttgttagttaatttatttaattggtatctagttacaacgaggaacnccctaagcctcngatctatcgctgctatccgtaagttaacaaggtccggtaccagttacgtaaggttcaggtggacaggtgatcgagggactagtacttcactcncacatacagtacgtactaacaacgttgaagtttacgtttacgacttaaacgttactacgtacgtaacaacgtacggttacgttaaccgtaccctacccgttaccgtacttaccgttacgttaccgggacggtacggtaccgtaaggtcgggaacttaacgaaccgtaaacggtacttacgggtgtaaccgtcggtaactaccggttattaccgg

SEQ ID NO: 181934 - DNA, 776 bp, Homo sapiens
  misc_feature: GYAE6OF02FOOKR.2.39.D06.1.454.CMB.1.raw
  modified_base (231)..(231): a, c, t, g, unknown or other
  misc_feature (231)..(231): n is a, c, g, or t
  modified_base (289)..(289): a, c, t, g, unknown or other
  misc_feature (289)..(289): n is a, c, g, or t
tcagacgctcgacacacgaccggtgctcgatttagtgacatctcgcagttctttgggggagccagtctcagtcaggacacagcatggacatgagggtccccgctcagctcctgggctcctgctactctggctccgagatgccagatgtgaccacccagatcgacccagtctccatccctccctgtctgctatctggtgggacacaggagtcatcgatctcgttcggccggntaagtcagaggttgttagttattttaattaattggtatctagttacaaccgaggaacnccccgtaagccgtacctgtactagtatcgtacgtcgactacgttacctagtttaaccgaaacgggttcggggtaccctaagtaccggtaacggttcaggttcggacgtagtggaacgtcggtaggtaccgtagtttactttaccgtactacgtaccgaccttaacgtactaacggttaacgtaccttaaccgtaacccgtaggtaaacgtttacctttacggtaccttaaacccgtttaccgtttaacgttacgtaacccgttaaacggtaacgttaaccggttaacccgttaaaccccgttacccccggtaacccgtttttaaccgtccccgttttaacccggtttaccggggggaaccggttaacccgggtacccgggtaaagggttccggggaaacttaaccgggttaaaccgttaaaaaccggttaccggttacggttaaccggtaccgttaccggaaccgtttacctaacccggtttacccg

SEQ ID NO: 181935 - DNA, 556 bp, Homo sapiens
  misc_feature: GYAE6OF02F38BW.2.39.D06.1.454.CMB.1.raw
  modified_base (199)..(199): a, c, t, g, unknown or other
  misc_feature (199)..(199): n is a, c, g, or t
  modified_base (279)..(279): a, c, t, g, unknown or other
  misc_feature (279)..(279): n is a, c, g, or t
  modified_base (456)..(456): a, c, t, g, unknown or other
  misc_feature (456)..(456): n is a, c, g, or t
tcagacgctcgacacacgaccggtgctcgatttagtgacatctcgcagttctttggggggagccagtctcagtcaggacacagcatggacatgagggtccccgctcagctcctggggctcctgctactctggctccgagatgccagatgtgacacccagatgacccagtcctccatcctccctgtctgcatctgtgganacagagtcatcatctcttgccgggacaagtcagagtgttagtatttaattaaattggtatcattacaaacgagggaaacncccctaaagctcctagtatctatgactgtcaatcctaagtttaacgtaaaggtcgggtacccagtacgtaaggttcaggtcgacgaggtaggatcgtaagggacaagtacgttcactcctacaacctatctagtactactaaccactagaattagtttagactaacgtactacgtanactaaacagtacgtaccactaccctcactctacgttcggacggagaccgaagggtgaatacgtaaccgaagtacgtaggtcgactaggacctactgtacg

SEQ ID NO: 181936 - DNA, 796 bp, Homo sapiens
  misc_feature: GYAE6OF02FIGQD.2.39.D06.1.454.CMB.1.raw
  modified_base (200)..(200): a, c, t, g, unknown or other
  misc_feature (200)..(200): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatcgacccagtctccatccctcctgtctgcatctggtggganacaggagtcactctagttctcgttcggccggggactaacggtcgaggtacggttagtttagtttaactttttaatttaaagtttgggttaattaccgtaaggtttaacccgaaaaccgggtaacgggtaaacccgtacccccgttaaaggtcccttaccgtacgtaactttacgtagtacggtccgtacgtaccttaaccgttacccgttaaagttttaaaccggaacggggttaccgggtacccctaagttaccggtaacgggttcggtaacgggtggtaaccggtagggttacggtaacgttcggtacgggtactaacgtttacttaccgtaccttaccgtaccctaccgtaagtaccgtagggtttaacctaccgtaaactaaccgtaggttaagtttacttcgtaaacgttaaccttacgtacttacgtaactaacggtagttaaccgtacctacccgttaccccgtcgtaccttacgtaaccgggttccgggacgggaacggtccggttaagggtaacggtactaaccggttaaaccgaacggttacgtacgggttaccgtacctaaccggacctttacctacggttaccg

SEQ ID NO: 181937 - DNA, 762 bp, Homo sapiens
  misc_feature: GYAE6OF02G8YQJ.2.39.D06.1.454.CMB.1.raw
  modified_base (61)..(61): a, c, t, g, unknown or other
  misc_feature (61)..(61): n is a, c, g, or t
  modified_base (183)..(183): a, c, t, g, unknown or other
  misc_feature (183)..(183): n is a, c, g, or t
  modified_base (256)..(256): a, c, t, g, unknown or other
  misc_feature (256)..(256): n is a, c, g, or t
  modified_base (485)..(485): a, c, t, g, unknown or other
  misc_feature (485)..(485): n is a, c, g, or t
tcagacgctcgacacacgaccggtgctcgatttagtgacatctcgcgagttcttggggganccagtctcagtcaggacacagcatggacactgacggtccccgctcaggctccgtgggctcctgctacctctaggcctaccgagtatcgaccagatgtcgacacccgagatcgacccagtccnccatcctccgtgtctcgactatcgtggtagggaagtaccaggtactctactcgtactctacgtcggaccgganaacgtactaggtagtttaagtttattaattttaagtttaaagtggtaatacctaagttaaccgaaaacggagggtaaaccctacccgtacgtccttaccgtataactacgtactcggcctagtcctaacttaccggttaaacttaacggacgggttccgtaccctaggttaccgtagtcggaggtggacgtcggtagtaactccgggtagacttagtttaccgttaccncgttaccctaaccgtaaccgtacgtacggttaaaccggttctttaacccgtaaaccgtaaaccgtacgggttaaactttccgttttaaaccgaacccttaaacgtttaaccggttacttaacgtaaaccgaacgttaacggttaaccgtaaaccgtcccgtacccttaccgggtacccttaacgggtccgttacgggggaccgtaacgggtaccgtaagggtcgaaccgtaaactaacggaacgtgtacgggcctacaccgtacgacttattcccgg

SEQ ID NO: 181938 - DNA, 840 bp, Homo sapiens
  misc_feature: GYAE6OF02I740W.2.39.D06.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
tcagacgctcgacacacgaccggtgctcgatttagtgacatctcgcagttctttgggggagccagtctcagtcaggacacagcatggacatggacgggtccccgctcagctcctggggctcctgctactctggctccgagatgccagatgtgaccacccaagatcgacccagtcctaccatccctccctgtcctgctatctggtagganacngacgtcatacatcgttcgttcggccgggactaagtcgtaagtagttagtttagttaattttaagtttaaagttggtattacgtaacggttaaccaaaaccggtaacgggaaaaccgtaccccgtaaaggtccttacccgttagtaaccgttacttaacgtcgaccgttacgacctaacgttaccgttaaacgtttaaccgaaagggttccgggtacctacgtacgtaacgggttctacgggtaggtacgtaaggtaggtacgtaccggttagggacttaacggtactttaccgactacctaccgaacgtacgttacgtacgttaaccgttaccgtaacgtaaccgtagttaaacgttaaacgttttaccgaaccctttaaacgttaacccgttacgttaaaccggaccgttaaacgttacgggtttaaaacccggttaccttaaacccccgttacccccgtacgttaaccccgtttacgggttaaccccggtttagggggtaccccggaacggggttaaccgttaaagggtaacccgggtaacgtaaaccgggttaaaccgtaaaccggttaacccggtcgggtaccgggttacccgtacgtaacccgaccgtttacggttaaccccg

SEQ ID NO: 181939 - DNA, 629 bp, Homo sapiens
  misc_feature: GYAE6OF02FGUPR.2.39.D06.1.454.CMB.1.raw
  modified_base (200)..(200): a, c, t, g, unknown or other
  misc_feature (200)..(200): n is a, c, g, or t
  modified_base (225)..(225): a, c, t, g, unknown or other
  misc_feature (225)..(225): n is a, c, g, or t
tcagacgctcgacacacgaccggtgctcgatttagtgacatctcgcaggttctttgggggagccagtctcagtcaggacacagcatggacatgagggtccccgctcagctcctggggctcctgctactctggctccgagatgccagatgtgacacccagatgacccagtctccatcctccctgtctgcatctggtggganacagagtcatcatctcttgccgggnaagtcagagtgttagtatttattaaattggtatcagttacaaaccgagggaaacgtcccctaaagcctccgtagatactatgtctgcagtcctaagtttaacaaaggttcgggtacccatacgaaggttcagtcggactaggtgattcgtagggaactagtactttccaacttccgtacctacctaagttcctaaggttaacgttacctaaaccaaccgttaggtaaacgtttatttacgaccttaacctttactacttacgtacctaaacgacgttaacgttaaccgtaccttaccccgttaccgaccttaccgtaccgtttccggggaccggtacgggaaccaagggttggaactacgtaacgaaacgtacgtacggtaggacctagacctacctattaccg

SEQ ID NO: 181940 - DNA, 850 bp, Homo sapiens
  misc_feature: GYAE6OF02JWQZA.2.39.D06.1.454.CMB.1.raw
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
tcagacgctcgacacacgaccggtgctcgatttagtgacatctcgcagttctttggggagccagtctcagtcaggacacagcatggacatgagggtccccgctcagctcctggggctcctgctactctggctccgagatgccagatgtgacacccagatgacccagtcctccatccctcctgttccagcatcgtgtaggganacgagcgtacatcactcttccgtggccggactagtacgacgtagtgttagttaattttattttaaaggttcggttattagtacgttacgtaaaccgtaacgggaacgaccccgtaacgtctccgtanattcgttaactgtctacgatacttaccgttagttaacgtaaacgttccggggtacctagtaacgttaaggttaaccggtaggtttaccggtacggagttaacggtcggttacggtacgggtaacgttaacggtaccgtttttacctacgttcccgttaaaccgttaccgtaaaaggtttacccctaaagggttttaccgtaacccgtttaaacggtaaacccgttaaccggttaaagtttacggtttttaaaacccgttacccgttaaaacccttttaaccctaacgttttaacgggtaacccttaaaacgttaccggttaaacgtttaacccgttaaacccgtttccccgttaaccccgttaaaccgtttcccggttacctttaacccggggtacccgggtacgggaacccggttaacggggttaaggtaaaccgtacggttaaaccccggtaaagttaaccggttaccggtaagggtcccttaccggggtaaacccttaaccggtacccgtttaaccgg

SEQ ID NO: 181941 - DNA, 685 bp, Homo sapiens
  misc_feature: GYAE6OF02FOJFP.2.39.D06.1.454.CMB.1.raw
  modified_base (61)..(61): a, c, t, g, unknown or other
  misc_feature (61)..(61): n is a, c, g, or t
  modified_base (102)..(102): a, c, t, g, unknown or other
  misc_feature (102)..(102): n is a, c, g, or t
  modified_base (201)..(201): a, c, t, g, unknown or other
  misc_feature (201)..(201): n is a, c, g, or t
  modified_base (204)..(204): a, c, t, g, unknown or other
  misc_feature (204)..(204): n is a, c, g, or t
  modified_base (227)..(227): a, c, t, g, unknown or other
  misc_feature (227)..(227): n is a, c, g, or t
  modified_base (235)..(235): a, c, t, g, unknown or other
  misc_feature (235)..(235): n is a, c, g, or t
  modified_base (261)..(261): a, c, t, g, unknown or other
  misc_feature (261)..(261): n is a, c, g, or t
tcagacgctcgacacacgaccggtgctcgatttagtgacatctcgcagttctttggggganccagtctcagtcaggacacagcatggacatgaggtccccgntcagctcctggggctcctgctactctggctccgagatgccagactgtgaccacccgagatcgacccagtcctccatcctccctgctgcatctgtggganacngagtcatcgatctctggccgganaagtcagngtgttagtatttattaaagttgtatnagttacaacgaggaactccctaagctactgatctatcgctgactacgtcgtacgttaacgaaggtcggtacctatacgtaaggttcctaggtcgactaggtcgagttcggagggtacagttcttaccgacttacgtctaactacgtcgtaacgtcgtactaacctaaccgtagtaaacgttactttaccgaacgttaaaccctttaacgtaccgttaacgtacgtaaacgtaaggttacccgtttaaccgtaacccttaccccgttacccgttaccttaccggttaacggtttaacccgggacgggttaacggaacccgtaaggggttccggaaacgtttaccgtaaaccgtaaaacccgggtttacgttacgggttaccgggtaaccttaccggtacccgtttaaccccgtaagtttccccgg

SEQ ID NO: 181942 - DNA, 730 bp, Homo sapiens
  misc_feature: GYAE6OF02JBIMR.2.39.D06.1.454.CMB.1.raw
  modified_base (130)..(130): a, c, t, g, unknown or other
  misc_feature (130)..(130): n is a, c, g, or t
  modified_base (142)..(142): a, c, t, g, unknown or other
  misc_feature (142)..(142): n is a, c, g, or t
  modified_base (223)..(223): a, c, t, g, unknown or other
  misc_feature (223)..(223): n is a, c, g, or t
  modified_base (380)..(380): a, c, t, g, unknown or other
  misc_feature (380)..(380): n is a, c, g, or t
  modified_base (477)..(477): a, c, t, g, unknown or other
  misc_feature (477)..(477): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (629)..(629): a, c, t, g, unknown or other
  misc_feature (629)..(629): n is a, c, g, or t
  modified_base (726)..(726): a, c, t, g, unknown or other
  misc_feature (726)..(726): n is a, c, g, or t
tcagacgctcgacacacgaccggtgctcgatttagtgacatctcgcagttctttggggggagccagtctcagtcaggacacagcatggacatgagggtccccgctcagctccgtggggctcctgctactntcggctccgagntgccaggatgtgaccacccagatcgacccagtctccactccctccgtgtctagcattcgtggtagggacgacagtacgttnagtctaacgttcctcggtttacggcccgggacaagtccgaaggtagttagtttaacgtttaagttttaattttaaagtttagggttataccttaaaggttaccaaaaccggtaaacgggaaaccgtaccccgtaaagtcctaccgtatacgttctancggtctacgactctaccgtaaagttaacgtacgggtacgggtaaccctataccggtaaggtctaggtaggcgtaggtacgtagtcgtagggtaaacntttaagttccncttaaccnctaacctagtaccgttaagttacgtaccgttaaccgaaacgttgtaaacgttctttaacggtaaccttaaacttaccgttaactacgtaacgtaaaccgttaaggtaaccgtaaccgttacccgtttaccccnccgttacttacccgttacgttacgggacgggtaccgacggttaaggacggaacgtaacgtaacaacgttagacgggtcgtaacgtcacgtaccgttntacg

SEQ ID NO: 181943 - DNA, 824 bp, Homo sapiens
  misc_feature: GYAE6OF02ILXBN.2.39.D06.1.454.CMB.1.raw
  modified_base (245)..(245): a, c, t, g, unknown or other
  misc_feature (245)..(245): n is a, c, g, or t
  modified_base (778)..(778): a, c, t, g, unknown or other
  misc_feature (778)..(778): n is a, c, g, or t
  modified_base (799)..(799): a, c, t, g, unknown or other
  misc_feature (799)..(799): n is a, c, g, or t
  modified_base (806)..(806): a, c, t, g, unknown or other
  misc_feature (806)..(806): n is a, c, g, or t
  modified_base (813)..(813): a, c, t, g, unknown or other
  misc_feature (813)..(813): n is a, c, g, or t
tcagacgctcgacacacgaccggtgctcgatttagtgacatctcgcagttctttggggggagccagtctcgagtcaggacacaggcatggacatggacgggtccccgctcgagctccgtggggcctcctcgctacctcgtgggtcctaccggagatcggaccctagacgtcggtcgaccacccaggtactcgaaccctagtcctcccgtactccctcctaggtctcgactacgtcgtggaggganaccaggatacctatcgtacttcctcggttacgggaccgggtactaacggttccgaaggttaggtttggtttaacgttaactttttaaggttttaaacggttcgtaacgttactaacggtttaacccgaaaaccggaacggggtaaacccttaccccgtaaggtacccttacgtcgtaaaccttaacgtaagttccgacgttcaccgtaaccgtttaccgtaaacggttttaaccggaacgggtttccgggaacccttacgggtaaccgggttaaacccggttggttaccgggtacggtacggtaacggtcgggttacttacgggaccgggtaacgtacgtttccgttaccgacctactcccgtaaacgttcggtaacttcgttaaacgtaccgttaaaccacgggtttaacgacggtttaacgttacgtaacctaaactttaccgtagccttaaacgacgttaacggtcttaacctaccctccggtactaccttacgtaccgggtcgaccggtacgtaccggtagtacgaacncgtaaacgacgttaacggcgnggtaccnccgaacncgttactaccg

SEQ ID NO: 181944 - DNA, 635 bp, Homo sapiens
  misc_feature: GYAE6OF02FRCOQ.2.39.D06.1.454.CMB.1.raw
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgacacccagatgacccagtctccatcctccctgtctgctatcgtgtggagacagagtcatcatctcgttggccggacaagtcagtagtgtttaagttattttaattaaagttggttatcgtagttacaaaccgtaagggaaacctccccgtaagcctactagacttctagtgtctgctacgttacctaagtttaaccgaaggtccggggtaccctagtaccgtaaggttcgaggtacggcgtaggtacggtatcggtagggactaaggtacttctaacttctaccactaatcgtagttaacgtaccttaacaaccgtagtaacgttgtttaaccgacttaacttacttacgtcgtaactaacgtaacgtacgttaccgaccttaccccgtactacctaccgttcgttaccgggacgggtacggtaacgtaaggtggtaacgtacgtaacgtaacgtacgtagtcgtactcggactaccgtattacg

SEQ ID NO: 181945 - DNA, 825 bp, Homo sapiens
  misc_feature: GYAE6OF02FT1CX.2.39.D06.1.454.CMB.1.raw
  modified_base (62)..(62): a, c, t, g, unknown or other
  misc_feature (62)..(62): n is a, c, g, or t
  modified_base (215)..(215): a, c, t, g, unknown or other
  misc_feature (215)..(215): n is a, c, g, or t
tcagacgctcgacacacgaccggtgctcgatttagtgacatctcgcagttcgtttggggganccagtctcagtcaggacacagcatggacatgacggtccccgctcacgcttccgtggggcctccgtgctactcgtggctccgagatgccaagatgtacgaccacccagtactcgaaccctagttcctacctactcccgttccctagtctgactnttcgtggtacgggacgacgagtacgtcagtctacttcttcgtcggccggatacgtcgtagtacgttagtttagtttaattttaacgtttaaagtttcgttagttacgtacgttaaccgtaaccggtaaacgggtaaacccgtcccgtaaccgtcttaccggtagttacttcgtacttcgtccgtacgacttactaccgttaagttaacgtaacggggttccggttacctaacgttaccggtaacgttacgtacggtacgggtactacggggttatacgggttacggtaccgggaatttacggttacccgttacgtcccgtaccgttaaccaccgttagtaacgttaaacggtttaccctaccggttaaaaccgtaaaccttaggggttaaaacttttcgggtttaaacccttactttaaccgttaaacgttacgttacgtaaaccttaaacgtacgttaacccggtttacctacccccggtttacgtaacccgccttttccgggttacggttacccggggtaccggttaaacgggtaccgtagggtaaccgtagtaaacccggtaacgaggttacgtggtcgttaccgccgtaactccgggttattccgg

SEQ ID NO: 181946 - DNA, 622 bp, Homo sapiens
  misc_feature: GYAE6OF02IMOCG.2.39.D06.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (288)..(288): a, c, t, g, unknown or other
  misc_feature (288)..(288): n is a, c, g, or t
tcagacgctcgacacacgaccggtgctcgatttagtgacatctcgcagttctttgggggagccagtctcagtcaggacacagcatggacatgagggtccccgctcagctcctggggctcctgctactctggctccgagatgccagatgtgaccacccagatcgacccagtcctccatccctccctgtctgcatctggtggganacgagagtnatcatctctcgcggacaagtcagtagttagttagttattttaattaagttgtatctagttacaaacgtaggaaccnccctaagcctcgtagacttctatcgctcgactactacgttaagttacgaaggtccggtaccctagtaccgtaaggttcgagtcgacgtaggtcgtagtacggtaggactagttcttacacctctacacctatacgtagtacgtacctacgtaaacgtagtaagttactttacgaaccttaactttacgttacctaagtaccgtaaagtaacgttacgttaaccgacccttacccaccgtcgtaaccgttccggtacgggaccggtacggacggtagggtacgaacggtactaaccgaagtacgttcggtaccgtagtaccgaccttctagttcc

SEQ ID NO: 181947 - DNA, 839 bp, Homo sapiens
  misc_feature: GYAE6OF02H585B.2.39.D06.1.454.CMB.1.raw
tcagacgctcgacacacgaccggtgctcgatttagtgacatctcgcagttctttgggggagccagtctcagtcaggacacagcatggacatgacgggtccccgctcagcctcctggggctcctgctactctggctccgagtatcgccaaggattggtacgaacaaccccgaggtatacggaacccctaagttcctaccaacttccccttcccgtgttcctcgactaacttcgtgggtagggaagtaaccgtaggtaccgttcaacttcctaattccgttcgttccgggccgggtaactaacggttacgaaggtaggtttagtttaaagtttaaactttttaaaggtttttaaaagttggtaacttacgttaacgttaccgaaaaccggaaaaggtaaaccgaaccccttaaggtcctacgtaacgaacttcgtactacggctacgtacctaacgttaccgtaaaggtttaaacgaacgggtaccgggtaccctaagtaaccggtaacgggttactaacgggtacggtacgtaacggtagtaaccgtgggtaacggtaataccgttactttacctactacctccgaaacctacgtacgttaacgtacgtaaccgtaaactaaaccggtagttaaacgttacgttttaacgaacccgtttaaacctttataaccgtaccgtaactaaacgtaacgttaaacgttaacccgtaaacccttcccggaccttaccggtaaccgtttacggtaccgggtaacggtaacgggaccgtaagggtacgttaacgaaacttaacggtaaaccgcttacgggacgttccgtacaaccgttacgtgttaac

SEQ ID NO: 181948 - DNA, 814 bp, Homo sapiens
  misc_feature: GYAE6OF02INY90.2.39.D06.1.454.CMB.1.raw
  modified_base (193)..(193): a, c, t, g, unknown or other
  misc_feature (193)..(193): n is a, c, g, or t
tcagacgctcgacacacgaccggtgctcgatttagtgacatctcgcagttctttgggggagccagtctcagtcaggacacagcatggacatgagggtccccgctcagcctcctggggctcctgctactctggactccgagatgccagatgtcgacaccagtatcgacccagtctccactcctcctgtctagcntctgtggacacgagagtcactcatctctgccggacagtcagagttgttagtatttatttaagttgtactcacttacaaccgtagggaaccaccccgtacgccgtacctaggtacctagtaactcgcgttacgccgtaacgttcccgttaaacggttttaaccggtaaaaggttccggggttacccctaagttaacccgggttaaacggttcgtacgggttaaccggtaccgttaaacgggttcgtaacggttccgtaacggggtaaccgtaaacggtttacgtttacctaacgttcccgtaacccgtaaccaacggtttaaccgtaacgtttaaacccgttaaccgttaaaccgtaaccgttaaacggttaaacgtttagtttttaaccgtaaccgtttaaacccgttttaccgtaaacttaaccgttaacgtaaaccgtaacggtttaagttacccgtaaccgtttaccccgtacccgttaccgttccttaacccggttttacccgggaccgggttacggtaaaccccggttagggtaaccggtaaccgttaacgtaaccgtaaacggttacccgtacgggttaccgtaccggtacctacccgtaccgttacctttccgg

SEQ ID NO: 181949 - DNA, 890 bp, Homo sapiens
  misc_feature: GYAE6OF02H9MNB.2.39.D06.1.454.CMB.1.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
tcagacgctcgacacacgaccggtgctcgatttagtgacatctcgcagttctttgggggagccagtctcagtcaggacacagcatggacatgacgggtccccgctcaggctcctggggcctcctgctactctggctaccgagatgcagatgtgacaccagatgacccagtctaccatccctccgtgtacctgcatccgtgtgggagacaggataccatacagttctcgttcggaccgggtanaacggtntaacgaggtttaggtacgttaaattttaattttaaaaggttggtaaacttacgtaaacgttacaaaacgaacgggtaaaacaccccgttaaagtccttaaccgtaccgttagacctttaacacgtaccgttagaccgttaacttacccgttaagtttaaaacccgggaaaaagttcccggggggtaaccccttaagtaacccgtaaagggttttcgaacccggtagggttaaccgagtttaacgggggtaaatcctttaaccggggggaattaaaggggtttaaccctttacgttaaccggtaacctttaaccggaaccttaacgtacttaaaggttaacgtttacccgtaaacccggttaaaccgtaactaaagggtttaaccttttacgtaaacccgttaaaaccttaacgttaaacccacccggttaaacttaacggaaaacggtttaagggttaaaccctttaaccccgtaaaacccttccggttaacccttaaacggtacccgttttaaccggggacccgggtaaacgggttaaccggttaaacggggtaacggtaagtaaacccggtaacgtaaaaacgttaccgggacgttaaccgggtacgttacgaaacccggtaccttaacgttaacccgg

SEQ ID NO: 181950 - DNA, 602 bp, Homo sapiens
  misc_feature: GYAE6OF01E50EY.19.69.G03.1.454.CMB.1.raw
  modified_base (346)..(346): a, c, t, g, unknown or other
  misc_feature (346)..(346): n is a, c, g, or t
tcagtactctcgtgcacgaccggtgctcgatttagtcgctgcgtaaaggagaaaggggacccaaaaccacacccctccttgggagaatcccctagatcacagctcctcaccatggactggacctggagcatccttttcttggtggcagcagcaacaggtggccactcccaggttcagctggtgcagtctggaggtgaggtgaagagccgtggggcctcagtgaaggtctcctgcaggcctctggttacacctttgccagtattcggatcgagcgtgggtcgccgacgacggcccctgggacgaagggtcttggaggtggagtgggatggatcgacgtacccttaanaatagaataaccacactaactatacgacaacagaactccgtaccgacgggccagtaccacatacgaaccacacgacacactaccaacgacctacacgtacctacgagtggacgcgtaggagtagtcgagacgaccgtaccgagaaccgacgtactaattatagttagtgacgacgtacgtacgtacttacccggtaagttacggttaaattttggttttacggacgtttaggttacgttcggtcgtttaaaccggg

SEQ ID NO: 181951 - DNA, 788 bp, Homo sapiens
  misc_feature: GYAE6OF01DAY57.19.69.G03.1.454.CMB.1.raw
tcagtactctcgtgcacgaccggtgctcgatttagtcgctgcgtaaaggagaaaggggacccaaaaaccacacccctccttgggagaatcccctagatcacagctcctcaccatggactggacctggagcattccttttcttggtggcagcagcaacgaggtcggccactcccaggttccagctggtgcagtcgtggaggtgaggtgaagagccgtggggcctcgagtgaacggtctccgtgacgaaggtcctcgttggttacctaccgtttcggacctaggtacgtttacggtatcgtacggtcgtgggtcgtacgaccgacggtccccgtaggaaccgaagggtcttaggacggtggagtacggagtggatccgaacgtaccgtttaacaagttcgaaaacgtaacaacctacgtactaacgtacgactaacgaacggtacctaccggtaccgacggggtaccgacttacccgaacgacgtaccggaacccaacgaaccgaactaccgaacttaccgtaaccgtacctaacgcccgtaaccgtaagagtaccggtaagtccggtaaggtacgtacggttacgaacggtaccggtaaccgtacccggaaccggtaacccgtaacccggtacttaaacgtttaacgttaacctttttaggggtaccgttaccggaacgggttaacggttactaacccgtttacccggttaagttaacccgggtttttaaattttccggtttaacgggtactttagggtttacttcccgggttaacgtttaaaccgggg

SEQ ID NO: 181952 - DNA, 637 bp, Homo sapiens
  misc_feature: GYAE6OF01AWR2I.19.69.G03.1.454.CMB.1.raw
  modified_base (398)..(398): a, c, t, g, unknown or other
  misc_feature (398)..(398): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagcctggggcctcagtgaaggtctcctgcaaggcctctggttacacctttgccagattcggtatcagctgggtgcgacaggccctggacaaggggcttggagtggagtgggatgggatcgagtcccttaacaattgataacgacacactatagcacagaaatcgtaccagggaccgagtcgaccatgaccanacgacaacactactacgactacagacctacagtaggacgccttaggagtagtaccgtagaacgacgttacccggaacgtaccgaaccgggtaccctaattacgtaagtttaacgttacggttaggtacccggtaaaggtacggttaaccttaccccgtaaacgttaccgggttaaatttttaacggtttttacgggtaacgttttagggtttaacttacggggtaccgtttaaaccggg

SEQ ID NO: 181953 - DNA, 642 bp, Homo sapiens
  misc_feature: GYAE6OF01BPGGV.19.69.G03.1.454.CMB.1.raw
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagccgtggggcctcagtgaaggtctcctgcaaggcctcgtggttacacctttgcctagtattcggtatcagtcgtgggtncgacgacggcccctggacaagggtcttaggagtggagtgggatggatcgacgtcccttanaagtcgaataaccacacactatgacacgagaactccgtaccgacgggccgagtaccaccagtacgaccacacgacacatacctacgactaccacgtaccctaacgagtcggagtcgtaggacggtacgtcgtaggaacgtacgtaccggaaccgaaccgaccggtacctaattaacgttatttacggttacggtacggacgtaaggtacgttacctttacccggtaagttacgggttaaatttttacggtttttacggaacgtttagggtttaacgtgggttaccgtttaaacggg

SEQ ID NO: 181954 - DNA, 615 bp, Homo sapiens
  misc_feature: GYAE6OF01BAPDT.19.69.G03.1.454.CMB.1.raw
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttctggtggcagcagcaacaggtggccactcccaggttcagctggtgcagtctggaggtgaggtgaagaagccgtggggcctcgagtgaagtctcctgcaaggcctcgtaggttaccaccgtttgccgtagtattcggtatcgagtctagggtgcgacacggtccccgtagggacaagggcttggaggtggagtgggatggatcgtacggacccttaanaatgaactaacacacactatcgacacagaactcnccgaggccagtcacatcgaccanacgacacactactaacactacgactaccanagtaggactacgtaggacggtatcgtagtacgactaccgaacgtaaccgacggtactaattacttaagttagtacggtacggtacgaggtacgttacgttacccgtaagttaccggttaaattttacggttttcgggtaactttagggtttacgtccggttacgttaaccggg

SEQ ID NO: 181955 - DNA, 769 bp, Homo sapiens
  misc_feature: GYAE6OF01C12DB.19.69.G03.1.454.CMB.1.raw
  modified_base (220)..(220): a, c, t, g, unknown or other
  misc_feature (220)..(220): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagctatccttttcttggtggcagcagcaacaggtggcccactcccaggttcagctggtgcagtctggaggtgaggtgaagagcgtgggcctanagtgaaggtctcctgacaaggcctcgttcggttactacctttgccagtattcggtatcgagcgtgggtgcgacgacggcccctaggacgaagggtcttaggagtaggagtaggggatacgggattcgaacggtcctttaaacgaatagaaactaacacaaccactacgtagaccaacgaagtaacttacccgtacccggaacggggtacccgggtaactacccggaacctaacgtacgaacccgaaaccgaacggaacccaaaccttaacgtaaacccgttaacccgtaaaccgtaactaaacccggtaccctaacgtaaccggtacggttaacggacggttaccgggtaaggggttacgtaccggtagtaaacggacccgtaacccggaaaccgtaccgaaccgggtaccttaacgttagtttaaacgtttagttaacggtggtaactacggtaacgttaacccgttacgtaaacggtttacggtttaaatttttcgggtttttaacggtacggtttggttttaaactggtttaaccggttaaccggg

SEQ ID NO: 181956 - DNA, 801 bp, Homo sapiens
  misc_feature: GYAE6OF01D15QK.19.69.G03.1.454.CMB.1.raw
  modified_base (82)..(82): a, c, t, g, unknown or other
  misc_feature (82)..(82): n is a, c, g, or t
  modified_base (407)..(407): a, c, t, g, unknown or other
  misc_feature (407)..(407): n is a, c, g, or t
tcagtactctcgtgcacgaccggtgctcgatttagtcgctgcgtaaaggagaaagggacccaaaaaccacaccctcttgganaatcccctagatcacagctcctcaccatggactggacctggagcattccttttcgttggtggcagcagcaacgaggtcgccactcccgaggttcagctggtgctagtcgtggaggtgaggtacgaagacgccgtggggcctagaggtagaacggttcctccgtagaccgaaggtcccttacgttacggttacctaccgtttgacctagtacgtttcggtatcgagtccgtgggtcgacggacgtacggtccccgtaggacgaacgggttcgtaggaggtagggtaggtagggtagtagggacttacgtaccgtacccctttaaanaacggttagaaaacctaacgaacctacgtaactacgtcggaacaacgaacgtacttaccggtacggaccggggacctaaggtaaccaacgtacgtaaccgaaccaacgaaccgtaaccctaagtaacctttaacccgaaccgtaacccttaacgaacccgtaacccgtaagtacggtacgggaccgtaacggttaggaacggttactagggacgtaaacggtacccggtaaccggaaccgggtacgaacccgggttaacctaatttaacgtttaggttacgttagggtacggtaacggtaacgtaaacccggttaccgttacccgtaagtttaacggtttaattttacgggtttacggtaacgtttaggttacggtacgttccggttaaacggg

SEQ ID NO: 181957 - DNA, 582 bp, Homo sapiens
  misc_feature: GYAE6OF02G0EJN.19.69.G03.1.454.CMB.1.raw
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagcctggggcctcagtgaaggtctcctgcaaggcctctggttacacctttgccagattcggtatcagctgggtgcgacaggcccctggacaagggcttgagtggatgggatggatcagccttacatgataacacacactatgcacagaatctaccgagggaccgacgtcaccatacgacccacacgaccacactcctacgactacacgacctacataggacgctggaggacgtcgtagacgtagtacccgaacgaccgaccggacctaagttattaacgtttagttaggtacgacggtagtacgtaactttacccgagttaccggtaattttaggtttttacggtactttagggtttacttcgggtacttaaccgg

SEQ ID NO: 181958 - DNA, 624 bp, Homo sapiens
  misc_feature: GYAE6OF02GVF1E.19.69.G03.1.454.CMB.1.raw
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagccgtggggcctcgagtgaaggtctcctgcaaggcctcgtggttacacctttgccagtattcggtatcagccgtgggtcgcgacgacggcccctggaccaaggggcttggaggtggagtggggatgggactcgacgtacccttanaatgaactaacacactactangacactagaactctaccgagggaccgacgtccaccagtacgaacccacaacgaccaacgtactaccgtaacgacctacgacgtaccctacaggtacggacgtcgtaggaaggtactcgtagaacgtacgtacccggaacgtaccgaaccgaccttaagtacttagtttatacggtagagacgtactacgttacccaaggttacgttaattttacgtttaggtacctttaggtttacgtaggttactaacgg

SEQ ID NO: 181959 - DNA, 629 bp, Homo sapiens
  misc_feature: GYAE6OF02JDJ5B.19.69.G03.1.454.CMB.1.raw
  modified_base (282)..(282): a, c, t, g, unknown or other
  misc_feature (282)..(282): n is a, c, g, or t
  modified_base (463)..(463): a, c, t, g, unknown or other
  misc_feature (463)..(463): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagccgtggggcctcagtgaaggtctcctgcaaggcctctggttacacctttgccagattcggtatcagcgtgggtncggacacggcccctggacgaaggtcttgaggtggagtgggatggatcgaggtcccttaacgaagtgtaacgtaacactaacaccttaagtcggacaacagtaatccgtaccgacggggccgagtaccacctagtacgaacccacgaacgaacacaactcctaccgactaccgactccctanacgtggacgcgtaggaggtagtcgtagaacgacgtacccggaacgacgaaccggactaactactttaagtagttaggtagacggacgtaacgtacttaacccgaggttaccgttaagttttacggttttcggtacgtttaggtttacgtacggtaccgtttaacgg

SEQ ID NO: 181960 - DNA, 639 bp, Homo sapiens
  misc_feature: GYAE6OF02HA39Z.19.69.G03.1.454.CMB.1.raw
  modified_base (335)..(335): a, c, t, g, unknown or other
  misc_feature (335)..(335): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagcctggggcctcagtgaaggtctcctgcaaggcctctggttacacctttgccagattcggtatcagctgggtgcgacaggcccctggacaagggcttggagtggatggggatgggatcgagcccttanaatgataacacacactatgcacagtaatctaccgagggccgagtccacctatcgaccacgacgacacactctacgactaacagtaccctacagtacggacgtcgtaggacggtacgtacgtcggagacgtacccggaaccgaaccgaaccgggtaccctaaattacgttaaattttagttggttacgacggtaacggtaacggttaacgttttaccccgaagtttacccgggttaaatttttaacggtttttttacgggtaacgttttaggggttttaacgttacgggttacgtttaacccggg

SEQ ID NO: 181961 - DNA, 615 bp, Homo sapiens
  misc_feature: GYAE6OF02GPMQR.19.69.G03.1.454.CMB.1.raw
tcagtactctcgtgcacgaccggtgctcgatttagtcgctgcgtaaaggagaaaggggacccaaaaaccacacccctccttgggagaatcccctagatcacagctcctcaccatggactggacctggagcatccttttcttggtggcagcagcaacaggtggccactcccaggttcagctggtgcagtctggaggtgaggtgaagaagccgtggggcctcagtgaaggtctcctgcaaggcctctggttacacctttgccagattcggtatcagcgtgggtgcgacacggcccctgggacaagggcttaggaggtggagtgggagtggatcgacgtccctagaagtgactaacactacactatcgacaacgagtaactcgtaccggagggcccgagtccaccatacgaaccacacgaaccacactcgaaccgaactaacacgacctagatcgggactcgaggaacgtcgtacgagtacgacgtcccggaagaccgaccggtactagttaacgttagttatggtacgacgtaacgtaagtaccttaccgtagttaaccggttaagttttacgttttagggacgttttagggttaacttacgggttaccttaacggg

SEQ ID NO: 181962 - DNA, 654 bp, Homo sapiens
  misc_feature: GYAE6OF02GM9YQ.19.69.G03.1.454.CMB.1.raw
  modified_base (279)..(279): a, c, t, g, unknown or other
  misc_feature (279)..(279): n is a, c, g, or t
  modified_base (376)..(376): a, c, t, g, unknown or other
  misc_feature (376)..(376): n is a, c, g, or t
tcagtactctcgtgcacgaccggtgctcgatttagtcgctgcgtaaaggagaaaggggacccaaaaaccacacccctccttgggagaatcccctagatcacagctcctcaccatggactggacctggagcattcctttttcttggtggcaggcagacaacagggtcggccacctccctaggttcagctggtgcagtctggaggtgaggtagaagagcgtgggcctgagtgaggtctctgacacggtcctcgtgttactaccttgccagtagttcggtancagcgtaggtgcgacgacggtccctaggacgtaaggtctaggtaggtaggagtggatggactcgacgtcctaatagtacgactaacactacacttanacgacaacgagactaccgtacggacggacccgtataccaactacgtaaccgaccaacgaactaacacctactaccgtaaccgaacctacaacaccgtacgaggttacgacgtgaggtaggtagtaccgtagaacgtaccgtacgaccgtacgaccgacttaacttaagttacttaagtagtagtacggtacgtaacggttacctaccggtacgtttaaccgttaagttttacgttttacgggtacgtttacggtttaggttacggtacctttaacggg

SEQ ID NO: 181963 - DNA, 324 bp, Homo sapiens
  misc_feature: GYAE6OF01AX3TD.22.14.B03.1.454.CMB.1.raw
  modified_base (317)..(324): a, c, t, g, unknown or other
  misc_feature (317)..(324): n is a, c, g, or t
tcagacatacgcgtcacgaccggtgctcgatttagtgtgagtagttccgcggacgaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacgagcggccctgggctgcctggtcaaggactacttccacgcgtatgtctgagcgggctggcaaggcgcatagnnnnnnnn

SEQ ID NO: 181964 - DNA, 322 bp, Homo sapiens
  misc_feature: GYAE6OF01D8X7W.22.14.B03.1.454.CMB.1.raw
  modified_base (310)..(310): a, c, t, g, unknown or other
  misc_feature (310)..(310): n is a, c, g, or t
  modified_base (316)..(322): a, c, t, g, unknown or other
  misc_feature (316)..(322): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggccgccctgctccaggacgcacctccgagagcacagcggccctgggctgcctggtcaaggctacttccacgcgtatgtctgagcgggctggcaggcncatagnnnnnnn

SEQ ID NO: 181965 - DNA, 515 bp, Homo sapiens
  misc_feature: GYAE6OF01CIL3R.22.14.B03.1.454.CMB.1.raw
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (447)..(447): a, c, t, g, unknown or other
  misc_feature (447)..(447): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccgggtccctgaccgattcagtggcaggcgggtctggggacagtatttcactctcaccatcagcagcctgcaggctgaagntgtgctagtttntattgcagcaatattatacttcctctnagtcgttcggaccaagggcctaagggtcgaaactcgaaaacgtacgtgtacggactcgcctacctacg

SEQ ID NO: 181966 - DNA, 293 bp, Homo sapiens
  misc_feature: GYAE6OF01CXAMS.22.14.B03.1.454.CMB.1.raw
  modified_base (287)..(293): a, c, t, g, unknown or other
  misc_feature (287)..(293): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggctagtttattattgtcagcaatattatattcctcctcagacgttcggccaagggaccaaggtgaaatcaaacgactgtggctgcaccatctgtcttcatcttcccgcatctgaacgcgtatgtctgagcggctggcaaggcgcatagnnnnnnn

SEQ ID NO: 181967 - DNA, 503 bp, Homo sapiens
  misc_feature: GYAE6OF01DOF3Q.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccggaatccggggtcctgaccgattcagtggcagcgggtctgggacagatttcactctcaccatcagcagcctgcaggctgaagatgtgctagtttattactgtcagcaattattatattcctctcagtacgttcgaccaagggaccaagggtgaaatacaaacgaactgtagactgccactacg

SEQ ID NO: 181968 - DNA, 535 bp, Homo sapiens
  misc_feature: GYAE6OF01DWFDB.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcattactgggctctacccgggaatccggggtccctgaccgattcagtggcagcggtctgggacagatttcactctcaccatcagcagcctgcaggctagaagatgtgctagtttattattgtcagtctaattattatacttccctacctcagtaccgttcggaccgtaaagggtaccctaaagggtacggaaaactaccgaaaacgtacgtaggtacggactacgcaccgtacg

SEQ ID NO: 181969 - DNA, 504 bp, Homo sapiens
  misc_feature: GYAE6OF01B1ZUH.22.14.B03.1.454.CMB.1.raw
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcagctgaagatgtggctagtttatactgtcagcaatattatattcctcctnagacgttcgaccaagggaccaaggtacggaaatcaaacgaactgtggactgcaccgta

SEQ ID NO: 181970 - DNA, 531 bp, Homo sapiens
  misc_feature: GYAE6OF01DCL0R.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtgctagtttatattgtcagactaatattattacttccctctcagtaccgttcggaccgaagggaccaaagggttcggaaaattccgaaaacgaacgttggtacggcttacggccaaccgtaacg

SEQ ID NO: 181971 - DNA, 551 bp, Homo sapiens
  misc_feature: GYAE6OF01B67BP.22.14.B03.1.454.CMB.1.raw
  modified_base (407)..(407): a, c, t, g, unknown or other
  misc_feature (407)..(407): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtgcagcgggtctgggacagtatttcactctcaccatcagcagcctgcaggctagaagtntgtggctaagtttattattgtacagtactaattattatacttccctacctacaggtaccgtttccggaccgtaaacggggaccctaaagggtaggaaaactaccgaaaaacgacgttggtacggaccttggcccaacccgtacg

SEQ ID NO: 181972 - DNA, 543 bp, Homo sapiens
  misc_feature: GYAE6OF01ECA5P.22.14.B03.1.454.CMB.1.raw
  modified_base (411)..(411): a, c, t, g, unknown or other
  misc_feature (411)..(411): n is a, c, g, or t
tcagacatacgcgtcacgaccggtgctcgatttagtgtgagtagttcagcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagtatttttacagctccaccaataagagttactagcttggttccagcagaaaccaggacatcgtcctgcactgctcatttactgggcgtcgtacccgggactcccgggtcctgaccgtattcagtcggcaggcgggtcgtgggacagtatttcactctcaccatcagcagcctgcaggctagaacgntgtggctaggtttatgttgtacagtctaagttattatactttccctactcgacgtaccggttcggaccgtaaagggaccctaagggttacggaaactacgaaaacgtacgttggtacggcttcgcctaaccg

SEQ ID NO: 181973 - DNA, 504 bp, Homo sapiens
  misc_feature: GYAE6OF01CEHBX.22.14.B03.1.454.CMB.1.raw
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccggggtccctgaccgattcagtggcagcgggtctgggacagatttcactctcaccatcagcagccctgcaggctgaagntgtggctagtttatattgtcagcaatattatattcctctnagtacgttcggacctaagggaccaaggtgaaatacaaacgactgtaggctgcacctag

SEQ ID NO: 181974 - DNA, 321 bp, Homo sapiens
  misc_feature: GYAE6OF01D8M8Y.22.14.B03.1.454.CMB.1.raw
  modified_base (316)..(321): a, c, t, g, unknown or other
  misc_feature (316)..(321): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnnn

SEQ ID NO: 181975 - DNA, 646 bp, Homo sapiens
  misc_feature: GYAE6OF01CETYW.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctcccgtggctgtgtctcgtgggcgaggagggcccaccatcaactgacaacgtccacgccagtagtttatttttacagctccaaccaataagagttacttagcttggttccagcaagaaaccaggacatcgtcctgcactgctctatttacgtgggcgtccgtacccgggaacgtcccggggtccctcggaccgtacttcgaggtcggcgaggtcgggtcgtagggacagtactttcactctcacctatcagcacgcctgcaggtctaggaagtgtggtcggacttaggttttattattcggtacaaggtactaaagtttatttaagttacctttcccctaccttacgtaacggttacccggtttccgggaacccgtaaaacgggggtaccctaaaggggttaacggtaaaaccgtaaccgaaaaaccggttaacgtagggttaccgggacttcggaccctaacccgttaacg

SEQ ID NO: 181976 - DNA, 531 bp, Homo sapiens
  misc_feature: GYAE6OF01D1YEH.22.14.B03.1.454.CMB.1.raw
  modified_base (302)..(302): a, c, t, g, unknown or other
  misc_feature (302)..(302): n is a, c, g, or t
  modified_base (361)..(361): a, c, t, g, unknown or other
  misc_feature (361)..(361): n is a, c, g, or t
  modified_base (461)..(461): a, c, t, g, unknown or other
  misc_feature (461)..(461): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctnatttactgggctctacccgggaatccggggtccctgaccgattcagtggcagcgggtcngggacagtattcactctcaccatcagcacgccctgcagtcctgaagtagtggtcggctagttttattagttgtctagctaattatttatacttcctctanacgtacgttcggaccaagggtaccaaggtacggaaactacgaaacgacgtggtacgactcgctacctacg

SEQ ID NO: 181977 - DNA, 522 bp, Homo sapiens
  misc_feature: GYAE6OF01B473B.22.14.B03.1.454.CMB.1.raw
  modified_base (410)..(410): a, c, t, g, unknown or other
  misc_feature (410)..(410): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccggggtccctgaccgattcagtgcagcgggtctgggacagatttcactctcactatcagcacgtcctgctacgtcgtagaagngtgtgacttagtttattagttgtacagactaattattattacttcctactcacgtacgtcgacgaggtaccgtaaggtagaacacaaacgtacgtgacgancgaccnctacg

SEQ ID NO: 181978 - DNA, 517 bp, Homo sapiens
  misc_feature: GYAE6OF01BO6DQ.22.14.B03.1.454.CMB.1.raw
tcagacatacgcgtcacgaccggtgctcgatttagtgtgagtagttccgcggggagctacaacaggcaggcaggggcagcaagatggtgttgcagacccaggtctccatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccgggaatccggggtccctgaccgattcagtggcagcgggtctgggacagattcactctcaccatcagcagcctgcaggctgaagatgtggctagtttatattgtcagctaaagtattatattccctctacagtacgttcggaccaaagggaccctaagggtacggaaataccgaaaacgactgtaggactgcaccgtag

SEQ ID NO: 181979 - DNA, 314 bp, Homo sapiens
  misc_feature: GYAE6OF01BAYOF.22.14.B03.1.454.CMB.1.raw
  modified_base (314)..(314): a, c, t, g, unknown or other
  misc_feature (314)..(314): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacagcggccctgggctgcctggtcaaggctacttccacgcgtatgtctgagcgggctggcaaggcgcatagn

SEQ ID NO: 181980 - DNA, 322 bp, Homo sapiens
  misc_feature: GYAE6OF01C71DY.22.14.B03.1.454.CMB.1.raw
  modified_base (316)..(322): a, c, t, g, unknown or other
  misc_feature (316)..(322): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnnnn

SEQ ID NO: 181981 - DNA, 506 bp, Homo sapiens
  misc_feature: GYAE6OF01A0VTA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagccctgcaggctgaagatgtggctagtttattattgtcagcaatattatattcctctcagaccgttcggaccaagggaccaagggtggaaatcaaacgactgtggactgcaccta

SEQ ID NO: 181982 - DNA, 522 bp, Homo sapiens
  misc_feature: GYAE6OF01D6P82.22.14.B03.1.454.CMB.1.raw
  modified_base (400)..(400): a, c, t, g, unknown or other
  misc_feature (400)..(400): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccggaatccgggtccctgaccgattcagtggcagcggtctgggacagattcactctcacatcagcagcctgcaggctgaagntgtgctagttttatattgtcagtctaattattaatacttcctcctcagtacgttccggaccaaggggaccctaagggtggaaaactaccgaaaacgaactggtacggacttgaccacctaag

SEQ ID NO: 181983 - DNA, 504 bp, Homo sapiens
  misc_feature: GYAE6OF01DTE6L.22.14.B03.1.454.CMB.1.raw
  modified_base (363)..(363): a, c, t, g, unknown or other
  misc_feature (363)..(363): n is a, c, g, or t
  modified_base (399)..(399): a, c, t, g, unknown or other
  misc_feature (399)..(399): n is a, c, g, or t
  modified_base (500)..(500): a, c, t, g, unknown or other
  misc_feature (500)..(500): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtatttttacagctccaccaataagagttactagcttggttccagcagaaaccaggacatcgtcctgcactgctcattactggcgtctacccggaatcccgggtcctgaccgatcgagtggcagcggtctgggacngatttcactctcacatcagcagcctgcaggctgaanagtgtggctagttttattagttgtcagcaatattatattcctctacagtcgttcggacaagggacctaaggtggaaaatccgaaaagactgtagactgccncgta

SEQ ID NO: 181984 - DNA, 320 bp, Homo sapiens
  misc_feature: GYAE6OF01CCSMQ.22.14.B03.1.454.CMB.1.raw
  modified_base (316)..(320): a, c, t, g, unknown or other
  misc_feature (316)..(320): n is a, c, g, or t
tcagacatacgcgtcacgaccggtgctcgatttagtgtgagtagttccgcgggcaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnn

SEQ ID NO: 181985 - DNA, 540 bp, Homo sapiens
  misc_feature: GYAE6OF01AE6A6.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggatccgggtccctgaccgattcgagtcggcaggcgggtctgggacagtatttcactctcaccatcagcagcctgcaggctgaagatgtgctagtttatactgtcagtctaattattattacttccctacctctaagtccgttccggaccgtaacgggaccaagggttacggaaacttaccgaaaacgtacgtaggtacggactcgacctaccgtacg

SEQ ID NO: 181986 - DNA, 509 bp, Homo sapiens
  misc_feature: GYAE6OF01D3V39.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccgggaatcccgggtcctgaccgattcagtggcagcgggtctgggacagatttcactctcaccatcagcagcctgcaggctgaagatgtgctagtttatattgtcagtcaattattatacttcctcctcagtacgttcgaccaagggacccaagggtgaaactcgaaaacgactgtacggcttgcacgtac

SEQ ID NO: 181987 - DNA, 560 bp, Homo sapiens
  misc_feature: GYAE6OF01EBCAH.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctcgtacccgggaatccgggtccctgaccgattcagtggcaggcgggtcgtgggacaggatttcgactcctcaaccatcaagcagccctgcaggctagaagatggtgacttagtttattattgacaagtcaaattatttatactttccctacctcgtaacgtaccgtttccggacctaaacgggggtaccctaaagggtggaaaactccgaaaacgaccgttggtcggaccttggacctaaccgtacg

SEQ ID NO: 181988 - DNA, 563 bp, Homo sapiens
  misc_feature: GYAE6OF01AJ2Z4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagccctgcaggctgaagatgtgctagtttatattgtcagcaattactttatactttcctaccttcacggtaccgtttccgggaccctaaacgggggtacccaaagggttacggaaaagttacccgaaaaacggaaccgttaggtacgggtaccttcgggaacctacccgtaaac

SEQ ID NO: 181989 - DNA, 321 bp, Homo sapiens
  misc_feature: GYAE6OF01CQ3YW.22.14.B03.1.454.CMB.1.raw
  modified_base (316)..(321): a, c, t, g, unknown or other
  misc_feature (316)..(321): n is a, c, g, or t
tcagacatacgcgtcacgaccggtgctcgatttagtgtgagtagttccgcgggcaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnnnn

SEQ ID NO: 181990 - DNA, 514 bp, Homo sapiens
  misc_feature: GYAE6OF01ERPD0.22.14.B03.1.454.CMB.1.raw
  modified_base (405)..(405): a, c, t, g, unknown or other
  misc_feature (405)..(405): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctaccgggaatccgggtccctgaccgattcagtggcagcgggtctgggacagattcactctcaccatcagcagctgcaggctgaagatgngctagtttatattgtcagcaattattattattcctctcagtaccgttcggacctaagggaccctaagggtacggaaatacgaaaacgactagtacgactcgcacctacg

SEQ ID NO: 181991 - DNA, 556 bp, Homo sapiens
  misc_feature: GYAE6OF01BR5FB.22.14.B03.1.454.CMB.1.raw
  modified_base (311)..(311): a, c, t, g, unknown or other
  misc_feature (311)..(311): n is a, c, g, or t
  modified_base (410)..(410): a, c, t, g, unknown or other
  misc_feature (410)..(410): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactgctcatttacngggcgtcgtacccggatccgggtccctgaccgattcagtggcaggcgggtgtgggacagtattccactctcaccatcagcagccctgcaggctagaagntgtggctagttttatattgtcagtactaattattattacttccctctactaggtaccgttccggaccgtaaaggggaccctaaagggtaggaaaacttaccgaaaacggtaacgttggtacggacttacggaccctaaccgtaacg

SEQ ID NO: 181992 - DNA, 635 bp, Homo sapiens
  misc_feature: GYAE6OF01CVMLA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctctatttactgggtcgtcgtacccgggaatcccgggtcctcgaccgtattcaggtgcgaggcgggtctgggacagtattcactcgtcaccatcagcagccctgcgaggtctaggaacgtagttcggtaggtccttaagttttacgtttacttggttaccaaggtacttaaacgttaatttaacgttacttttaccccgttacctaccttaaggtaccccggtttaccgggaaccccgtaaacggggaaacccgtaaagggttaacgggtaaaaacctaccgtaaaaaaccggacgttacgggttaacggaccttacgacccgtaaccgttaaccg

SEQ ID NO: 181993 - DNA, 520 bp, Homo sapiens
  misc_feature: GYAE6OF01DIFBU.22.14.B03.1.454.CMB.1.raw
  modified_base (408)..(408): a, c, t, g, unknown or other
  misc_feature (408)..(408): n is a, c, g, or t
  modified_base (429)..(429): a, c, t, g, unknown or other
  misc_feature (429)..(429): n is a, c, g, or t
  modified_base (509)..(509): a, c, t, g, unknown or other
  misc_feature (509)..(509): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaatagattactagcttggttccagcagaaaccaggacatcgtcctgcactgctcatttactgggcgtcgtacccgggaatccggggtccctgaccgattcgagtggcaggcgggtctggggacagatttcactctcaccatcagcagccctgcaggctagaagntggtgctagtttattattgtnagtactaattattatacttcctctcagtacgttccggaccaagggaccaagggtagaaactacaaacgaacttggtacgntcgctccgtac

SEQ ID NO: 181994 - DNA, 319 bp, Homo sapiens
  misc_feature: GYAE6OF01D1G3O.22.14.B03.1.454.CMB.1.raw
  modified_base (315)..(319): a, c, t, g, unknown or other
  misc_feature (315)..(319): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnnnn

SEQ ID NO: 181995 - DNA, 636 bp, Homo sapiens
  misc_feature: GYAE6OF01EKMPM.22.14.B03.1.454.CMB.1.raw
tcagacatacgcgtcacgaccggtgctcgatttagtgtgagtagttccgcgggggaggctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttaagcttggttaccagcaagaaaccaggacatcgtacctgcactgctcatttacgtggcgtaccgtacccgggaacgtccgggtaccctgaccgattcagttcgcaggtcggtcgtagggacagtatttcactctccaccatacagcacgcctagacgacgggctaggaagtactggtacggtactagttttaattagttagttacaagtacgtaaatttaagtttaactttatttaccccttacgttacgaaggtaccggtttaccgggaaccctaaacggggtaacccgtaaaggggtacgggtaaaaacttaccggaaaaaaccgttacgtaacggttacgggacccgttacggtacccgtaaccgttaaccgg

SEQ ID NO: 181996 - DNA, 504 bp, Homo sapiens
  misc_feature: GYAE6OF01DOI66.22.14.B03.1.454.CMB.1.raw
  modified_base (406)..(406): a, c, t, g, unknown or other
  misc_feature (406)..(406): n is a, c, g, or t
  modified_base (495)..(495): a, c, t, g, unknown or other
  misc_feature (495)..(495): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtggcagcgggtctgggacagatttcactctcaccatcagcagcctgcaggctgaagntgtgctagtttattattgtcagcaattattatattcctctcagtacgttcgaccaagggtaccaaggtgaaatcaaacgaactgtaggntgcacgtac

SEQ ID NO: 181997 - DNA, 584 bp, Homo sapiens
  misc_feature: GYAE6OF01ATWCR.22.14.B03.1.454.CMB.1.raw
tcagacatacgcgtcacgaccggtgctcgatttagtgtgagtagttccgcgggggtaggctactaacaggcaggcaggggcagcgaagatggtgttgcagacccaggtcttcatttctctgttgctctggatctctggtgcctacggggacattgtagatcgaacccagtctcctagactaccctggctgtcgtctcgtcggcgagaggccaccatcaactgcaagtccagccagtagttatttttacagctccaccaataacgagttacttagtcttggttccagcgagaaaccaggacatcgtcctgcactgctcagtttacgtcggcgtcgtacccgggtaacgtcccgggtccctcgaccgacgttcgagtcggccacggtccgggtctcgggactacgtactttccgactctacacctatccaagcacggccctaggaccaggcctagaagtatgtaggctagttttatagtgtcaagtactaagttattatcttcctcctacgagtaccgttacggaacctaaagggaactagggtagaaacttacgaaaacgtacgtgtacgactcgaccacgtacg

SEQ ID NO: 181998 - DNA, 550 bp, Homo sapiens
  misc_feature: GYAE6OF01EUFDC.22.14.B03.1.454.CMB.1.raw
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (414)..(414): a, c, t, g, unknown or other
  misc_feature (414)..(414): n is a, c, g, or t
tcagacatacgcgtcacgaccggtgctcgatttagtgtgagtagttccgcgggggaggctacaacaggcaggcaggggcagcaagatggtgttgcagacccaggtcttcatttctctgttgctctggatctctggtgcctacgggcattgtgatgacccagtctccagactccctggctgtgtctctgggcgagagggccaccatcaactgcaagtccagccagtagtatttttacagctaccaccaataagattactagcttggttccagcagaaaccaggacatcgtcctgcactgcctcatttactggctcgtacccgggtaatccgggtccctgacccgattccgagtggcaggcgggtctgggacngtatttcactctcaccatcagcagcctncaggcctgaaacgtnttgtcggctagttttatagttgtcagtactaattacttattacttcctctcgaagtccgttcggaccgtaacggggacctaaagggtacggaaaactaccgaaaacggacttacggagtacctcgcaaccgttacg

SEQ ID NO: 181999 - DNA, 544 bp, Homo sapiens
  misc_feature: GYAE6OF01BBN75.22.14.B03.1.454.CMB.1.raw
  modified_base (407)..(407): a, c, t, g, unknown or other
  misc_feature (407)..(407): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgtggctagttttattattgtcagcaattattatacttcctcctcagtacgttccggaccaaaggggtacccaagggttacggaaaacttaccgaaaaccggtaacttaggtacgggaccttcgcctaacccgtacg

SEQ ID NO: 182000 - DNA, 509 bp, Homo sapiens
  misc_feature: GYAE6OF01CT8WE.22.14.B03.1.454.CMB.1.raw
  modified_base (434)..(434): a, c, t, g, unknown or other
  misc_feature (434)..(434): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctcatttactgggcgtctacccgggaatcccggggtcctgaccgattcagtggcagcgggtctgggacagatttcactctcaccatcagcagcctgcaggctgaagatgtggctagtttattattgtcagactaatnttatattcctctacagtacgttcggccaaagggtaccaaggtacggaaaatcgaaaagactgtagactgcaccta

SEQ ID NO: 182001 - DNA, 549 bp, Homo sapiens
  misc_feature: GYAE6OF01DZ0XH.22.14.B03.1.454.CMB.1.raw
  modified_base (310)..(310): a, c, t, g, unknown or other
  misc_feature (310)..(310): n is a, c, g, or t
  modified_base (543)..(543): a, c, t, g, unknown or other
  misc_feature (543)..(543): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcaagaaaccaggacatcgtcctgcactgctcatttacngggcgtactacccgggaatccggggtcctgaccgtattcaggtggcaggcgggtctgggacagtatttcactcctcacctatcagcacgtcctgacaggctagaacgtatgtggactaggttttacttagttgtcagtactaattacttattacttcctcctacacgtaccgttccggacgtaacgggacctaagggtacgaaacgtacaaacgaacgtgtacggactcgacncgtacg

SEQ ID NO: 182002 - DNA, 568 bp, Homo sapiens
  misc_feature: GYAE6OF01ASPBT.22.14.B03.1.454.CMB.1.raw
  modified_base (309)..(309): a, c, t, g, unknown or other
  misc_feature (309)..(309): n is a, c, g, or t
  modified_base (411)..(411): a, c, t, g, unknown or other
  misc_feature (411)..(411): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctcatttacngggtctcgtacccggatcccgggtcctgaccgtatcagtggcaggcgggtcgtgggacagtatttcactctcacctatcagcagccctgcgaggctagaagntggtgtctagttttattagttgtcagtactaattattacttattccctcctacaggtaccgttccggacccgaaacggggtaaccctaaaggggttacggaaaacgttaccgaaaaaccgtacgttacgggtacggcttacggcccgtaacctaacg

SEQ ID NO: 182003 - DNA, 595 bp, Homo sapiens
  misc_feature: GYAE6OF01DP3QY.22.14.B03.1.454.CMB.1.raw
  modified_base (403)..(403): a, c, t, g, unknown or other
  misc_feature (403)..(403): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaacaataagtagttacttagcttggttccagacagaaaccaggacatcgtcctgcactgctctatttacgtgggcgtccgtaacccgggaacgtcccggggtcctcgaccgtattcgagtcggcgaggcgggtcgtgggacagtatttcactctacaccntacagcagcctgacgaggctagaacgtatggtgactagttttattagttgtcaagctaaattacttattaccttccctcctactacggtaccgttaccgggaccgtaaaacggggaccctaaaggggttacgaaaacttacccggaaaacgttacgtacgggttacggaacttcggaaccctaccgttaacg

SEQ ID NO: 182004 - DNA, 581 bp, Homo sapiens
  misc_feature: GYAE6OF01DKL2Q.22.14.B03.1.454.CMB.1.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctctgggcgagagggccaccatcaactgcaagtccagccagagtatttttacagctccaccaataagagttacttagcttggtttccagnanaaacaggacatcgtcctgcactgctcatttactgggcgtctacccgggaaactccggggttcccctagcccgaattccgaagtgggcagcgggtctgggacagatttcactctcacccaatcagcacgcctgcaggcctgaagatgtggctaggtttattattgtcagaccaattattaatatttccctccgtacacggtacgttacccgggcctaaagggggaaccctaaaggggtaggtaaaaaacgtccgtaaaaaccggaaaaccgttcgggtagggacctttcggacctaacccgtaaacg

SEQ ID NO: 182005 - DNA, 555 bp, Homo sapiens
  misc_feature: GYAE6OF01COP7A.22.14.B03.1.454.CMB.1.raw
  modified_base (407)..(407): a, c, t, g, unknown or other
  misc_feature (407)..(407): n is a, c, g, or t
  modified_base (420)..(420): a, c, t, g, unknown or other
  misc_feature (420)..(420): n is a, c, g, or t
  modified_base (438)..(438): a, c, t, g, unknown or other
  misc_feature (438)..(438): n is a, c, g, or t
  modified_base (535)..(535): a, c, t, g, unknown or other
  misc_feature (535)..(535): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggtcgtctacccggaatccgggtccctgaccgattcagtcggcaggcgggtctgggacaggatttcactctcaccatcagcagcctgcaggctaganatgtgctagtttntattgtacagactaattnttaatacttccctaccttcgagtaccgtttacggaccgtaaagggcccgaaagggttacgggaaaacttaccgaaaacggaaaccttgggtacggtntacggtaccgaaccgtaacg

SEQ ID NO: 182006 - DNA, 654 bp, Homo sapiens
  misc_feature: GYAE6OF01EIGER.22.14.B03.1.454.CMB.1.raw
tcagacatacgcgtcacgaccggtgctcgatttagtgtgagtagttccgcgggggaggctacaacaggcaggcaggggcagcaagatggtgttgcagacccaggtcttcatttctctgttgctctggatctctggtgccgtacggggacattgtgatgacccagtctccagacctccctggctgtgtctcgtgggcgagacgggccaccatcaactgcaagtccagccagtagttatttttacagtcctaccaccaataagagttacttagcttggttccagcaacgaaaccaggactactcgtcctgctactgctactatttacgtcgggcgtaccgtacccgggaacgtcccgggtccctaggtaccgagttcgaggtcggcgaggtccgggtcgtaggggacctagtactttccaccgtctaccaaccctataccgaagcgtaacgtcccgtaggaccgtaggtccgtagaaggtagttggtacggtacgttaagttttacgttagttcgtacaacgtactaattatttacttactttccctaccgttacgaacggttaccgttaccgggaaccgtaaggggtaaccttaaggggtacgtaaaactacgtaaaccggtacgtcggtacggacgttacgtacctacgttacg

SEQ ID NO: 182007 - DNA, 605 bp, Homo sapiens
  misc_feature: GYAE6OF01CXRFA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctctatttactgggtcgtctacccgggaatcccggggtccctgaccgtattcagtggcaggcgggtctgggactagtatttcactctcacctatcagcagccctgacaggctagaacgtagtcggtggtacctaagttttactttaagtttcggtacaaggtacctaaagttatttaacttactttcccctcctacgtaaacgtacccggtttaccggacccgtaaacggggtaacccaaaggggttacggtaaaaactaccgaaaaacgtacgttacggtaggccttaacggccctaaccgtaacg

SEQ ID NO: 182008 - DNA, 588 bp, Homo sapiens
  misc_feature: GYAE6OF01DBOGV.22.14.B03.1.454.CMB.1.raw
  modified_base (433)..(433): a, c, t, g, unknown or other
  misc_feature (433)..(433): n is a, c, g, or t
  modified_base (582)..(582): a, c, t, g, unknown or other
  misc_feature (582)..(582): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaaataagagtttactagtacttgttccgtacgcaacgaaaccaacggacgaactcgtcctcgcactctcgtctattacttcgggcgtcgtacccggtaacgtccgggtcccgtcgaccgtacttactagtaggcgacgcgggtcgtcgggtacgagtacgtttctaccgtctcaaccatcacgcanccctgcaggctaggaacagtggtggactagttttaattacttagtcaagctaaaatttcttaattactttccctcccttagacgtacggttccgaccgaaaggggaaccctaaggtaggaaacaccaaagtaactggtagactcgtacncctacg

SEQ ID NO: 182009 - DNA, 822 bp, Homo sapiens
  misc_feature: GYAE6OF01CA28U.22.14.B03.1.454.CMB.1.raw
tcagacatacgcgtcacgaccggtgctcgatttagtgtgagtagttccgtcgggggagctacaacaggcgaggctaggggccaggcaacgaagtcggttcgttgtcgagaacccaggtcttcattttctctgttgctcgtggatctctgggtagtccggtacggggacattgtggttacttggtacccagttcttaccgaaggtactccctggtcttggtgtctcgtgggcgtaggagggccacgaggtcgaacgttggaccaacgtccgacggtcccaggtaagttaactttttacgacgtctccgaaccaagtaacgtacgtttacgttaagtccgtttacggtttaccaagtacgtaagaaaccgtaggtaacgtaacgttccggtccttaggcctacgtcggaccgttacggtaacgttttacggtgggtccggttaccggtaacccgggtaaacgttcccggggtaccgtacgggaaccgtagttcgaaggtcggacgtaacggtcggtacgtaggggaccgagttacgtttaccgtacgtacgtaccgtacctactacacgtccacgtaccctaggaccgtaacggacctaaggtaacgtagttcggtacggtaactttaagtttaaatttacgtacgtaccgaagtactaaagttacgtttaacgttaactttcccgtaccgttacgtaacggttaccggttccggtaaaccggtaaaggggtaacccggtaaaggggttaacggggtaaaacttaccgggtaaaaacgtcgttacgggttacggaccggttacggaacccgaaccgttaaccgg

SEQ ID NO: 182010 - DNA, 513 bp, Homo sapiens
  misc_feature: GYAE6OF01DAIXQ.22.14.B03.1.454.CMB.1.raw
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttcccagcagaaaccaggacatcgtcctgcactgctcatttactgggcgtctacccgggaatccggggtccctgaccgattcagtggcaggcgggtctgggacagtatttcgactctcaccatccagcagcctgcaggctgaagtntggnggctagtttattattgtcagctaattattatactttccctctcagtacgttcggaccaagggccaaggtntaaancaaagacgtgagcngcactacg

SEQ ID NO: 182011 - DNA, 589 bp, Homo sapiens
  misc_feature: GYAE6OF01AY0NK.22.14.B03.1.454.CMB.1.raw
  modified_base (315)..(315): a, c, t, g, unknown or other
  misc_feature (315)..(315): n is a, c, g, or t
  modified_base (423)..(423): a, c, t, g, unknown or other
  misc_feature (423)..(423): n is a, c, g, or t
tcagacatacgcgtcacgaccggtgctcgatttagtgtgagtagttccgcggggagcgtacaacaggcgaggcaggggcagcaagatggtgttgcagacccaggtcttcatttctctgttgctctggatctctggtgccgtacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactgctctatttacgngggcgtcgtacccgggaagtcccgggtccctgaccgattcgagtggcaggcgggtctgggacagtactttcactctcaccatcgagcacgcctgctaggctagaagtntcgtggctagtttattagtgtacagtactaaattattattacttccctacctctaaggtaccgttaccgggaacccgtaaaggggtaaccctaaaggggtaccgaaaaactacccgtaaaaacggtacgttagggtacggtaccttacgaccgtaacccgttaacg

SEQ ID NO: 182012 - DNA, 319 bp, Homo sapiens
  misc_feature: GYAE6OF01DEUM0.22.14.B03.1.454.CMB.1.raw
  modified_base (306)..(306): a, c, t, g, unknown or other
  misc_feature (306)..(306): n is a, c, g, or t
  modified_base (312)..(319): a, c, t, g, unknown or other
  misc_feature (312)..(319): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggccatcggtcttcccctggcgcctgctccaggagccacctccgagagcacagcggcctgggctgcctggtcaaggctacttccacgcgtatgtctgagcgggctggcaaggcncatagnnnnnnnn

SEQ ID NO: 182013 - DNA, 843 bp, Homo sapiens
  misc_feature: GYAE6OF01CIBS8.22.14.B03.1.454.CMB.1.raw
tcagacatacgcgtcacgaccggtgctcgatttagtgtgagtagttccgtcgggggtagggctacaacacggaccagggcagggcagcaaggatggtgttggccagacccaggtcttcactttcggtctcgttgctctcggagtctctggtagccgtacggggacattgtgatgacccagtctccacgactcctcgctgtcgtctctggcgagtacggccaaccgatcaaactgcaacgtccagacctagacgttagtttttacagtctaccgaaccaataagagttactagtactttagttccatcagaaccaggaaccagtccgtcctcgacactcgctctacttacgtaggtcgtccgtacccgggaactccggggttccctacgggtacccggtacttacgaggtacggctacggtcgggtcgtagggacgtaggtactttccgacggttactactaaccttaattaccgaagtaccaacgtccctagaccgaacgggtactaggaaagttgtacggtacgggaccttaaggttttttaacttaacggttttacggtaaccgttaaacggtaactttaaaacgttaacgtttttaaaacgttaaccttttttccccttaacccgtttaaccgtttaaacccggggtttaacccggtttttaccccggggaaacccccgggtttaaaacggggggtaaaacccccgttaaaaagggggttttacgggttaaaaaaaacccgttacccggttaaaaaaaaccgggttaaaccccgggtttaacgggtttacgggggaaaccccggtttcggtaaaccccgtaacccccgtttaaaacccgg

SEQ ID NO: 182014 - DNA, 592 bp, Homo sapiens
  misc_feature: GYAE6OF01BOOXJ.22.14.B03.1.454.CMB.1.raw
  modified_base (363)..(363): a, c, t, g, unknown or other
  misc_feature (363)..(363): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagctactagcttgtccagcagaaaccaggacatcctcctctactgctctactttacgtgggctaccgtacccgggaatcccggggtccctacgaccgtattcgagtcggcncggcgggtcgtggggacaggtactttcacctctcaacactacacgtcacgccctggacaggctaggaagtagtagtggtcgttagtttatacgtgtacgatactaattaatttacttacttaccctacccgtactacggtaccgttacggaccgtaaacgggaccgtaaagggtaggtaaaacctacgaaaacggtaccgtaggtacggtactacgtacctaacgtacg

SEQ ID NO: 182015 - DNA, 547 bp, Homo sapiens
  misc_feature: GYAE6OF01B0FM9.22.14.B03.1.454.CMB.1.raw
  modified_base (417)..(417): a, c, t, g, unknown or other
  misc_feature (417)..(417): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctccaccaataagagttactagcttggttccagcagaaaccaggacatcgtcctgcactgctctatttacgtgggctacgtacccgggaattcccggggtccctgaccgattcgagtcggcaggcgggtctgggacagtatttcgactctcacatcagcacgcctgcaggctgaagntgtgctagttttatattgtcagctaattattattacttccctctctaggtacgttccggacctaaagggaccctaagggtacggaaacttacgaaaaccggtaactggtacggaccttgacctacgtacg

SEQ ID NO: 182016 - DNA, 538 bp, Homo sapiens
  misc_feature: GYAE6OF01DP2NZ.22.14.B03.1.454.CMB.1.raw
  modified_base (400)..(400): a, c, t, g, unknown or other
  misc_feature (400)..(400): n is a, c, g, or t
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggcgtctacccgggtaacgtcccggggtccctacgaccgattcgagtggcaggcgggtctgggacaggtattcacgtctcaccatcagcancctgcagctagaacgntgtgactagtttatattgtcagtcaattattatacttcctacctctagtaccggttcggacctaaagggacccgtaaggtaggaaactcgaaaacgacgtaggcgtatcggactaccgtacg

SEQ ID NO: 182017 - DNA, 522 bp, Homo sapiens
  misc_feature: GYAE6OF01BN7RA.22.14.B03.1.454.CMB.1.raw
  modified_base (412)..(412): a, c, t, g, unknown or other
  misc_feature (412)..(412): n is a, c, g, or t
  modified_base (457)..(457): a, c, t, g, unknown or other
  misc_feature (457)..(457): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcctacccgggaatcccggggtccctgaccgattcagtggcagcgggtctgggacagatttcactctcaccatccagcagcctgcaggctaggaagtntgtggctagtttattattgtcagtcaattattatacttcctactnacgtacgttcggaccgaagggacctaagggtagtaaactcaaacgactagcggactgccacgtac

SEQ ID NO: 182018 - DNA, 525 bp, Homo sapiens
  misc_feature: GYAE6OF01D8TRF.22.14.B03.1.454.CMB.1.raw
  modified_base (405)..(405): a, c, t, g, unknown or other
  misc_feature (405)..(405): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtccctgaccgattcgagtggcaggcgggtctggggacagtatttcactctcacatcagcagcctgcaggcngaagatgtgctagtttatattgtcagctaattattatacttcctcctactagtacgttcgaccgaagggaccaaggtacggaaataacgaaacgaacgtggtacgcttacgccaacgtag

SEQ ID NO: 182019 - DNA, 529 bp, Homo sapiens
  misc_feature: GYAE6OF01DFOBT.22.14.B03.1.454.CMB.1.raw
  modified_base (401)..(401): a, c, t, g, unknown or other
  misc_feature (401)..(401): n is a, c, g, or t
  modified_base (422)..(422): a, c, t, g, unknown or other
  misc_feature (422)..(422): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccggaatcccggggtcctgaccgattcagtggcagcgggtctgggcagattcactctcaccatcagcagcctgcagctgaanatgtgctagtttatattgtanagactaattattatatttcctcctactacgtacgttccggaccaaggggacctaagggtaggtaaactaccgaaaacgaacttggtacggctacggcctaccgtacg

SEQ ID NO: 182020 - DNA, 528 bp, Homo sapiens
  misc_feature: GYAE6OF01CFJ5V.22.14.B03.1.454.CMB.1.raw
  modified_base (417)..(417): a, c, t, g, unknown or other
  misc_feature (417)..(417): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactcccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggaagtcccggggtcctcgaccgtattcagtggcaggcgggtctgggacaggtattccactctcacctatcagcagcctgcaggctagaagngtggtgctagtttattagtgtcagtactaattattattattccctctcagtccgttcgacgaagggacccagggtacgaaactacgaaacgactggcgactcgcacgtacg

SEQ ID NO: 182021 - DNA, 543 bp, Homo sapiens
  misc_feature: GYAE6OF01A27UO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtatttttacagctccaccaataagagttacttagcttggttccagcagaaaccaggacatcgtcctgcactgctcatttacgtgggcgtcgtacccgggtaatcccggggtccctgaccgtattcgagtggcaggcgggtctggggacagtactttcactctcaccatcagcacgcctgcgaggctagaagatgtggtctaagttttatagttgtcagtctaattattatacttcctctcagtaccgttccgactaagggaccaagggtacggaaaactccgaaaacgtacgtaggtcggactcgaccaccgtac

SEQ ID NO: 182022 - DNA, 544 bp, Homo sapiens
  misc_feature: GYAE6OF01B4ST3.22.14.B03.1.454.CMB.1.raw
  modified_base (411)..(411): a, c, t, g, unknown or other
  misc_feature (411)..(411): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggaatcccggggtccctgaccgattcagtggcaggcgggtctgggacagtattcactctacaccatcagcagcctgcaggctagaagntgtggctagtttattattgtctagctaattattaatacttcctacctctagtaccgtttcggaccgtaacgggtaccaaagggtggaaaactacgaaaacgtacgtacggtacggactaggacctacctaacg

SEQ ID NO: 182023 - DNA, 515 bp, Homo sapiens
  misc_feature: GYAE6OF01A6ACQ.22.14.B03.1.454.CMB.1.raw
  modified_base (510)..(510): a, c, t, g, unknown or other
  misc_feature (510)..(510): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattaagtggcagcgggtctgggactagatttcactctcaccatcagcagcctgcaggctgaagatgtggacagtttatactgtcagcaatattattacttcctcctcagcgttcggcctaaagggaccaacgggtgaaactcaaacgtactggtcgactagcaccnttccg

SEQ ID NO: 182024 - DNA, 544 bp, Homo sapiens
  misc_feature: GYAE6OF01EIZYX.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacgtgggctcgtacccgggaagtcccgggtccctgaccgattcagtggcaggcgggtctgggacagtatttcactctcaccatcagcagccctgcaggctagaagatggtgactagttttattattgtcagactaattatttatactttccctactacgagtaccgttccggaccgtaaacgggacctaagggtacgaaactaccgaaaacgtaacgtggtacggactgccacgtacg

SEQ ID NO: 182025 - DNA, 495 bp, Homo sapiens
  misc_feature: GYAE6OF01DIE4J.22.14.B03.1.454.CMB.1.raw
  modified_base (401)..(401): a, c, t, g, unknown or other
  misc_feature (401)..(401): n is a, c, g, or t
  modified_base (487)..(487): a, c, t, g, unknown or other
  misc_feature (487)..(487): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttactgggctctacccggaatccggggtcctgaccgattcagtggcagcgggtctgggacagatttcactctcaccatcagcagcctgcaggctgaanatgtggctagtttattattgtcagcaatattatattcctctcagtacgttcgccaagggaccaagggtgaaatcaaagacgtgagntgcactac

SEQ ID NO: 182026 - DNA, 685 bp, Homo sapiens
  misc_feature: GYAE6OF01CD8TY.22.14.B03.1.454.CMB.1.raw
  modified_base (358)..(358): a, c, t, g, unknown or other
  misc_feature (358)..(358): n is a, c, g, or t
  modified_base (380)..(380): a, c, t, g, unknown or other
  misc_feature (380)..(380): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagagttatttttacagctaccaccaataagagttacttagcttgttccagcagaaaccaggacatcgtcctgcactgcctctatttacgtcgggtccgtacgtacccgggaacgtcccgggtcctcgaccgtnttcgagtcggcaggcgggtcgngggacagtactttcaccgtctaccaccgatcgacggcaacggccctaggcacgggtcctaagggaacgtagttcgggtacggacctttaaggtttttacttatttcggtaacctaaggtaaccttaaagtttaatttaccttacttttaccccgtaccttaacggaacggtttaccccgggtacggtaaccccggaaaaacggggtcccgttaaaaggggttaaaccggtaaaacttaaccccgtaaaaacgggtaaccgttagggtaacccggtaccgttaacgaccccgtaaaccgtttacgg

SEQ ID NO: 182027 - DNA, 613 bp, Homo sapiens
  misc_feature: GYAE6OF01EUOU3.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacgggccaccatcaactgacaacgtccagccagtagtttatttttacagtcctaccaaccaataagtacgttacttagtcttcggttccagacaacgaaaccaggacacgtcgtcctgccacgtcgctactagtttacgtcgggtcgtaccgtacccgggtaacgtcccgggtaccctcggaccgtacgttcgaggtcggacgtacggtcgggtcgtgggactagtactttcgactcctcactactcgacgcacgtctacgcgaggtctagagtagtcgtagtctaagtttactagttcgtacgagtactaagttacttacttacttcccgtactcgtagtaccggtccggaacgtaacgggacctaagggtacgaactacgaaacgtacgtgtacggactcggactactacg

SEQ ID NO: 182028 - DNA, 677 bp, Homo sapiens
  misc_feature: GYAE6OF01BHQLN.22.14.B03.1.454.CMB.1.raw
  modified_base (664)..(664): a, c, t, g, unknown or other
  misc_feature (664)..(664): n is a, c, g, or t
tcagacatacgcgtcacgaccggtgctcgatttagtgtgagtagttcccgcggggggagctacaacacggcaggaccaggggcagcaagatggtgttaccgcagacccacggtcttcatttctctgttgctctggatctctggttgccgtacggggacattgtgatgaacccagtcctccacgactcccgtggcgtgtgtctcgtgggcggagagggccaccaatcaaccgtgcaagtccagccacgagttatttttacacgctccaccaataacgtagttacttaggccttaggttacccacgctaaggaaaccaggaccacgtccgtcctgacgacttgctcattttacgtgggtcgttctacccgggaagtcccggggtaccctggacccgattccgaagtcggcaggcgggtcgtaggggtacgaggtagtttccacttctacctaccgagtaccacgccacgtccctcgacgaacggtcctaggaaacgtacgttggtacggtacctagtttttaacttagtttcgttacgtaacgacgtaaagtttaccgtttaattaaccttttcccgtaccttacgacgtaccggttaccgggaccgaaacggggtacccgtaaagggtcggaaaacgttcgaaaccgttacgttggtacgagtcncccgtacctacgg

SEQ ID NO: 182029 - DNA, 546 bp, Homo sapiens
  misc_feature: GYAE6OF01EBWAP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcaggcgggtctgggacagtattcactctcaccatcagcagcctgcaggctagaagatgtggactagttttattattgtcgagactaattattattacttcctcctacgacgtacgttacggaccgtaacgggacctaagggttacggaaactaccgaaaacgtaacgttggtacggactacggaccaccgtacg

SEQ ID NO: 182030 - DNA, 545 bp, Homo sapiens
  misc_feature: GYAE6OF01EXGE1.22.14.B03.1.454.CMB.1.raw
  modified_base (368)..(368): a, c, t, g, unknown or other
  misc_feature (368)..(368): n is a, c, g, or t
  modified_base (538)..(538): a, c, t, g, unknown or other
  misc_feature (538)..(538): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtccctgaccgattcagtgcagcgggtctgggacngtattcactctcaccatcagcacgcctgcaggctagaagatgtgctagttttatagttgtcagactaagttattagttacttcccctacccgtaagtaccgttccggaccgaaagggaccgtaaagggtagaaactccgaaaacgtactaggtacggactagacccaccngttaccg

SEQ ID NO: 182031 - DNA, 587 bp, Homo sapiens
  misc_feature: GYAE6OF01BCYC4.22.14.B03.1.454.CMB.1.raw
  modified_base (430)..(430): a, c, t, g, unknown or other
  misc_feature (430)..(430): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttactgggctccgtacccgggtaacgtcccggggtccctcgaccgtattcgaggtcggcgaggcgggtcgtggggacagtactttcactcgtacaccatcagcacgcctgccaggcctagaagtntggtcggacttagttttattagttgtacagacgtaaattattaattacgttccctactacgtaaggtaccggtttaccgggacccgtaaagggacccgtaagggtaggtaaaactaccgtaaaacgaccgttggtacggacctcggaccaccgtacg

SEQ ID NO: 182032 - DNA, 564 bp, Homo sapiens
  misc_feature: GYAE6OF01DAPZS.22.14.B03.1.454.CMB.1.raw
  modified_base (400)..(400): a, c, t, g, unknown or other
  misc_feature (400)..(400): n is a, c, g, or t
  modified_base (418)..(418): a, c, t, g, unknown or other
  misc_feature (418)..(418): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccagtcaactgcaagtccagccagagtatttttacagctccaccaataagagttactagcttggttccagcagaaaccaggacatcgtcctgcactgctcatttacgtggcgtcgtaccccggaagtcccggggtccctggaccgtatcgagtcggcaggcgggtgtgggacagtatttcactctcaccatcagcanccgtgacagcgtagaagntgtgctagtttattgtgtcagtactaagttattattacttcccgtctacgtaggtaccgttaccggacgtaaaccgggtaccctaagggtacgtaaaactcgaaaaccggtacgttacggtacggccgttaacgccgtaacctacg

SEQ ID NO: 182033 - DNA, 612 bp, Homo sapiens
  misc_feature: GYAE6OF01DR1H7.22.14.B03.1.454.CMB.1.raw
  modified_base (354)..(354): a, c, t, g, unknown or other
  misc_feature (354)..(354): n is a, c, g, or t
  modified_base (431)..(431): a, c, t, g, unknown or other
  misc_feature (431)..(431): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcccctggctgtgtctctgggcgagagggccaccatcaactgcaagtccagccagagtatttttacagctccaccaataagagttacttagcttggttccagtcaagaaaccaggacatcgtcctgcactgctctatttacgtgggccgtcgtacccgggaagtcccggggtcctcggaccgnttcgagtcggcaggcgggtctagggactagtactttcacgtctaccacctatccaagcagtccctgcagctagaagntcggtgacgtagtttattagttgtctaaggtactaaagttattaacgtttactttacccctaccgtacgtacggttaaccggttcccggaaccgtaaaacggggtaccctaaagggttaacgtaaaacgtaaccgtaaaacgtaacgttcgggtacggtaccgttcgacctaacgttaacg

SEQ ID NO: 182034 - DNA, 522 bp, Homo sapiens
  misc_feature: GYAE6OF01BXN5Q.22.14.B03.1.454.CMB.1.raw
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (453)..(453): a, c, t, g, unknown or other
  misc_feature (453)..(453): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaccaggacatcgtcctgcactgctcatttacngggcgtctacccgggaatcccggggtcctgaccgattcaggtcgcaggcgggtctgggacagatttcactctcaccatcagcagcctgcaggctagagntgtgctagtttatattgcagctaattacttattacttcctacctnacgtacgttcggaccgaagggtaccaagggtacggaaatcgaaaacgtacgtgtcggactgccactacg

SEQ ID NO: 182035 - DNA, 787 bp, Homo sapiens
  misc_feature: GYAE6OF01AC889.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttctattctctgttgctctggatctcgtggtcgccgtacggggactattgtgatcgacccagtcctccacgtacctcccgtggctgtcgtcgtcggtcgggcgaggacggccaccatacaactgacacgtcacgacctagtacgtttacttttacacgtcctaccaacctaaataagtacgttactacgtccgttaggtaccagaccgaacgaaaccgacggactacgtccgtaccgtacgacctacgtctacgttacgtaacggtttaccggtccggggtacccgttaccgggtaaccccggggtaacgggttccccggggtaccgtaccggtaaccggtacgtttacggacgggtccgggacggtaacgggtccgggtacggtacgggtaactacgttaacttccgtaccgtccgtaacccaaccgtactacggaccgtaccgtaacggtcccggtacggaacgtacgggtaccgtaagggtaaagttcgggtttacggtaacggtaactttttacggtttattacgttacggtaacctacggtaatttacgtactttaccttaccgttaccctacggtaacgtacggtaccggtaaccggtaacccggaaggtaccggtaaaggtaaagtacccgaaacggtaacgtcggtaccggtacttccgactacctccgttacg

SEQ ID NO: 182036 - DNA, 541 bp, Homo sapiens
  misc_feature: GYAE6OF01DYQU1.22.14.B03.1.454.CMB.1.raw
  modified_base (310)..(310): a, c, t, g, unknown or other
  misc_feature (310)..(310): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttacngggctctacccgggaatccggggtcctgaccgattcagtggcaggcgggtctgggacagatttcactctcaccatcagcagcctgcaggctgaagatgtggctagtttacttactgtcagctaattattaatacttcctcctcacgtacgttccggaccaacggggtaccaagggttaggaaaactaccgaaaacggtaaacttgggtacggctacggcctacccgtaacg

SEQ ID NO: 182037 - DNA, 562 bp, Homo sapiens
  misc_feature: GYAE6OF01D61RZ.22.14.B03.1.454.CMB.1.raw
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaaccaataagagttacttagcttggttccagcaagaaaccaggacatcgtcctgcactgctnattactggcgtctacccgggaatcccgggtcctgaccgattcagtggcaggcgggtctgggacagtacttcactctcaccatcagcagccctgcaggctagaagtntgtgctagttttatagtgacaagtctaaagttntttatactttccctactacgtacggtacccggtttccggaccgtaaacggggtaaccctaaaggggtacgaaaacttaccgaaaacgtaccgttggtacggacgttagcccaacgttac

SEQ ID NO: 182038 - DNA, 322 bp, Homo sapiens
  misc_feature: GYAE6OF01A9N9G.22.14.B03.1.454.CMB.1.raw
  modified_base (313)..(322): a, c, t, g, unknown or other
  misc_feature (313)..(322): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacagcggcctgggctgcctggtcaaggctacttccacgcgtatgtctgagcgggctggcaaggcgcatagnnnnnnnnnn

SEQ ID NO: 182039 - DNA, 559 bp, Homo sapiens
  misc_feature: GYAE6OF01CQ0C7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttacttagcttggttccagcaagaaaccaggacatcgtcctgcactgctctatttacgtgggtcgtaccgtacccgggaacgtcccggggtccctacgacccgtattccgaggtcggcaggtccgggtcgtaggggacaggtactttccgactctccaacctatcagcagccctgcaggctagaagagtgtggactaagttttatattgtacagactaattattattacttcctcctacgagtaccgttcgaccgaaagggtaccaaggtacgaaatacgaaacgtatggtacgactagcactacg

SEQ ID NO: 182040 - DNA, 521 bp, Homo sapiens
  misc_feature: GYAE6OF01C7II1.22.14.B03.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (506)..(506): a, c, t, g, unknown or other
  misc_feature (506)..(506): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagctacttagcttggttccagcaagaaaccaggacatcctcctctactgctcatttactgggcgtctacccgggaatcccggggtcctcgaccgtattcagtgcagcggctgggacagactttcactctcaccatcagcagcctgcagctgaagntgngctagtttattattgtcagctaatnttatnttcctctnagtacgtacaccgaagggtacccaaaggttaggaaactacgaaaacgtactcggtacggnttacgcctacgtacg

SEQ ID NO: 182041 - DNA, 505 bp, Homo sapiens
  misc_feature: GYAE6OF01DRIYX.22.14.B03.1.454.CMB.1.raw
  modified_base (404)..(404): a, c, t, g, unknown or other
  misc_feature (404)..(404): n is a, c, g, or t
  modified_base (418)..(418): a, c, t, g, unknown or other
  misc_feature (418)..(418): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctcgtacccggaatccgggtcctgaccgattcagtggcagcgggtctgggacagatttcactctcaccatcagcagcctgcaggctagaagntgtgctagttattnttgtcagactaattattatacttcctcctcagtacgttcggaccaagggaccaaggtgaaatacgaaacgatggtagctgcacctag

SEQ ID NO: 182042 - DNA, 603 bp, Homo sapiens
  misc_feature: GYAE6OF01C80KR.22.14.B03.1.454.CMB.1.raw
  modified_base (556)..(556): a, c, t, g, unknown or other
  misc_feature (556)..(556): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagactccctggctgtgtctcgtgggcgagagggccaccatcaactgcaacgtccagccagagttatttttacagctccacaataagagttactagcttggttccagcaagaaaccaggacatcgtcctgcactgcctctatttacgcgggtcgtaccgtacccgggtaacgtcccgggtcctcgaccgtagtcgagtcggcgacggtcgggtcgtgggactagtactttccactcctcgaacctaatccgaagcagccctgcgaggctagaagacgtggtggacttaggtttaacttgttacgtcaagtactaaattagttaacttactttcccgtcctacgaaccggttaccgtcccgggtaacaaacggggtaccaaaggggttanaaaaccttaccgaaaacggtaactggaacgtcctaggccctacgtac

SEQ ID NO: 182043 - DNA, 670 bp, Homo sapiens
  misc_feature: GYAE6OF01ATIBN.22.14.B03.1.454.CMB.1.raw
  modified_base (329)..(329): a, c, t, g, unknown or other
  misc_feature (329)..(329): n is a, c, g, or t
tcagacatacgcgtcacgaccggtgctcgatttagtgtgagtagttccgcggggggagctacaacaggcaggcaggggcagcaagatggttgttgcagacccaggtcttcatttctctgttgcgtctggatctctggtgcctacggggacattcgtgatgacccagtctccgagactcccgtggcctgtgtctctcgggcgaggagggcccaccatctaactgcaacgtccagaccagagttatttttacagtctccaccaataagagttactagtcttggttccagcagaaccaggacatcgtcctgccacgtgcctctatttaccgnggtcgtccgtacccgggacgtcccggggtccctcgaccgattcgagtcggcacggccgggtcgtgggacagtacttccactcctacacccatacgaacgctacgccgttacgactacgggtactaggaaagtgtagggtacgtaccttttaagttttaacttccgttacggtacaacggtaactaaatttaacgtttaacgttacctttacccgtaccgtaccggtaaggtacccggttacccgggaaccggtaaaccgggtaccgtaaagggtacgtaaaacgttacccgaaaacggtaccgttcgggtaccggtaccctcggtaaccctacccgttacg

SEQ ID NO: 182044 - DNA, 606 bp, Homo sapiens
  misc_feature: GYAE6OF01AD4K0.22.14.B03.1.454.CMB.1.raw
  modified_base (420)..(420): a, c, t, g, unknown or other
  misc_feature (420)..(420): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcctcctctactgctctatttactgggcgtccgtacccgggtaacgtccggggtccctgaccgattcaggtggcaggcgggtctgggacagtatttcactctcaccatcagcacgcctgcgaggctagaagntggtggctagttttacttacgtgtcagtactaagttatttaacttactttcccttaccctacgtaacggttaccggttcccgggaacccgtaaacgggggtaacccgtaaaggggttaacgggaaaacttacccgaaaaccggtaacgttcggtacgggtactacggaccctaaccgtcgttaccg

SEQ ID NO: 182045 - DNA, 548 bp, Homo sapiens
  misc_feature: GYAE6OF01AE5ZF.22.14.B03.1.454.CMB.1.raw
  modified_base (537)..(537): a, c, t, g, unknown or other
  misc_feature (537)..(537): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcaagaaaccaggacatcgtcctgcactgctcatttacgtgggcgtcgtacccgggaacgttcccggggtccctgaccgtattcgagtcggcaggcgggtcgtgggacagtatttcacttctcaccatcagcagccctgcgaggctagaagagtgtggtactagtttattattgtacagactaattattatacgttcctcctctacgtaccgttcggaccgaagggtaccctaagggtagaaactacgaaacgtacgtgtaggacngtccacgtacg

SEQ ID NO: 182046 - DNA, 376 bp, Homo sapiens
  misc_feature: GYAE6OF01A22FA.22.14.B03.1.454.CMB.1.raw
  modified_base (313)..(314): a, c, t, g, unknown or other
  misc_feature (313)..(314): n is a, c, g, or t
  modified_base (316)..(317): a, c, t, g, unknown or other
  misc_feature (316)..(317): n is a, c, g, or t
  modified_base (319)..(319): a, c, t, g, unknown or other
  misc_feature (319)..(319): n is a, c, g, or t
  modified_base (321)..(321): a, c, t, g, unknown or other
  misc_feature (321)..(321): n is a, c, g, or t
  modified_base (323)..(376): a, c, t, g, unknown or other
  misc_feature (323)..(376): n is a, c, g, or t
tcagacatacgcgtcacgaccggtgctcgatttagtgtgagtagttcccgggaagttccgggggtccctgaccgacttcgagttcggcagcgggttctgggactagatttcactctcaccatcagcagcctgcaggctgaagatgtggcagtttattattggttcagcaatatttaatattcctctcagacgtttcggccaaggggtaccaagggtggaaaacgtcaaaacgaacttgtaggctggcaccatctgtcttcatcttcccgcatctgaacgcgttatgtcctgagcggctggcaaggcgcatagnngnngntncnnnnnnnnnnnnnnnnnnnnnnnnnnnnnnnnnnnnnnnnnnnnnnnnnnnnnn

SEQ ID NO: 182047 - DNA, 551 bp, Homo sapiens
  misc_feature: GYAE6OF01C4FQP.22.14.B03.1.454.CMB.1.raw
  modified_base (196)..(196): a, c, t, g, unknown or other
  misc_feature (196)..(196): n is a, c, g, or t
  modified_base (306)..(306): a, c, t, g, unknown or other
  misc_feature (306)..(306): n is a, c, g, or t
  modified_base (366)..(366): a, c, t, g, unknown or other
  misc_feature (366)..(366): n is a, c, g, or t
  modified_base (406)..(406): a, c, t, g, unknown or other
  misc_feature (406)..(406): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagngggccaccatcaactgcaagtccagccagagtatttttacagctccacaatagagttactagcttggttccagcagaaaccaggacatcgtcctgcactgctcatttacngggcgtctacccgggaatcccggggtcctgaccgattcagtggcagcgggtctgggcagntttcactctcaccatcagcagccctgcaggctgaagatgngctagtttattagttgtcagtactaagttattaattactttccctcctcgtaacgtaaccggttccggaccgaacggggtacctaaagggttagttaaaactaccgaaaacggtacttaggtacggacttcgacctaccgttacg

SEQ ID NO: 182048 - DNA, 555 bp, Homo sapiens
  misc_feature: GYAE6OF01D5BTP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattacttagcttggttccagcagaaaccaggacatcgtcctgcactgctctatttacgtgggctcgtacccgggaacgtccggggtccctgaccgattcaggtggcaggcgggtctgggacagtattcactctcaccatcagcagtcctgcaggcctaggaagtatggtggacttagttttacttagttgcagtactaaattagttattacttcctccttacacgtaccgttccggaccgtaaagggacccgtaagggtacggaaaactacgaaaacgacttcggagggctacggctacctacg

SEQ ID NO: 182049 - DNA, 373 bp, Homo sapiens
  misc_feature: GYAE6OF01C0H25.22.14.B03.1.454.CMB.1.raw
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
  modified_base (329)..(332): a, c, t, g, unknown or other
  misc_feature (329)..(332): n is a, c, g, or t
  modified_base (335)..(373): a, c, t, g, unknown or other
  misc_feature (335)..(373): n is a, c, g, or t
tcagacatacgcgtcacgaccggtgctcgatttagtgtgagtagttccgacgggacaaaagtccacgaccacagtgtactatgtcgctgagacagccgtgagatctgaggacacggtccggtttattattgtgttatgggtgagcactccggcggcctcggggccagggaaccctggtcaccgtctcctcagcctccaccaacgggccccatcggtcttccccctggcgcccctgcctcccaggncacctccgagagcacagccggccctgggctgcctggtcaaggctacttcacgcgtatgctagagcgggctggcaggcncatagnnnnctnnnnnnnnnnnnnnnnnnnnnnnnnnnnnnnnnnnnnnn

SEQ ID NO: 182050 - DNA, 579 bp, Homo sapiens
  misc_feature: GYAE6OF01ERF2A.22.14.B03.1.454.CMB.1.raw
  modified_base (425)..(425): a, c, t, g, unknown or other
  misc_feature (425)..(425): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagctactagcttggttccagcagaaccaggacatcctcctctactgtctctatttacgtgggccgttccgtaacccgggaacgtcccggggtccctggacccgtattcgagtggcaggcgggtcgtgggacagtatttccactctaccacatcagcagcctgcagctagaagtntgtggtctagtttattagtgtcagtactaagttattacttacttccctacccttacgacggttaccggttccgggaacccgtaaagggggtaccctaaaggggtacggtaaactacgaaaaccggtaacgtggtacggactcggaccaccgtac

SEQ ID NO: 182051 - DNA, 542 bp, Homo sapiens
  misc_feature: GYAE6OF01BW5UO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttacttagcttggttccagcaagaaaccaggacatcgtcctgcactgctcatttacgtgggctcgtacccgggaatcccggggtccctgaccgattcagtcggcaggcgggtctggggacagtatttcactctacaccatacagcagcctagcaggctagaagatgtagctagttttattagttgtcagtctaagttattattacttcctctacagtaccgttcggaccgaagggtaccaagggtaggaaactacgaaaacgtacgttgtacggtactgccactacg

SEQ ID NO: 182052 - DNA, 620 bp, Homo sapiens
  misc_feature: GYAE6OF01EE1TG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctaccaccaataagagttacttagcttggttccagcagaaaccaggacatcgtcctgcactgctctatttactgggcgtccgtacccgggaagtcccggggtccctgacccgtattcgagtcggcaggcgggtcgtggggacagtatttcactctacacatcgagcgacgcctgcgaggctagaagtagtgtggtctaggtttttaattagtttgtctacggtactaaatttagtttaattactttcccctaccgttacgaacggttacccggttaccgggaccgtaaaaccggggtacccgtaaaggggttacggtaaaaacgttacgaaaaacccggtaacgttgggttacgggaccttacggaccctaacccgtacg

SEQ ID NO: 182053 - DNA, 668 bp, Homo sapiens
  misc_feature: GYAE6OF01DBO52.22.14.B03.1.454.CMB.1.raw
  modified_base (314)..(314): a, c, t, g, unknown or other
  misc_feature (314)..(314): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagtctccacaataagtagttactagtcttggttccagcaagaaccaggacatcgtctgcactgctctatttacgngggtctccgtacccgggaacgttcccgggtcctgaccgtattccgagtcggcgacggcgggtctaggggacagtactttccgaacttcctacgaaccctattaccgagtccacgtccccgttaggaccgtaagggccttaggaaacgtgttcggtaggtacctttaggttttaactttagtttacgtacgtaaggttctaaaagtttactttaattacctttcccgtacccttccgtaacggtaaccgtttccggggaaccctaaagggggtaaccctaaaggggttaaccggtaaaacttaaccgaaaacggttaaacgttcggtaacggtccgtacgacccgtacctaacgg

SEQ ID NO: 182054 - DNA, 580 bp, Homo sapiens
  misc_feature: GYAE6OF01BKRIJ.22.14.B03.1.454.CMB.1.raw
  modified_base (439)..(439): a, c, t, g, unknown or other
  misc_feature (439)..(439): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagtctccaccaataagtagttaacttagcttggttccagcaagaaaccaggacatcgtcctgcactgctctatttacgtcgggtcgtccgtacccgggtaacgtcccggggtccctacgaccgtattcgagtggcgacggtcgggtcgtgggactagtactttcacgtctacacctatccagcagcctgcgagctagaagngtgtgctagtttacttgtgtactagacttaaattactttactactttccctaccttacgtacgtaccggttcgacccgtaagggaccgtaagggtaacggtaaactacgaaacgtacgtggtacggacctgccgtactacg

SEQ ID NO: 182055 - DNA, 545 bp, Homo sapiens
  misc_feature: GYAE6OF01BHVYQ.22.14.B03.1.454.CMB.1.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctatttacgtgggcgtaccgtacccgggaactcccggggtccctgaccgtattcaggtggcaggcgggtcgtggggactagtactttcgactctcaccatcagcacgtcctgcaggctagaagntgtgntagtttattatgtanagataattattaatcttcctctcagtaccgttcggaccgtaagggaccctaagggtacgaaactacgaaacgtacgtggtaggactcggcctaccgtag

SEQ ID NO: 182056 - DNA, 632 bp, Homo sapiens
  misc_feature: GYAE6OF01E1Q6E.22.14.B03.1.454.CMB.1.raw
  modified_base (436)..(436): a, c, t, g, unknown or other
  misc_feature (436)..(436): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagcctccaaccaataagatttaacttagcttggttccagcaagaaaccaggacatcgtcctgcactgctctatttacgtgggtccgtccgtacccgggaacgtcccgggtccctgacccgtattcgagtggcaggtcgggtctgggacagtattcacttcctaccaccatcgagtcacgtccctgcaggctagaagtntggtcgtacttagttttattagttgtacgaagtacttaattaatttacttaacgtttccctaccttacgtaacggtaccggtttaccggaacccggtaaacggggtaacccgtaaaggggttaacggtaaaacttaaccggtaaaaaccggacgtttacgggtacggttacctaaccgggtacctaaccccgttag

SEQ ID NO: 182057 - DNA, 572 bp, Homo sapiens
  misc_feature: GYAE6OF01D6MEJ.22.14.B03.1.454.CMB.1.raw
  modified_base (419)..(419): a, c, t, g, unknown or other
  misc_feature (419)..(419): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctatttactgggcgtcgtacccgggaagtcccgggtccctcggaccgtattcgagtggcgaggcgggtctgggacagtattcactctacaccatcagcagcctgcaggctagaagtntcgtgacttagttttattattgacaagtctaaattatttaatcttccctcctacgtaacggtaccggtttaccggaacccgtaaacggggccgtaaagggttacgaaaactacccgaaaacgtacgttggtacggacctggaccctacgtacg

SEQ ID NO: 182058 - DNA, 713 bp, Homo sapiens
  misc_feature: GYAE6OF01C2CKP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagtcttggttccagcaagaaaccaggacatcggtcctagcactgctctattttacgtgggccgttacgtacccgggaagttcccggggtcctcgaccgattcaggtggcaggcgggtcgtgggacagtctttacgctctcaccagtcacgcacgcctagacgagctagaagtcgttggacggtacgtttttaatttaagttttacgttacgttacgtaactaaacgtttaaattttagtttaaacccttttccgtttaccccgtttaccccgttaagggttaaaaccccgggttacccggggtttaaacccgggaaaccggggttaaaaaccccggggtaaacggttaaaacgggggttaaaaccgttaaaaaacgttaaaccccggttaaaaaccggacgggtttacgggtacccgggttacaacccggtacccttaaaccgtttaacccgg

SEQ ID NO: 182059 - DNA, 769 bp, Homo sapiens
  misc_feature: GYAE6OF01CK6NA.22.14.B03.1.454.CMB.1.raw
tcagacatacgcgtcacgaccggtgctcgatttagtgtgagtagttccggcgggggagctacaacaggcaggcaggggcagcaagatggtgttgcagacccaggtcttcatttctctgctgctctggatctcgtggtgccgtacggggactattgtgatcgacccagtctccagacctccctggctgtgtctcgtgggcgaggacggccaccatacaactcgacaacgtccacgccagtagttacttttacagcctaccaacaataagtagttactagtcttacgtccagacaacgaaccgagactatccgtcctgctactgacctactacgtttacggcgggtaccgttacccggtaacccgggtaccggtcccggggtcccgtacgtaccgtacgttaccgacggtcgggacgtacgggtccgggtacggtacgggaactacggttactttaccgtacctccgtaccaacctacgtaccgagaccaccgtccgtaggaccgaggtacgttaggaaacgtgttcgggtacgttacgtttaagttttaattaggttaccgtacgtaaacggtattaaaatttacgtttaaacctttacccctttccgtaaccccgttacgtaaaccggggttaccggtttaacccggggaaacccgggtaaaaaccgggggtaaaccgggttaaaacgggtaaaccgggttaaaaaccctaaacgggaaaaccgttaccggttgggtaacccggtacgttaaccggaccccttaaacgg

SEQ ID NO: 182060 - DNA, 574 bp, Homo sapiens
  misc_feature: GYAE6OF01C7WZ8.22.14.B03.1.454.CMB.1.raw
  modified_base (312)..(312): a, c, t, g, unknown or other
  misc_feature (312)..(312): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctccaccaataagtagttactagtcttggttccagcagaaccaggacatcgtactgcactgctacatttacnggtcgtcgtacccgggaatcccgggtcctgaccgtatcgagtcggcaggcgggtctgggacagtacttcactctacaccatcagcacgctagcacggctagaagtagtggtagtcttaagtttattagttcgtacaggtacctaaagttattaacttacttaccttacccgtacgtaacgtacggttcccgaacggaaacgggtacctaagggtacggaaactacgaaaaccgtaactggtacgacctggtaccacgttacg

SEQ ID NO: 182061 - DNA, 519 bp, Homo sapiens
  misc_feature: GYAE6OF01AI7FJ.22.14.B03.1.454.CMB.1.raw
  modified_base (307)..(307): a, c, t, g, unknown or other
  misc_feature (307)..(307): n is a, c, g, or t
  modified_base (465)..(465): a, c, t, g, unknown or other
  misc_feature (465)..(465): n is a, c, g, or t
  modified_base (514)..(514): a, c, t, g, unknown or other
  misc_feature (514)..(514): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctcaccaataagagttactagcttggttccagcagaaccaggacatcgtcctgcactgctcatttacnggcgtctacccgggaatcccgggtcctgaccgattcagtgcagcggtctgggacagatttcactctcaccactacagcacgcctgcaggctagaagagtgtgctagtttattagttgtcagtactaatattattacttcctactcagtacgtcgacgngggaaaaaacctgggtagaaactacgaaacgacgtagtacggactcgcnctacg

SEQ ID NO: 182062 - DNA, 551 bp, Homo sapiens
  misc_feature: GYAE6OF01CC7VS.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaaccaataagagttacttagcttggttccagcaagaaaccaggacatcgtcctgcactgctcatttactgggcgtctacccggaatccgggtcctgaccgattcagtcggcaggcgggtctgggacagtattcactctcacatcagcagcctgcagctagaagatgtgactagttttatagttgtacagtactaaattatttatactttcctctcgaagtaccgttcggaaccaaggggaaccctaagggtaaggaaaacttacgaaaaaccggtacgttcggtacggtactcggacctaaccgttacg

SEQ ID NO: 182063 - DNA, 539 bp, Homo sapiens
  misc_feature: GYAE6OF01A7B3V.22.14.B03.1.454.CMB.1.raw
  modified_base (409)..(409): a, c, t, g, unknown or other
  misc_feature (409)..(409): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccgggtccctgaccgattcagtgcaggcgggtcgtgggacagtattcgactctcaccatcagcagcctgcaggctagaagtntgtgctagtttatattgcagctaattattacttattccctcctctacggtacgtttccggaccgtaacggggaccaagggtaggaaactacgtaaaacgtacgtaggtacggacttcgccgtacgtaacg

SEQ ID NO: 182064 - DNA, 585 bp, Homo sapiens
  misc_feature: GYAE6OF01B622B.22.14.B03.1.454.CMB.1.raw
  modified_base (424)..(424): a, c, t, g, unknown or other
  misc_feature (424)..(424): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttacgtgggcgtccgtacccgggaacgtcccggggtccctcggaccgtattcgagtcggcaggcgggtctgggacagtatttcactctacaccatcagcacgccctgcaggctagaagntgtggacttagttttattacttgtaccagtacaaagttattaattactttccctaccttacgtacggttaccggttccggaacccgtaaacggggtaaccctaagggtacggaaaacttaccgaaaaacgtacgtgggtacgaccttcggacctacctacg

SEQ ID NO: 182065 - DNA, 710 bp, Homo sapiens
  misc_feature: GYAE6OF01D8JUI.22.14.B03.1.454.CMB.1.raw
  modified_base (566)..(566): a, c, t, g, unknown or other
  misc_feature (566)..(566): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgagagggccaccatcaactgacaagtccagccagtagttatttttacagctaccaaccaataagtagttacttagtcttggttaccagtacgaacgaaaccaggacagtcgtcctgctactgctactatttacgtggtcgtaccgtacccgggtaagtcccgggtaccctacgaccgtattcgagtcggcgacggccgggtcgtagggaacgtagtacgtttccacgttcctaccaacctatccaagggccctacgtcccgtggaccgtaagggaccgtaaggaacggttagtcgggtacggtactttaagttttagttacgttaggtaaccaaggttacttaaaatttacgtttaacttactttacccccnccgttaaggaaaccggttacccgggttaccggaaacccggtaaaacggggtaaacccgtaaaggggttaaccggtaaaaaccttaccggaaaaacggttaccgttcggggtacggaccctttacggaaccctaaccggttaacg

SEQ ID NO: 182066 - DNA, 788 bp, Homo sapiens
  misc_feature: GYAE6OF01B08SQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagactccctggctgtgtctcgtgggcgagacgggccacatcaactgacaacgtccacgccagtagtttaatttttacacgtcctaccaacctaaagttaaagtaacgtttaccgttaagtcgtttacgggttacccaggaccgaaacggaaacccgtaaggtaaccgtacttcccggttcctacggtaccaccgttcgtaccttaccttaacgttttacggtccggggtaccgtaccccgggttaaaccccggggtaaaccgggttccccggggttacccgttacggaacccggttaacgtaccggtaacggggttcggaccggtacggggtcccggggttacggtacgggggtaacctaacgggttacttttaccgaccgtttacctaccgtaacccgtaacttccgaacgccaccggtccgtcggacgacggtctaggaagtagtcggtaggtacttaaggttttattacgttacggtactacggtacttaaatttacgttaactttccttacccgtaccgttacgtacggttacccgggtacggtaacccggtaacggaaccgtaagggtaacgtaaacaaccgtaaagtccgtagaccggtacacgctacgtacg

SEQ ID NO: 182067 - DNA, 589 bp, Homo sapiens
  misc_feature: GYAE6OF01CYLJM.22.14.B03.1.454.CMB.1.raw
  modified_base (581)..(581): a, c, t, g, unknown or other
  misc_feature (581)..(581): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggacgggccaccatcaactgcaagtccagccagtagttatttttacagctaccaacctaataagtagttacttagtcgttggtccagcaagaaccaggacatcgtctgcactgctctattacgtcggcgtcgtacccgggagtcccgggtacctcggaccgtatcgaggtcgacgaggccgggtacgtcgggactaggtacttccacgtcctacacctatcacgcacggcctggcgtacggtctagggaacgtgtggtacggtacttaaggttttacttagttcgtacgtagtactaaagttacttacttacgttccctacgtacgtacgtcggtaccgacgaacgggactaagggataactacgaaacgtacgtggtacgacngccatacg

SEQ ID NO: 182068 - DNA, 705 bp, Homo sapiens
  misc_feature: GYAE6OF01EARCI.22.14.B03.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtctgcactgctnatttactggcgtctacccgggaatccgggtcctcgacgacttcgagtacgcgagcgggtacgtcgggtacgagtattctaccgtctactaccaacttcgagcgtaacgcccttacgcgaacggtcgtacgaagggtaattcggtaggacccgttaagttttaaggtttaacctacggttcctaaggacccttaaaagtttacgttttaaatttacctttaccccgttacccgttaaccgtaagggtaaccccggtttacgggtaaccccttaaaacggggggggtaaaacccctaaacgggggttaaaggggttaaaaccttaaaaccccgggtaaaaaaccggtaaaacgtttcggggttaacggaaccccgtttggtaaacccgaacccccgtttaaacggg

SEQ ID NO: 182069 - DNA, 528 bp, Homo sapiens
  misc_feature: GYAE6OF01A6TXM.22.14.B03.1.454.CMB.1.raw
  modified_base (414)..(414): a, c, t, g, unknown or other
  misc_feature (414)..(414): n is a, c, g, or t
  modified_base (461)..(461): a, c, t, g, unknown or other
  misc_feature (461)..(461): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttacgtgggctccgtacccgggaatcccggggtccctgaccgattcagtcggcaggcgggtctgggacagtacttcactctcaccatcagcacgcctgcagctagaagntgtggctaggtttattagttgtcagctaattattatacttcctactnagtacgtcgacgtaagggacctaagggtacgaaatacaaacgtacgtcgtcggactgaccgactacg

SEQ ID NO: 182070 - DNA, 591 bp, Homo sapiens
  misc_feature: GYAE6OF01EHLO7.22.14.B03.1.454.CMB.1.raw
  modified_base (425)..(425): a, c, t, g, unknown or other
  misc_feature (425)..(425): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctattttacgtgggtcgtccgtaccccgggaagttcccggggtccctggacccgattcaggtggcgaggcgggtctgggacagtattcactctcaccatcagcagccctggcaggctagaagntgtcggcttagttttattagttgtacagactaagttatttaattcttaccctccttacaacggttaccggttaccggaaccgtaaacggggtaaccgtaaaggggtaacgaaaacgttaccgaaaaccggtaacgttagggacggtacctcggacctaccgtaacg

SEQ ID NO: 182071 - DNA, 537 bp, Homo sapiens
  misc_feature: GYAE6OF01EMCDX.22.14.B03.1.454.CMB.1.raw
  modified_base (423)..(423): a, c, t, g, unknown or other
  misc_feature (423)..(423): n is a, c, g, or t
  modified_base (454)..(454): a, c, t, g, unknown or other
  misc_feature (454)..(454): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagtatttcactctcaccatcagcagcctgcaggctgaagatggtgctagtttattnttgtcagactaattattattacttcctcctnacgtaccgttcggacctaaaggggtaccctaagggtaggaaaacttaccgaaaacgtacttggtacggactacgccacctacg

SEQ ID NO: 182072 - DNA, 594 bp, Homo sapiens
  misc_feature: GYAE6OF01AGNDJ.22.14.B03.1.454.CMB.1.raw
  modified_base (315)..(315): a, c, t, g, unknown or other
  misc_feature (315)..(315): n is a, c, g, or t
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttattttttacagtctaccaccaataagagttacttagcttggttccagcagaaaccaggacatcgtcctgcactgctcatttacgngggctcgtacccggaacgtcccgggtcctcgaccgtattcgagtcggcacggcgggtctgggacagtacttcactctacacctntcagcacgccctgacaggctagaagtntggtcgattagtttattacgttggtacagtactaaagttattacttacgtttccctacctacgtacggtaccgtttaccgggacccgaaagggggtaccctaaaggggttacggtaaaacttcccgaaaaagtaccgttggtacggaccttcggaccctacgttaccg

SEQ ID NO: 182073 - DNA, 551 bp, Homo sapiens
  misc_feature: GYAE6OF01EVGV7.22.14.B03.1.454.CMB.1.raw
  modified_base (398)..(398): a, c, t, g, unknown or other
  misc_feature (398)..(398): n is a, c, g, or t
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccgggacatcgtgatgacccagtctccagactccctggctgtgtctctggcgagagggccaccatcaactgacaagtccagccagagtatttttacagctccaccaataagagctacttagcttggtccagcagaaaccagacatcctcctctactgcctctatttacgtgggcgttaccgtacccggaacgtcccgggtccctgaccgtattcgagtggcaggtcgggtctgggacagtattcactctaccactatcngcacgctgcagctgaagntgngtntgtttatagtgtcagctaagttacttattacttccctctacgtacgtaccgttaccggacccgtaaaagggtaccgtaaagggtacgaaataaccgaaaccgtacgtgtacggaccttagcccactacg

SEQ ID NO: 182074 - DNA, 543 bp, Homo sapiens
  misc_feature: GYAE6OF01DSPPW.22.14.B03.1.454.CMB.1.raw
  modified_base (451)..(451): a, c, t, g, unknown or other
  misc_feature (451)..(451): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagcttggttccagacagaaaccaggacatctcctgcactgctctatttactgggcgtccgtacccgggaagtcccgggtcctcgtaccgattcagtggcgaggcgggtctggggacaggtaactttcacgttctaccaccgatccaagccagtcccgtgacagggctagaagagtggtgacttagtttactangtacagcctaaattattatcttacctctactagtaccgttggaccaagggacctaaggtgaaactgaaaacgtatgtaggactgctaccgta

SEQ ID NO: 182075 - DNA, 601 bp, Homo sapiens
  misc_feature: GYAE6OF01EO2Y0.22.14.B03.1.454.CMB.1.raw
  modified_base (407)..(407): a, c, t, g, unknown or other
  misc_feature (407)..(407): n is a, c, g, or t
tcagacatacgcgtcacgaccggtgctcgatttagtgtgagtagttccgcgggggagctacaacagacaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcaagaaaccaggacatcgtcctgcactgctcatttactggcgtcgtacccggaatccgggtccctgaccgattcagtggcaggcgggtctgggacagtattcactctcacatcagcagcctgcaggctagaagtntggtgactagttttatagttcgtacagctaaattactttacttactttccctaccgttacgtaacggtacccgtttaccgggaacccgtaaaagggggtaaccccgtaaaggggttaaccggtaaaaacttacccggaaaaacccggttaaaccgttgggtacgggtaccttacggacccgtaaacccgttacg

SEQ ID NO: 182076 - DNA, 588 bp, Homo sapiens
  misc_feature: GYAE6OF01AP164.22.14.B03.1.454.CMB.1.raw
  modified_base (439)..(439): a, c, t, g, unknown or other
  misc_feature (439)..(439): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagtctccaccaataagagttacttagcttggttccagcaagaaaccaggacatcgtcctgcactgctctatttacgtgggcgtccgtacccgggaacgttcccggggtccctcggacccgtattcgaggtggcgaggtcgggtcgtggggacaggtacgttcactcctacgaccatcagccacgtccctgcagtctagaatntttcgcttactttatactgtcagctaatataatgtacttggtctacgtactccgtacccgttccggacccgtaagggacctacggtacgttagggaaacgttaaacgtttaaaaccggaacggtttcggacgggtaccttggtaacccc

SEQ ID NO: 182077 - DNA, 567 bp, Homo sapiens
  misc_feature: GYAE6OF01E1O7J.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagtatttttacagctccaccaataagagttacttagcttggttccagcagaaaccaggacatcgtcctgcactgctcatttactggtcgtcgtacccgggtaagtcccgggtccctgaccgatcagtgcaggtcgggtctgggacagtattcactctcaccatcagcacgtcctgcaggtctagaagtgttggtcggacttaagttttattagttcgtacagtactaattattatacttcctacctagacgtaccgttaccggaccgtaaacgggacctaaagggttacgtaaaactaccgaaaacggtacgtagggtacgctacggtacctaaccgtacg

SEQ ID NO: 182078 - DNA, 656 bp, Homo sapiens
  misc_feature: GYAE6OF01DBKT3.22.14.B03.1.454.CMB.1.raw
  modified_base (423)..(423): a, c, t, g, unknown or other
  misc_feature (423)..(423): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaacgtccagccagtagttatttttacagctccacaataagattactagtcttcggttccagcaacgaacaggactactcgtcctgctacgtcgctctatttacgtcgggtcctaccgtacccgggtaacgtcccgggtcccgtacgaccgtacgtcgaggtggcgacggtcgggtcgtcgggactagtcttccactctccaacctntccgacgcaccgtccctggaccgaggtcctaaggaacgtaggtcggtacggttactttaaggttttattagttcggtaacgaagtaacttaacgtttattaacgttcctttacccttcgtacgtaacggttaccgttaccgggaacccgaaggggtaaccgtaagggttaacggaaaaccttaccggaaaacgttaacggttcggtaccgacgttacgaccctacgttaccgg

SEQ ID NO: 182079 - DNA, 532 bp, Homo sapiens
  misc_feature: GYAE6OF01CHWXD.22.14.B03.1.454.CMB.1.raw
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (302)..(302): a, c, t, g, unknown or other
  misc_feature (302)..(302): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctcaccaataagagtactagctggtccagcagaaccaganatcgtcctgcactgctnatttacngggcgtcgtacccggaatccgggtccctgaccgattcagtgcagcggtctggacagtatttcactctcacatcagcagcctgcaggctagaagtatgtgctagtttattaagtgtcagcaattaacttatacttcctactcagtaccgttcggtagaaaccgggtaacgaagggttaggaaaatacccgaaaaagtaaccgtaggtaggaccttacggctaacccgtaac

SEQ ID NO: 182080 - DNA, 551 bp, Homo sapiens
  misc_feature: GYAE6OF01BU5O3.22.14.B03.1.454.CMB.1.raw
  modified_base (355)..(355): a, c, t, g, unknown or other
  misc_feature (355)..(355): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttattttttacagctccaccaataagagctacttagcttggttccagcagaaaccaggacatcctcctctactgctctatttactgggcgtccgtacccgggaactcccggggtccctgaccgattcngtggcaggcgggtctgggacagtatttcactcctcaaccatcacgcacgcctgcaggctagaagtgtgtggactagtttattactggtacagtacaattacttattactttccctacctcgtaggtacgttccggacgtaaacgggacctaagggtagaaactacgaaaagacgtggtacggatcggccaactacg

SEQ ID NO: 182081 - DNA, 581 bp, Homo sapiens
  misc_feature: GYAE6OF01DJ8G4.22.14.B03.1.454.CMB.1.raw
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcagggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttattttttacagctccaaccaaataagagttactagtcttggttccagcaagaaaccaggacatcgtcctgcactgctctatttacgtcgggcgtcgtacccggaacgtccggggtccctgaccgtattcgaggtcggcaggtcgggtcgtggggactagtactttcactctaccaacctactcacgcacgccctgccaggctaggaagtagtcgnggtacttagttttattacgttgtactagactaattattattacttccctctacgtacgtacggttccggaccggtaagggaaccgtaagggtaagaaactaacgaaacgtacgtcggtacgctacgccaccgtac

SEQ ID NO: 182082 - DNA, 554 bp, Homo sapiens
  misc_feature: GYAE6OF01CT68L.22.14.B03.1.454.CMB.1.raw
  modified_base (311)..(311): a, c, t, g, unknown or other
  misc_feature (311)..(311): n is a, c, g, or t
  modified_base (470)..(470): a, c, t, g, unknown or other
  misc_feature (470)..(470): n is a, c, g, or t
  modified_base (486)..(486): a, c, t, g, unknown or other
  misc_feature (486)..(486): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttacttagcttggttccagcagaaaccaggacatcgtcctgcactgctctatttacgngggcgtccgtacccgggaagtcccggggtccctgaccgtattcaggtcggctaggcgggtcgtgggacgtagtactttcgacttctacgaccatccagccacgccctgccgtaggctagaagtatcggtggcttagtttattagttgctaagctaaatnttaactcttcctactnacgtacgttcgacgaacggtaccaaggtagaaactacgaaacgtagtcggtagctacgctaccgtacg

SEQ ID NO: 182083 - DNA, 531 bp, Homo sapiens
  misc_feature: GYAE6OF01CX05S.22.14.B03.1.454.CMB.1.raw
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcaagaaaccaggacatcgtcctgcactgctcatttactgggcgtccgtacccgggaagtcccgggtcctgaccgtattcgaggtcggcgagcgggtcgtgggacagtacttcactctcaccatcagcacgctgcaggctagaagntgngctagtttattattgtacagtactaattattattacttcctctacgagtaccgttccgacgaagggacctaaggtagaaactacgaaacgactggtagctacgcgactacg

SEQ ID NO: 182084 - DNA, 538 bp, Homo sapiens
  misc_feature: GYAE6OF01CHAA4.22.14.B03.1.454.CMB.1.raw
  modified_base (388)..(388): a, c, t, g, unknown or other
  misc_feature (388)..(388): n is a, c, g, or t
  modified_base (406)..(406): a, c, t, g, unknown or other
  misc_feature (406)..(406): n is a, c, g, or t
tcagacatacgcgtcacgaccggtgctcgatttagtgtgagtagtcggtcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaccaggacatcgtcctgcactgctcatttactggcgtctacccgggaatccggggtccctgaccgtattcagtggcagcgggtctgggacagatttcactctcaccatcagcngcctgcaggctagagtangtagctagtttacttattgtcagtataatatttatacttcctccttcaggtaccgttccggacccgtaaagggtacccgaaagggttaggaaactacgaaaaggtactaggtcggacttagccgaacctacg

SEQ ID NO: 182085 - DNA, 636 bp, Homo sapiens
  misc_feature: GYAE6OF01CNKOO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagaccagtagttatttttacagtctccaacaataagtagttacttagtcttggttaccagcaagaaaccaggacatcgtcctgcactgctctatttacgtgggaccgtccgtaccgggtaacgtcccggggtccctcgaccgtattcgaggtggcaggcgggtcgtaggggacaggtattcacgtctcaaccatcaagtccacgccctagacgaggtactaggaatcgttaggtcggtaccttaagtttactttaagttcgaacaacggtacctaaaagtttctaaactttacgtttccccgtacttacgaacggttaccgggttcccggaagtaaaccggggtaaccgtaaagggtacgtaaaacgttaccgaaaaccggttaactcgggtagaccgttacaccgttaacctacg

SEQ ID NO: 182086 - DNA, 647 bp, Homo sapiens
  misc_feature: GYAE6OF01CE4K5.22.14.B03.1.454.CMB.1.raw
  modified_base (637)..(637): a, c, t, g, unknown or other
  misc_feature (637)..(637): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagtctaccaacaataagtagttacttagtcttggttccagtacaagaaaccaggacatccgtcctgcactgctactatttacgtgggtccgtaccgtaacccgggtaacgtcccggggtacctacggaccgtattccgaggtcggcgacggcgggtcgtggggactaggtactttccacgtcctaccacctatacgacgtccgtaacgccgttacggaccgtaacgggcttaaggaaaggttcgttagggtcgtaacgtttaagttttaatttacgttggtactacggtaactaaatttacgttattacctttccctacgtacgtacggttaccggttccgaaccgtaagggacccgtaaaggtacgaaactacgaaacgtacgtcggtacgtcgtacnccgtctaacg

SEQ ID NO: 182087 - DNA, 687 bp, Homo sapiens
  misc_feature: GYAE6OF01C4G5O.22.14.B03.1.454.CMB.1.raw
  modified_base (321)..(321): a, c, t, g, unknown or other
  misc_feature (321)..(321): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagagttatttttacagctccaaccaataagagttacttagctttggttccagacaacgaaaccaggacatcgtcctgcactcgctctactttacgngggtccgtaccggtaaccccgggaacgttccccggggtccctacggaaccgtaactttaccgaggttcggacgtaacgggtccggggtcgttacggggactagtacgtttcaactcctaccaaccatcagcagcccgtgaccaggctagaagtagttggtggacttaaggttttatttagttacgtacgaagtactaaattaatttaactttaccttcccttacccgtacgtaccggttaaccggttaccggggaaacccgtaaacgggggtaaaccgtaaaagggggttaacggtaaaaaacgttacccgaaaaaacggttaccggtacggtagggtaccttccggaaccctaaccggttaaccg

SEQ ID NO: 182088 - DNA, 550 bp, Homo sapiens
  misc_feature: GYAE6OF01AVFUZ.22.14.B03.1.454.CMB.1.raw
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagccctgcaggctgaagntgtgctagtttatnttgtcagctaattattattacttccctcctactacggtaccgtttccggacccgaaaggggtacccaaggggtacggaaaactaccgaaaaccggaacgttaggtacggacctcggcctaaccgtacg

SEQ ID NO: 182089 - DNA, 745 bp, Homo sapiens
  misc_feature: GYAE6OF01C6RTI.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtcgtctcgtgggcgaggacgggccaccatcaactgacaacgtccagaccagtagtttatttttacacgtctaccactaaataagtacgttacttagtcgttcggttccagacaacgaaaccgaggacagtcgtctacgcactcgctctacgtttacgtcgggtcgtacctaccgtagtaccgtacccggggtcctacggaccgtagttcgaggtcggacgacgggcgggttacggtacggacgtaagtacttacctaccgtctaccaacctacgtaccacgggacctacggtacccgtggacccgtaggggtacccttagggaaaacggttgttacgggtacggtaccttttaaggtttttaaccttaggtttacggtacgtaacggttaacttaaatttaactttaactttacccttaccccgttaccgttaaccggtacgggtaacccggtttaaccgggacccggtaaaacgggggttaacccgtaaaggggtacgtaaaaacgttaacccggaaacgttaaccggttgggtaaccgggcttaaccggacccttaaaccg

SEQ ID NO: 182090 - DNA, 622 bp, Homo sapiens
  misc_feature: GYAE6OF01DNQQZ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaacaataagtagttacttagcttgttccagcagaaaccaggacatcgtcctgcactgctctatttacgcgggtcgtccgtacccgggaacgtcccggggtccctcgaccgtattcgagtggcaggcgggtcgtgggacagtactttcactctccaccatcgacgcagccctaggacacggctaggaaatgttcgtacgggtacttaggttttaattagttcgtctaaggtactaaagtttactttaatttactttcccttacctacgtaaccggttaccggttacccggaaccgtaaacggggtaaaccctaaggggtttaaagtaaaacttacccgaaaacgtaaaccgttggtacgccttaacggcctaacctacg

SEQ ID NO: 182091 - DNA, 525 bp, Homo sapiens
  misc_feature: GYAE6OF01AUGXZ.22.14.B03.1.454.CMB.1.raw
  modified_base (407)..(407): a, c, t, g, unknown or other
  misc_feature (407)..(407): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccgggtccctgaccgattcagtggcagcgggtctgggacagatttcactctcaccatcagcagcctgcaggctgaagntgtggctagtttatattgtcagtctaattattatacttcctcctacgagtacgttccggaccaagggacccaagggtcggaaataccgaaaacgacgtgtacggactcgccacctacg

SEQ ID NO: 182092 - DNA, 628 bp, Homo sapiens
  misc_feature: GYAE6OF01C1UK6.22.14.B03.1.454.CMB.1.raw
  modified_base (336)..(336): a, c, t, g, unknown or other
  misc_feature (336)..(336): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatcaactgacaagtccagaccagtagttactttttacagtctaccaacctaaataagtagtttacttagtcgttcggttaccagacaagaaaccgaggacactccgtcctgcactgctactattacgngggtccgtacggtacccggtaacgtccgggtcctacgaccgtatcgagtcgacgacggcgggtcgacgggacacggtacttacgactctacacctatcgagccagtaccgtgacaggtactaggaagtgtgtggtacttaagtttatagtcgtacgaagtactaagttacttaacgtcttaccgtacgtacgtaccggtacgtaccggaaacgtaacgggtaaccgtaagggttaaccgaacttaaccggaaaacgttcgtaacggtcgacttacgacccgtaacgttaccg

SEQ ID NO: 182093 - DNA, 564 bp, Homo sapiens
  misc_feature: GYAE6OF01B8KSG.22.14.B03.1.454.CMB.1.raw
  modified_base (309)..(309): a, c, t, g, unknown or other
  misc_feature (309)..(309): n is a, c, g, or t
  modified_base (417)..(417): a, c, t, g, unknown or other
  misc_feature (417)..(417): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggtcgtccgtacccgggagtcccggggtccctgaccgtattcagtcggcacggcgggtctgggacagtatttcactctacaccatcagcagcctgcaggctagaagntggtgcttagtttattagttgtcagactaatatttatactttacctcctacgtacggtaccgtttccggaccgtaaacgggaccctaagggttacgaaaacgttccgaaaacggtacgttggtacgggtactacggcctaaccgtac

SEQ ID NO: 182094 - DNA, 603 bp, Homo sapiens
  misc_feature: GYAE6OF01CHBVN.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctatggtgcctacggggacattgtgatgacccagtctccagactccctggctgtgtctcgtgggcgagacgggccaccatcaactgacaacgtccagccagtagttatttttacagtcctaccaaccaataagtagttacttagtcttggttccagtacaagaaaccaggacatcgtctagcactgctactattacgtggccgtacgtacccgggaacgtcccgggtcctacgacgtacttcgaggtcggacgaggtcgggtacgtgggacaggtacttcactctacacctatacgacgtacacgctagacgtaggtactaggaacgtagttggtcgtacttagtttaacttagttcgtacagtactaagttattacttacttctcctagtcgtaacgttcgaaccgtaacgggaacctaagggtaacgaaactaaccgaaaacgtacgtacggtacggactacgtcacgtaacg

SEQ ID NO: 182095 - DNA, 608 bp, Homo sapiens
  misc_feature: GYAE6OF01AEMWS.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctattttacgtgggtccgtaccgtaaccccggggtaacgttccccggggtccctcggacccgtattccgaggtcggcgaggcgggtcgtggggactaggtactttcactctaccacctatcacgcacgccctgcgaggctaggaagtagttggtggtacttaaggttttattagttcgtacaagtactaattaattacttacttccctacctacgtacggtaccgttccggaaccgtaacgggtaccgtaagggtacggaaactaccgaaaacgtacgtacgggtacgtactcgaccaccgttacg

SEQ ID NO: 182096 - DNA, 518 bp, Homo sapiens
  misc_feature: GYAE6OF01C4PN5.22.14.B03.1.454.CMB.1.raw
  modified_base (412)..(412): a, c, t, g, unknown or other
  misc_feature (412)..(412): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctaccccgggaatcccggggtccctgaccgattcagtggcagcgggtctggggacagatttcactctcaccatcaagcagcctgcagctgaagatgngcagtttatattgcagctaatattatattcctctcgatacggttccggacaagggaccctaagggtaggaaaactacaaaacgtaactggtaggctagcacctacg

SEQ ID NO: 182097 - DNA, 584 bp, Homo sapiens
  misc_feature: GYAE6OF01A1F4G.22.14.B03.1.454.CMB.1.raw
  modified_base (325)..(325): a, c, t, g, unknown or other
  misc_feature (325)..(325): n is a, c, g, or t
tcagacatacgcgtcacgaccggtgctcgatttagtgtgagtagttccgcgggggaggcgtacaacaggcaggcaggggcgagcaagatggtgttgcagacccaggtcttcactttctctgttgctctggatctctggtgccgtacgggacattgtgatgacccagtctccagactccctggctgtcgtcgtctgggcgagagggccaccatcaactgcaagtccagccagagttatttttacagctccactaataagattactagacgttggttaccagacgacgaaccgaggacatcgtactagacactgctactatttacgnggacgtaccgtacccgggaacgtccggggtcctcggaccgtagttcgaggtcgcgacggtcggtcgtcgggacagtacttacactctacacatcagcacgctgcgaggctagagcgtgtagtcttagtttatagttagactagtactaagttattaacgttcttcctacgttcgaacgttcggtacggaaccgtaaacgggacgtaaggacggtaaactaccgtaaaggacgtggacggactacgtcccgaccgttacg

SEQ ID NO: 182098 - DNA, 771 bp, Homo sapiens
  misc_feature: GYAE6OF01BUOS8.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccagccagtagttatttttacagcctaccaaccaataagtagttacttagtcttcggttccagcaagaaaccaggactagtcgtacctgactactgtctactactttacgtcgggtccgtaccgtaacccgggtaacgtcccggggtccctcgaccgtattcgacggttcggacgacgggtccgggttcgtacggggtaaccgtaggttactttaccgaccgttccttaccgaacccgtacgttacccgaacgggtaccgtaacccgggtaccccgttgggaccgtaaccggggttacccgtaagggtaaaaggttcgttacgggggttacgggtaccttttaaaggggttttttaacttaggtttacgttacgaacggttacttaaactttaactttacgttaccctttacccgttaccgtacgtaaccggttacccgggttaccgggaaccggtaaacggggtacccgtaaagggttaaccggtaaaacgttacccggaaaaacggttacggtcggtaccggtacccttcggaacccttaacgttaaccg

SEQ ID NO: 182099 - DNA, 630 bp, Homo sapiens
  misc_feature: GYAE6OF01DDIT6.22.14.B03.1.454.CMB.1.raw
  modified_base (323)..(323): a, c, t, g, unknown or other
  misc_feature (323)..(323): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagactccctggctgtgtctcgtgggcgagagggccaccatcaactgacaagtccagccagtagttatttttacagctaccaacaataagtattactagtcttggttccagacaagaaaccgaggacatcgtacctgcactgctactatttacgngggtctccgtaacccggagtcccgggtcctcgaccgtattacgaggtcggacacggtccgggtcgtagggactagtactttccgactctacgactatacacggcaaggccctggaccgaaggtctaagggaaagttgtggtaggacctttaagttttaatacgtggtacaacgtacttaaagtttattaacttaccgtttcccctacgtaacgtagtaccccgggttacggaaacccaaagggggacctaaagggtaggtaaaactacccgaaaagtacctgggacggacgcgtaaccaccgttacg

SEQ ID NO: 182100 - DNA, 566 bp, Homo sapiens
  misc_feature: GYAE6OF01CCGIS.22.14.B03.1.454.CMB.1.raw
  modified_base (309)..(309): a, c, t, g, unknown or other
  misc_feature (309)..(309): n is a, c, g, or t
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttactagcttggttccagcaagaaaccaggacatcgtcctgcactgctcatttacngggctcgtacccgggaatcccggggtcctgaccgattcagtggcaggcgggtctgggacngatttcactctcaccatcagcagcctgcaggctagaagntggtgctagttttattagttgtacagtctaaattattacttacgttccctcttacgagtaccggttccggaccgtaaacggggtacctaaaggggttacggaaaagttacccgaaaacggtaaccgttgggtacggtacacggacctaacccgttacg

SEQ ID NO: 182101 - DNA, 629 bp, Homo sapiens
  misc_feature: GYAE6OF01D84MM.22.14.B03.1.454.CMB.1.raw
  modified_base (453)..(453): a, c, t, g, unknown or other
  misc_feature (453)..(453): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacggggccaccatcaactgacaacgtccagccagtagttatttttacagtcctaccaacctaataagtagttacttagtcttggttccagacaagaaaccaggactactcgtcctgctactgctctatttacgtgggtccgtaccgtacccgggtagtccccggggtcctacgaccgtacttcgaggtcggactacggtcgggtcgtaggacgtagtacttccacgtcctctaccactcaacgcacgtcctggacncgggtactaaggagagttcgggtagtaccttaagttttacttagtagtaccaagtactaagttattacttacttcctacgttactacggtacccggttcggaaccgtaaaccgggacgtaagggtacggaaactaccggtaaaagtacgtcgtcggacttacgacctacgttaccg

SEQ ID NO: 182102 - DNA, 636 bp, Homo sapiens
  misc_feature: GYAE6OF01AS0AV.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaacgtccagccagtagttatttttacgagtcctaccaacctaataagtacgtttacttagtcttcggttccagacaagaaaccgaggactactccgtcctgccactcgactctacgtttacgcgggtcgtaccgtacccgggtacggtcccgggtccctcggaccgtacttacgaggtcggacgacggtcgggtcgtgggactagtacttccactcactaccatcacgcagcctgacgaggtctaggaagtgtcgtacgtactttagttttactagttgacaagtacttaaatttattacgttacctttcccgtacttacggtacgtaccggttccgaaccggttaaacgggtacgtaagggtaacgtaaaacgtaccgtaaaaggaccgttgggactaacgtcgtaacgtccgttacgg

SEQ ID NO: 182103 - DNA, 543 bp, Homo sapiens
  misc_feature: GYAE6OF01D7RSE.22.14.B03.1.454.CMB.1.raw
  modified_base (399)..(399): a, c, t, g, unknown or other
  misc_feature (399)..(399): n is a, c, g, or t
  modified_base (423)..(423): a, c, t, g, unknown or other
  misc_feature (423)..(423): n is a, c, g, or t
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacaggtatttcactctccacatcagcagccctgcnggctagagatgtgctagtttattnttgtcagctaattatttatatttccctctcacgtaccgttccggacctaacgggaccctaagggttaggaaaacttaccgaaaacggtaaccttggtacggacttcgcctacccgtaacg

SEQ ID NO: 182104 - DNA, 868 bp, Homo sapiens
  misc_feature: GYAE6OF01DFMEA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgccgtacggggactattgtgatcgaccctagtcctccagtacctcccgtggtctgtcgtctcgtgggcgaggacggccaccatccaactcgactaacgtccacgaccgtagtacgttttactttttaccgacgtaccctacctaaacctaaagttaaacgtaacgttttaaccgtttacggtccgttttacggttacccaaggtaccaaaacggaaacccgtaaggaccttacgtccgtcctacgtacctacgtcgtccttactttacggtttacggtccgggtacccgtaaccgggtaccccggggtaaccggttccccgggtaccgtacggtaaccggtacgttacgggacggtcgggaccggtcgggttaccggggtacgtacgggtaaccgttacgtttacctttaccgtacccttacccgtaacctaaccgtgtaccgacgtccgtaacgtcgaacggtacgtacggtaacgtaaggtagtcggttacgggtactttacggtttaatttttaggttacgttacgaacgttaacgttaacttttaagttttaactttacccttaccccggttttaccctaacccggttacggggttaaacccggttcccgggttaaaccggggaaacccgggttaaacggggaaaccgtaaagggttaaaccgtaaacgtaaaaccgtacggttaaccggttcgggaccggttaccacgttacccgtacgttaaccg

SEQ ID NO: 182105 - DNA, 531 bp, Homo sapiens
  misc_feature: GYAE6OF01EP9TI.22.14.B03.1.454.CMB.1.raw
  modified_base (413)..(413): a, c, t, g, unknown or other
  misc_feature (413)..(413): n is a, c, g, or t
  modified_base (457)..(457): a, c, t, g, unknown or other
  misc_feature (457)..(457): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactgctcatttactggcgtctacccgggaatcccggggtccctgaccgattcagtggcagcgggtctgggacagtatttcactctacaccatcagcacgccctgcagctagaaagntgtggctagtttatactgtcagacaattattattattcctcctnacgtacgttccggaccgtaaacgggacaaaggtaggaaaatacgaaaacgaactgtacggactggacaccctaa

SEQ ID NO: 182106 - DNA, 739 bp, Homo sapiens
  misc_feature: GYAE6OF01C2RCZ.22.14.B03.1.454.CMB.1.raw
  modified_base (616)..(616): a, c, t, g, unknown or other
  misc_feature (616)..(616): n is a, c, g, or t
  modified_base (734)..(734): a, c, t, g, unknown or other
  misc_feature (734)..(734): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgacccagtctccagacctccgtggctgtcgtctcgtgggcgaggacggcccaccataccgaaactcgacctaacgtaccgacgaccgtaaggttacgttttaactttttaaccgacgtccttacccaaactaaagttaacggtaacgtttacgttagtccgtttaggttacccagaccgaaacgaaaccgaggactacgttaccgtctcgacctacgtcgtcctaacttagttaccggtacgggtaccgttaacccggtaccccggggtaaccggttccccgggtaccgtaccgtaccgttacgttaccgtacgggtcggtaccggagggtccgggtaggtacggtacgtacgttcttaccgtacctcctacgaactacgcgtaacgcgaacgtccgtacgacgtacgcgtaacggagtcggtaggtacgttacgttaattttacgtagttacggtanacgttaacttaattagttacctttcgttacctacgtacgtaaccggttccggtaccggtaacggaaccgtaaggtaacggttaaagaactacgaaacgtgtacgtacgcacacccgtntcccg

SEQ ID NO: 182107 - DNA, 534 bp, Homo sapiens
  misc_feature: GYAE6OF01BWJLW.22.14.B03.1.454.CMB.1.raw
  modified_base (385)..(385): a, c, t, g, unknown or other
  misc_feature (385)..(385): n is a, c, g, or t
  modified_base (409)..(409): a, c, t, g, unknown or other
  misc_feature (409)..(409): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccgggtccctgaccgattcagtggcaggcgggtctgggacagtatttcactctcaccntcagcagccctgcaggctagaagntgtgctagttttatattgcagctaattattatacttccctctcaggtaccgttccggaccgtaaaggggacctaagggtacggaaataccgaaaacgacgttagtacggactcgccaaccgtacg

SEQ ID NO: 182108 - DNA, 648 bp, Homo sapiens
  misc_feature: GYAE6OF01AU747.22.14.B03.1.454.CMB.1.raw
  modified_base (312)..(312): a, c, t, g, unknown or other
  misc_feature (312)..(312): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccacatcaactgcaagtccagccagagttatttttacagctaccaccaataagagttacttagcttgttccagcagaaaccaggacatcgtcctgcactgctctatttacgngggccgttcgtacccgggaattcccggggtccctggacccgtattccgaaggtcggcgacggtcgggtcgtcggggtacagtacttttacgaccttacgtacccacctataccgaacgccgacgccctggaccgtaggtccctagggaagtagttcggtggtacttaaggttttattagtttgtaccaagtactaaagttactttaacttactttcccgtaccttacgaaccggttaccggttacggacccgttaaacgggtacccgaagggttaggaaaaccttacgaaaaaccggtaccttagggtaccgtacgtacgacccgtaaccgttccg

SEQ ID NO: 182109 - DNA, 592 bp, Homo sapiens
  misc_feature: GYAE6OF01BFUQL.22.14.B03.1.454.CMB.1.raw
  modified_base (313)..(313): a, c, t, g, unknown or other
  misc_feature (313)..(313): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaaccaataagagttacttagcttggttccagcaagaaccaggacatcgtcctgcactgctctatttacgnggccgtactacccgggaatcccgggtccctgaccgnttcaggtgcaggcgggtctgggacagtattcactcncacatcagcacgcctagcaggtctagggaanacgttggtacgggtcttaggttttaattagtttcggtactacggtaactaagtttaatttaacttactttccctacctacgtaacgtaccggtttccggaaccgtaacggggacctaagggtaaggaaaactaccgtaaaacgtacgttaggtacggattcggacctaccgtaacg

SEQ ID NO: 182110 - DNA, 754 bp, Homo sapiens
  misc_feature: GYAE6OF01EIEN0.22.14.B03.1.454.CMB.1.raw
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagacctccctggctgtgtctctgggcgagagggccaccatcaactgcaagtccagccagtagttatttttacagctacaccaataagagttacttagtcttggttaccagtcaagtaaaccaggacatccgtacctgctacngctctaatttacgnggacgtctacccgggtaactccgggtccctgaccgtattcgagtcggcaggtcggtacgtgggaaccgagttagtttaccacttaccctacctaaccggtacttaccgaaggttccaacggttcccgtaacggacgtaacgggtccgttaagggaaaggtaacgtttcgggttaggggtaacctttaagggtttttaaagtttcgtttagtccgaaaggttaaccttaaagttttaatttaccgtttaaacttccccctacgtttaaccggaaccgtttaacccgggttttacccgggaaaccccggttaaaacgggggtaaccccgttaaaaggggttaaacgggtaaaaacccgtttaaacgaaaaacccggggttaacttaggggtaaccggacccggtttaacgaacccccgttaacccggttaaacc

SEQ ID NO: 182111 - DNA, 618 bp, Homo sapiens
  misc_feature: GYAE6OF01A7DK6.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacactcgtcctgcactgctctatttacgtgggccgtccgtacccgggtaacgtcccggggtccctcggaccgtattcgaggtcggcacggcgggtcgtgggacagtactttcacgtctcacctatccagcacgcctgcgaggtcaggaagtgtggtcgtacgttagttttattattgtacagtataattacttaattacgttccctacgtactacggtaccggtttaccggaccggtaaacggggtaacccgtaaagggttaacggaaaacttaaccccgtaaaaacggttacgttacgggttacggtacccgtacgtaccgtaaccgtaccg

SEQ ID NO: 182112 - DNA, 726 bp, Homo sapiens
  misc_feature: GYAE6OF01CLV9N.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatcaactgcaagtccagaccagtagtttatttttacagtcctaccaacctaagtaagtagttacttagtcttggttaccagacaacgaaaccgacggactagtccgtcctacgaccactcgacctacgttaacgtttacgtcgggtaccgtaccggtaaccccgggtaaccggttccccggggtaccctacggtaccggtacgttaccgtagggtcggacggacgggtccgggtacggttcggggaacctaggtacctttacctaccgttccgttaccaaccgtctacgaccggtcaacgtcccgtagaccgtaaggtcctaggaacgtagttcgggtaggtaactttaggtttattacgttcgtaacgtacgtaactaatttatttacgttacttacccttaccgttacgtacggttaccggtaccggaaccgtaaacgggggaaacctaacggggtaagtaaaccgtaaccgtaaacgtaacgtcgggtaacgaccgtttacacccgtaacgtacg

SEQ ID NO: 182113 - DNA, 710 bp, Homo sapiens
  misc_feature: GYAE6OF01CJULE.22.14.B03.1.454.CMB.1.raw
  modified_base (318)..(318): a, c, t, g, unknown or other
  misc_feature (318)..(318): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggagggccacatcaactgcaagtccagccagagttattttacagctaccaaccaataagagttactagcttgtccagcaagaaccaggactatacgtcctgacactcgctactatttacgngggtaccgtccgtaacccgggaacgttcccggggtccctcggaacccgtagttaccgagggttcggacgtaacgggtccgggtcgtacggggtaacacggttactttccgtaactccctccaaccctagtaccgacgccaacggtcccctagaccggaacggtctaaggaaacgtgtcggtaggtacttaagttttagttaacgttcgtaccgaaaggttctaaaaagtttctttaaacttacctttcccctaccgttacgaaacgggttaccccgtttacgggaaacccgaaacgggggtaaccgtaaaaggggttaacgtaaaaaccgttaacccgaaaaaccggttacggttacggtacggtaaccctcggaaaccctaccgttaaccg

SEQ ID NO: 182114 - DNA, 584 bp, Homo sapiens
  misc_feature: GYAE6OF01DUF63.22.14.B03.1.454.CMB.1.raw
  modified_base (402)..(402): a, c, t, g, unknown or other
  misc_feature (402)..(402): n is a, c, g, or t
  modified_base (436)..(436): a, c, t, g, unknown or other
  misc_feature (436)..(436): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagtatttttacagctccaaccaaataagagttactagcttgtccagcaagaaaccaggactatcgtacctgcactgctctatttacgtgggccgtacgtacccgggaagtcccggggtccctgaccgtattcgagtcggcaggtcgggtcgtgggacagtattcacttctcaaccntcaacgtcaacgcctagacaggtcctaggaaagnttggaggtccttaagttttattagttgacagtactaaattattatactttccctctagaacgttaccgttacggaaccgtaaagggaacccgtaaagggtagtaaaactaacgaaacgtaacgtggttaaggctacgcctaacctacg

SEQ ID NO: 182115 - DNA, 342 bp, Homo sapiens
  misc_feature: GYAE6OF01ED8XU.22.14.B03.1.454.CMB.1.raw
  modified_base (217)..(217): a, c, t, g, unknown or other
  misc_feature (217)..(217): n is a, c, g, or t
  modified_base (330)..(342): a, c, t, g, unknown or other
  misc_feature (330)..(342): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaccctggtcaccgtctcctcagcctccacgaagggcccatcggtccttccccctggccnccctgctccgaggacgcacctccgagacgcacacggcggccctggggctgccctggtcaaggactacgttcccacgcgtatgtctggagcgggctggcaagggcgacagtagnnnnnnnnnnnnn

SEQ ID NO: 182116 - DNA, 684 bp, Homo sapiens
  misc_feature: GYAE6OF01C2CYO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttaatttttacagcctaccaaccaaataagtaagttaccttagcgttcggttaccagacaacgaaaacaggaacagtccgtcctgcacgtcgtcctactatttacgtcgggtaccgtacccgtacccgggtaacgtcccggggtccctacggacccgtagttcgaggtcggtcgacggtcgggtcggtagggactaagtactttacgacctcctaccaacctatcccgtagacacgtccgtagaccgtagcgtaggaacgtagttgtacggtactttaggtttaattacgttgtactaacgaactaatttaattaccgttactttcccgtactaccggtaacgttaccggttaccggaaacggaaaccgggtaacgaaacggggttaagaaaaccgttaaaccgaaaaccggtattccggggtaggtaccctacgggtaaccctacttaacccgg

SEQ ID NO: 182117 - DNA, 783 bp, Homo sapiens
  misc_feature: GYAE6OF01EHZS7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctgctgtgtctcgtgggcgagacgggccaccatcaactgcaagtccagaccagtacgtttatttttacagtcctaccaactaataaagtacgtttacttagctttcggtaccagacaagtaaaccgaggactaacgttccgtaccgttcgacctaacgtcgtaccttacgttaacgttttaccgtcggggtacccgttacccggtaaaccccggggtaacgttccccgggggttacccctacgggtaaacccgtagtttacccggaagggtcgggtaccgtaacgggtccgggggttaccgtagggggtaaacctacgggtttaaacctttcccgtaacccgtttaccggtaacccctaacccgtaacgttaaccggaaccgtaccgtaaccgtcccgtacggtaccggaacgggtaccttaagggaacgtacgttcgggttacgtacgtttaagtttttacgttacgtttcgtacgtacgtaacttaaattacgttttaaccttacgttcccttacgtaactacggttaccggttaccgaaccggtaaacgggaacctaaggggtactaaaactacgaaacgtacgtgcggtactcgacctacgttacg

SEQ ID NO: 182118 - DNA, 682 bp, Homo sapiens
  misc_feature: GYAE6OF01BA9MN.22.14.B03.1.454.CMB.1.raw
  modified_base (314)..(314): a, c, t, g, unknown or other
  misc_feature (314)..(314): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagtctccaaccaataagagttacttagcttagttccagctaagaacaggacagtcgtctgcactgctctattacgnggctgtaccccccggaagtccgggtcctacgacgattcgagtcggacaggcggtcgtacggacgtagtacgttcacgtcctaccaactacgtacacgtacctaacggtccccgtagacgaggcctaagaacggtaacgttggacgtacttaagtttttaactagtttcgaacgtagtaacgttaaattacgttttaaactacgtttacccgtaccgtaacgttaacgggttacccggtttaaccgggaacccggttaaacgggtaacccggttaaacgggtaacggtaaaaaccttaacccgtaaaaagggttaaacccgttcggggttaacgtaccggttaaccgaacccgttaacccgttaaacgg

SEQ ID NO: 182119 - DNA, 618 bp, Homo sapiens
  misc_feature: GYAE6OF01B2PHD.22.14.B03.1.454.CMB.1.raw
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagtcttggttccagacagaaaccaggacatcgtccngcactgctctatttacngggtcgtccgtacccgggactcccggggtccctgaccgtattcgagtggacacggcgggtgtgggacagtactttcactctccacactcacgcacgtcccgtgacgaggtccgtaggaagtagtggtacggtcgttacgttttattagtttcgtctagacgtaaattatttacttaacttcccgtaccttacgtacgtaccgtttaccggacccgtaaacgggtaaccgtaaaggggtaacggtaaaacttaaccgtaaaaccgtaacggttggttacgggacttaccggtacctaacccgtacg

SEQ ID NO: 182120 - DNA, 555 bp, Homo sapiens
  misc_feature: GYAE6OF01BS0NA.22.14.B03.1.454.CMB.1.raw
  modified_base (311)..(311): a, c, t, g, unknown or other
  misc_feature (311)..(311): n is a, c, g, or t
  modified_base (419)..(419): a, c, t, g, unknown or other
  misc_feature (419)..(419): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactgctcatttacngggtctaccgtacccgggaatcccggggtccctggaccgattcgagtcggcacggcgggtctgggacagtatttcactctacacatcagcagcctgcaggctagaagntgtgctagtttattatgtcagtctaattatttacttacttccttacctctaacgtacgttccggaccgtaacgggtacctaagggtacgtaaagtaccgtaaacgacgttggtacggacctcggacctccgtaacg

SEQ ID NO: 182121 - DNA, 554 bp, Homo sapiens
  misc_feature: GYAE6OF01CUGO8.22.14.B03.1.454.CMB.1.raw
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaaataagagttactagcttggttccagcagaaaccaggacatcgtcctgcactgctcatttactggcgtacgtacccgggaatcccggggtccctgaccgattcagtggcagtcgggtctagggacagtactttcactctcacccatcagcagccctgcnggctgaagtntgtcgcttaagtttattattgtacagctaattagttacttctttccctctcaacggttccgttaccggacccgaagggtaccgtaagggttacgaaattaccgaaacgtacgttggtacggacttcgacctcctacg

SEQ ID NO: 182122 - DNA, 719 bp, Homo sapiens
  misc_feature: GYAE6OF01DE5YV.22.14.B03.1.454.CMB.1.raw
tcagacatacgcgtcacgaccggtgctcgatttagtgtgagtagttccgcgggggagctacaacaggcaggcaggggcagcaagatgggtgttgcagacccaggtcttcatttctctgttgctctggatctctggtgcctacggggacattgtgatgacccagtctccagactccctggctgtgtctcgtgggcgaggacgggccaccatacaactgacaacgtccacgaccagtagttatttttacagcctaccaacctaaataagtagtttaacttagtcgttggttccagacaacgaaaccaggaccatccgtcctgacactgcctactatttacgtggtccgtaccgtacccgggacgtcccgggtacctcgaccgtacgttcgacggtcggcgacggtcgggtcggtacgggacgtagtacgtttaccacgttacctccaaccgtactaccgaacggccgtaacgtccccttagggacctaggtcctaaggacgtagtgggtccgtacgtttaagtttagtttaccttaggtaccaaggtaacttaattacgtttaattacctttcccgtaccttacgtaaccggttaccgggttaccggaaaccgggtaacggggtaaacccgttaaaggggttaaacggaaaacttaaacccgggaaaaacgggttacgttacggggtaacggaccctacggtaaacccttcccgtaaacgg

SEQ ID NO: 182123 - DNA, 667 bp, Homo sapiens
  misc_feature: GYAE6OF01A2NZ1.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttcagcagaaccagacatcgtctgcactgctacatttacgtggtcgtcgtacccgggaatcccggggtccctgaccgattcgagtcggcacggcggtcgtagggacagtatttccacgtctacaccactcaagcagtccctcgacaggtccgtagaaacggtgttaggtacggtacgttaagtttttacgttaagtttcggtactaacggtaactaaagtttaacgttacttttaaccgtttaccctacccgttacgtaccggttaaaccggtttcccgggaacccgttaaacgggggtaacccggttaaaaggggtaacgggttaaaaacttaccccgtaaaaacgtaaacccgggtttcggtaacgggtaccgttaccggtaacctaaccccgtttaacgg

SEQ ID NO: 182124 - DNA, 761 bp, Homo sapiens
  misc_feature: GYAE6OF01BS2SS.22.14.B03.1.454.CMB.1.raw
  modified_base (351)..(351): a, c, t, g, unknown or other
  misc_feature (351)..(351): n is a, c, g, or t
  modified_base (629)..(629): a, c, t, g, unknown or other
  misc_feature (629)..(629): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggacattgtgatgacccagtctccagacctcctggctgtgtctcgtggcgagacgggccaaccatcaactgcaacgtccagccagtagttaattttacagtctaccgaaccgaattaaacggtacgttacgttacgtcgtttacggttccaaggaccgaacggaaacccagggtaacctaacgttccgtaccgttacgtaaccgttcnccgttacgtacttttacggtacgggtccgttaccggtaacccgggtaacgtcccggggtccctaggaccgtacgttccgacggtcggaccgacggtcgggtacgtcgggtaacgaagttcgtttaccgaaccttctcccgaacttcgacgacgtccgacgtctcggaccgtcgggtactaagtaacgtacgtggtaccggtaagttacggtttaagttacgttggtacctaagttaacctaaacgtttaggttaccttaaccttcccgttaacccgtnaacccgggttaccgttaccggggaacctaaacggggtaccggtaaacgggtaacggtaaaacccgttacggaaaccgttaaaccggttcgtacccggtacgtacccggtacctaaccgggttacttacccgg

SEQ ID NO: 182125 - DNA, 642 bp, Homo sapiens
  misc_feature: GYAE6OF01BJG79.22.14.B03.1.454.CMB.1.raw
  modified_base (317)..(317): a, c, t, g, unknown or other
  misc_feature (317)..(317): n is a, c, g, or t
tcagacatacgcgtcacgaccggtgctcgatttagtgtgagtagttccgcgggggagctacaacaggcaggcaggtgcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagtctccaccaaataagagtttactagtcttggttccagcaagaaaccaggacatcgtcctgcactgctctatttacgngggtcgtccgtacccgggaacgtcccggggtccctcgaccgtattcgacggtggcgacggcgggtcgtcgggacagtacttcctactcctacacctatcgaacgtcacgtcctgaccgtaggctaggaaagtacgttggtacgggtacttagttttagtattcggtacagtactaaatttacgttaattaccgtttccctaccgttaccgtaacggttcccggttaccggggaacccgtaaacggggtaaccctaaagggggttacgtaaaaacctacggaaaaccggtacgttcgggtaacggtcctaccgggcctaaacccgg

SEQ ID NO: 182126 - DNA, 666 bp, Homo sapiens
  misc_feature: GYAE6OF01BS1X0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagacggccaccatcaactgcaagtccagccagtagttatttttacagcctaccaacctaaataagtacgttacttacgtcttcggttaccagtacaacgaaaccgacggactacgtccgtcctgacctacgtcgctactacgtttacgcgggtccgtaccggtaacccggtaacgtcccgggtcctcgaaccgtagtacgaggtcgacgtacggcgggtcgagggacgtagttacttccgacttcgacacctataccgacgcacgtacctgacggaggtactaaggtaagtaacggttggtacgggtaactttaagttttaagttacgttgtaactaagttaacctaaagttttactttattacccttacctaccgtacgtaacggtaccggttaccgggaaccgtaacgggaacgtaaagggtagaaaccgtaacgaaacgtagttcggtagaccttcgaaccgtacccgtag

SEQ ID NO: 182127 - DNA, 576 bp, Homo sapiens
  misc_feature: GYAE6OF01AXQUL.22.14.B03.1.454.CMB.1.raw
  modified_base (311)..(311): a, c, t, g, unknown or other
  misc_feature (311)..(311): n is a, c, g, or t
  modified_base (369)..(369): a, c, t, g, unknown or other
  misc_feature (369)..(369): n is a, c, g, or t
  modified_base (435)..(435): a, c, t, g, unknown or other
  misc_feature (435)..(435): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactgctctattacngggctcgtacccgggagtccgggtccctgaccgtattcgagtcggcacggcgggtcgngggacagtacttcactctcaaccatcagcacgcctgcagctagaagtgtgtcgacttagtttattntgtcaagtactaatttacgttattacgtttccctactacgtaacggtaccgttaccggacccgtaaagggaaccccgtaagggtaacggtaaaactaccgaaaacggtactacggtacggtactcgaccgtaccgttaacg

SEQ ID NO: 182128 - DNA, 624 bp, Homo sapiens
  misc_feature: GYAE6OF01C66VX.22.14.B03.1.454.CMB.1.raw
  modified_base (382)..(382): a, c, t, g, unknown or other
  misc_feature (382)..(382): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaacgtccagccagtagttatttttacacgtcctaccaacaaataagtagttacttagtctttcggttaccagacaacgtaaaccaggactatccgtcctgcactgctctagtttacgtcgggtccgtaccgtacccgggtaaccgtccgggtccctcgaccgtnttcgaggtcggcgtacggtcgggtcgtacgggacgtagtacttactactcctacacctatcacgcacgcctgcgtagtcgtagagtgtggtcgtcgtttaatttagttagttcgctagtacttaagttattacttacttccctacgtacgacggttaccgtccggaaccggtaaacgggacccgtaaagggacgtaaactaaccgaaacggtacgtcggacgtctaccgtacctccgttacg

SEQ ID NO: 182129 - DNA, 572 bp, Homo sapiens
  misc_feature: GYAE6OF01BYA7R.22.14.B03.1.454.CMB.1.raw
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttactgggcgtcgtacccgggaatcccggggtccctgaccgattcagtggcaggcgggtctggggacaggtatttcactctcaccatcagcagcctgcgaggctagaagtntgtggctagttttactactgtcagtactaattacttatactttccctacctacgtacggtaccgtttccggacccgtaaaggggaccctaaagggtacggtaaaacttaccgaaaaacggtaccgttaggtacggtactacgccgtaaccgttacg

SEQ ID NO: 182130 - DNA, 734 bp, Homo sapiens
  misc_feature: GYAE6OF01DLN2H.22.14.B03.1.454.CMB.1.raw
  modified_base (423)..(423): a, c, t, g, unknown or other
  misc_feature (423)..(423): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgacaagtccacgcagtagttatttttacagcctccacaactaagtagttacgttagctttggttccagtcaacgaacaggactatccgtctgacactcgctctattttcgcgggtccgttacgtacccgggtacgtccggggtccctaggaccgtattcgtacgttcggacgtagggtccgggtacgtacgggactacggtacgtttacnccgtactccgaacctacgtccgaacgtccgaacgtcccgttacggacgtacggccctaagggaacttacggttgtacggtacgtttaaacggtttttctaaccggttcggtaataacgtaacgtttaaacttttatttaacccgttacttttacccccgtagttacccggtaaaccggtttacccgggttaccgggaaacccggttaaaccggggtaaaccgttaagggggttaacaaaaacccggttaccgtaaaaacggttcccggtaaggtttcccgggaagttcccggaaccgtaccgtttaaccgg

SEQ ID NO: 182131 - DNA, 719 bp, Homo sapiens
  misc_feature: GYAE6OF01DUJ8Y.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatacaactgacaagtccagccagtagttatttttacagctaccaacaaagtaagtagttacttagtcgttggttccagacgaagaaaaccaggactacgtccgtcctgacaccgtgacctacgtattacgtgggtaccgtaccggtaacccgggtaacgttcccggggtacctccggaaccgtacgttacgtacggtcggacgacggtcgggttacgtacgggaacgtacggtaactttccactcctaccgaacctagtacgaacgtcaaggtaccctgaccgagtcgtaagaacgtagttcgggacggtatttaaggttttatacgtttcggactaaggtaaccttaaagtttacttaatttacccggtttcccttaccgtaaggtaaccggtaacccggttaccggaaacccggtaaaggggtaaaccccgttaaaggggtaataaaaaccgtaacccgtaaaaacggttactcgggttaacggacctcggtaaacccaccggtttacc

SEQ ID NO: 182132 - DNA, 562 bp, Homo sapiens
  misc_feature: GYAE6OF01CE8OI.22.14.B03.1.454.CMB.1.raw
  modified_base (415)..(415): a, c, t, g, unknown or other
  misc_feature (415)..(415): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtcctcgaccgattcagtggcaggcgggtctgggacagatttccactctccaccatcagcacgcctgcaggctagaagatgngctagtttattagttgtcagactaattattacttacgttccctcctacgacgtaccggttacggacccgaaaggggtaccctaaagggttacggaaacttaaccgaaaacgtaacgttcggtacggtacctacgaccaaccgttacg

SEQ ID NO: 182133 - DNA, 325 bp, Homo sapiens
  misc_feature: GYAE6OF01DRMK3.22.14.B03.1.454.CMB.1.raw
  modified_base (314)..(314): a, c, t, g, unknown or other
  misc_feature (314)..(314): n is a, c, g, or t
  modified_base (319)..(325): a, c, t, g, unknown or other
  misc_feature (319)..(325): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaactctggtcaccgtctcctcagcctccaccaagggcccatccggtcttccccctggccgccctgcctccaggagccacctccgagagcacagccggccctgggctgcctggtcaaggctacttccacgcgtatgtctgagcggctggcaaggcgnatagnnnnnnn

SEQ ID NO: 182134 - DNA, 752 bp, Homo sapiens
  misc_feature: GYAE6OF01B4BLZ.22.14.B03.1.454.CMB.1.raw
  modified_base (332)..(332): a, c, t, g, unknown or other
  misc_feature (332)..(332): n is a, c, g, or t
  modified_base (730)..(730): a, c, t, g, unknown or other
  misc_feature (730)..(730): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacggccacatcaactcgacaacgtccgagaccaagtacgtttatttttacacgtcctaccaactaaagtaacgtacgttacgttagtcttacggttaccagtacgaacgaaaccgaggactacgtccgtccncgactactcgtctactacgttacgtcgggtccgtaccggtaacccgggtacgtcccgggtcctacggtaccgtacgttacgtacggtcggacgacgggtccgggtcggtacggggtaacgtacgttacgtttaccgaccgttccgtacccgtaacctacgttacccgaggacctaaccggtcccgtaggaacccgggtacggtacgttaacgggaaaggttcggtcgttacggtaacttttaagtttactttacgttacgagtaacgttaacttaaattacttaaccgtttaccttacccgtaccgtaacggtaccgggttaccgttaaaccgggaaccggtaaacgggtaccgtaaaggggtaaacgtaaaccgaacgtaaaacggtacggttcggngtacgtccggaacctaagttcg

SEQ ID NO: 182135 - DNA, 859 bp, Homo sapiens
  misc_feature: GYAE6OF01D85HG.22.14.B03.1.454.CMB.1.raw
  modified_base (186)..(186): a, c, t, g, unknown or other
  misc_feature (186)..(186): n is a, c, g, or t
  modified_base (851)..(851): a, c, t, g, unknown or other
  misc_feature (851)..(851): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggactattgtgatcgacccagtcctccagacctcctggctgtntctcgtggcgaggacgggccaccatcaactgacaagtccacgccaagtacgtttactttttacacgtcctaccgaacctaaagttaacgtacgtttaacttacgtcgtttacggttacccagtacgaaacgaaaccgtaggaacctaacgttcccgttaccgtacgtacccgtaaccgttcggtaccttacgtttaacggttttaacggtccggggtacccgttacccgggttaaaccccggggtaaaccggttcccccgggggttaccctaccgggtaaacccgttacgtttaacggacgggttaccggtaccggtacggggttacccggggtttaccggtacggggtaaaccgttaacggtttacgtttacccgtaaccgtttaccccttaaccgaaccccgtaagtaccccggtaacgtacccgaaacgttcccccgttaaggaccggttaacggtccgtaagggaaagttcgttaacgggttcggtaaccgttttaagttttacgtttacgtacgtaaccgtagtaaacctaagttttaatttaccgttccttacccgttactaccgggtaccgtaccggtttaccggaacgggtaacggttaacggtaaggtaaggtaaacctaacgaaaacggttcgttaggaccgttgaacgtacccnccgttacg

SEQ ID NO: 182136 - DNA, 563 bp, Homo sapiens
  misc_feature: GYAE6OF01CAYUA.22.14.B03.1.454.CMB.1.raw
  modified_base (307)..(307): a, c, t, g, unknown or other
  misc_feature (307)..(307): n is a, c, g, or t
  modified_base (448)..(448): a, c, t, g, unknown or other
  misc_feature (448)..(448): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaacgtccagccagtagttaattttttacacgtcctaccacctaaataagagtttacttagcttggttccagcaagaaaccaggacatcgtccngcactgctctattactggcgtccgtacccggtacgtcccgggtcctcgaccgtagttcgaggtcggcgacggtccggggtcgtacgggactagtactttccactctaccaccatcgagccacgctgcgaacgctagaagtntgggtgcttagtttattagtgtcagtactaattattatcttcctctcgagtccgtcgaccgtaaggacctagggtacaaactacgaaacgcgtaggtacggactacgcctagtac

SEQ ID NO: 182137 - DNA, 621 bp, Homo sapiens
  misc_feature: GYAE6OF01A6IPV.22.14.B03.1.454.CMB.1.raw
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctaccaccaataagagttacttagcttggttccagcaagaaaccaggacatcgtcctgcactgctctatttacgtgggctccgtacccgggaagtcccggggtccctggaccgattccaggtcggacgaggcgggtcgtaggggactaggtactttaccacgtccgttacaccctatcacgcaacgcctagcacggctagaagagtgnggacttaagtttattattcgtacctagacctaaagttacttaacttacgtttccctaccgttacgaacggttacccggttccggaacccgtaaacgggtaccgtaaaggggttacggtaaaacctaccgtaaaaacggtaaccgttgtacggtacctaggaccctaaccgttacg

SEQ ID NO: 182138 - DNA, 685 bp, Homo sapiens
  misc_feature: GYAE6OF01DFEVG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtcctccagacctccctggctgtgtctcgtgggcgaggacgggcccaccatacaactcgcaacgtccacgaccagtagtttacttttttacacgtcctaccaacctaagtaagtagtttacttagtcgtttcggttaccagtacgaacgaaaccaggacctagttccgtccgtcgcctacgtcgtcctacttaagtttaccggtcgggtccgttaccggtaaccccgggtacggttccccggggtaccctacggtaccgtacgttacgacggtcggacggtcggtccgggtcgtacgggacgtagtactttcgaccttcgtaccaacctactcgaacgcacgtccctgaccgaggcgtagaagtgttggtgtacttagttttattagttcgtaacagtactaagtttactactttaccttccttcgtacgtacgttaccggtacccggacgaaacgggtaccgtaagggttaacgtaaactacgtaaacgtacgtaggtacggtacacgctaacccgttacg

SEQ ID NO: 182139 - DNA, 958 bp, Homo sapiens
  misc_feature: GYAE6OF01ATP0N.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgccgtacggggacattgtgatcgacccagtcctccagacctcccgtggctgtcgtctcgtgggcgaggcggcccaccatacaactgacaacgtccacgccagttacgtttacttttacgacgtcctaccgaacctaaataaacgtacgtttaacgttacgtcgtttcggttaccagaccgtaacggaaaccgacggtacctaacgtccgttaccgtcgaccgtaaccgttcggtaccttacgtttaaccgttttaccgggtacggggtacccgttaccccgggtaaacccgggttaaccgggttccccggggttacccgtaaccgggtaacccgttacggttacggtacgggtaccggaccgggtaccggggttccggggttacggtaaccggggtaaccgttaacggtttaccgtttacccgtaacccgttacccgtaaccccgtacccgtaacggttacccgtaaccggtacccgtacccgggttaacccggtaccgggaccggtaaccgggtacggttaacggtaacgggttaacggttcggggttaaaccgtttacggttttaaaccgttttagttttaaccggttacgggttaaccgtaaacggttaactttaaacgttttaacgttttaaccgttacctttacccgttaccggttaacgtaaccgggtttaaccgggttacccggggtaaacccgggtaaaaccgggggtaacggttaaaccgggttaacggtaaaaccgttaaccgggtaaaaacggttccgggttaacggtaaccgggaaccgttaccggtaaaccccgtaacgtttaccggg

SEQ ID NO: 182140 - DNA, 893 bp, Homo sapiens
  misc_feature: GYAE6OF01CZDZX.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccacatcaactgcaagtccagccagagttatttttacagctaccaccaataagagttactagcttggtccagcaagaaccaggacatcgtcctgcactgctctaactttacgtgggtccgtaccgtaccccggggtaagttccccggggtaccctcggtaacccggtactttaccgagggttcgggaccgaacgggtccggggtaccgttagggggaaaccctaagggttaacgttttacccgaaacccgttcccgttaccgaaaccccgttaattacccgaacgggaccttaaaccgggccccgtttaacgggacccgaacgggggtaccctttaaacggggaaaacggtaacggtttggggttaaccgggtacccgttttaaaagggtttttttaaccttttaaaggttttacggggtttaaccaaacgggtaacccttaaaaaacggtttttaagttttaaaccgtttaaacccgtttttccccccgttaacccttaccgggtaaaacggtttaaccccggggttttaccccgggaaaccccggtaaaacgggggggtaaaacccccttaaaggggggttaaaccggttaaaaaacgtttaaacccccggaaaaaaacgggttaaacccggttacggggttaacgggtaacccgtttaccggaaaccccgtaaacccgttttaaacccggg

SEQ ID NO: 182141 - DNA, 646 bp, Homo sapiens
  misc_feature: GYAE6OF01DTGCT.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtggcgagagggccaccatcaactgacaacgtccagccagtagttatttttacagtctaccaaccaaataagtacgttacttagtcttggttaccagcaacgaaccaggactatccgtcctgctactgctctatttacgtggccgtaccgtacccggacgtcccgggtcctacgaccgtacgttacgaggtcggcgacggtcgggtcgtacgggactagtacttccgacttcctaccacatccgacgcacgtccctagacgaggtcgtaggaaagtgttacggtacgtacgtttaagttttactacgtcgtacgaacgtattaaactttattaacttccgttaccttccgtagtaaccggttacggttacccggaacgtaaaccggggtaacctaaggggtaacggtaaactaacccggtaaaacgtacggtacgtcgggactacgacctaacgtacg

SEQ ID NO: 182142 - DNA, 737 bp, Homo sapiens
  misc_feature: GYAE6OF01DQWQA.22.14.B03.1.454.CMB.1.raw
  modified_base (728)..(728): a, c, t, g, unknown or other
  misc_feature (728)..(728): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtgccgtacgggggactattgtgatcgacccagtcctccagacctccctggctgtgtctcgtgggcgaggacgggccaccatacaactgacaacgtccacgccagtagtttactttttacacgtcctaccaacctaaataacgtaacgttacttagtcttcggttaccagacaacgaaaccacggactacgtcgtcctgacctacgtcgtcctactattttaccggtcgggtccgtaccggtaaccccgggtaacggtcccggggtacctacggaccgtacgttcgaggtcggacgtacgggaccgggtcggtacggggaacctaggtacttacctaccgtctaccaacctagtaccgaacgcgtaccggccgtggacgaggtcgtaaggtaaacggtgttgggacgttaacttaggtttttaacctacgttacgtaacgtacgtaagttaaacttacgtttacttaccgttaaccctcgtaacgtaccgggttaacccggttccggaaaccggtaaacgggtaaccggtaaaggggtaaacgtaaactaaacccggaaacgtaaccgttgggaacgtacccgtagtaaccccncgttaccgg

SEQ ID NO: 182143 - DNA, 782 bp, Homo sapiens
  misc_feature: GYAE6OF01ADTTB.22.14.B03.1.454.CMB.1.raw
  modified_base (665)..(665): a, c, t, g, unknown or other
  misc_feature (665)..(665): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgttacggggacattgtagatcgacccagtcctccagacctcccgtggctgtgtctcgtgggcgaggacggccacactcaactgacaacgtccacgaccgagtacgtttatttttaaccgacgtcctacccaactaaactaaacggttacgttttaacgttaacgtccgttttacgggttaccaacgtaccgaaacgtaaaaccggaacggtaactacgttaccggtaccgtcgacctacgtcgtaccttacgttaacgttttaccggtcgggtccggttacccggtacccggggtaaccgggttccccggggtaccctacggtaacccgtacgttacggtacggtacgggtcgaccgggttccggggtcgtaaccgggggtaactacggtttaaccttactaccgttcctaccgtaactaccgcgtaacgccgtaccggtcctacggaccgacggtacggaacgtagtcggtacgggttcgtaagtttagtttacgttcttacggtacctaagtactaaagttttntacgttacttcccgtactacgtacggtaccggttacgaaccggtaaacggggtactaagggtaacgtaactaaccggtaacgttacgtcgggttaccgagtaccgaacgtcgttccg

SEQ ID NO: 182144 - DNA, 653 bp, Homo sapiens
  misc_feature: GYAE6OF01AZ8E9.22.14.B03.1.454.CMB.1.raw
tcagacatacgcgtcacgaccggtgctcgatttagtgtgagtagttccgcgggggagctacaacaggcaggcaggggcagcaagatggtattgcagacccaggtcttcatttctctgttgctctggatctctggtgccgtacggggacattgtgatcgacccagtctccagacctccctggctgtgtctcgtgggcgagacgggccaccatcaactgcaagtccagccagtagtttatttttacacgtcctaccaaccaaataagtaacgtttaacttagtcgtttcggttccagtcaagtaaaccgaggaacacgtccgtccgtgaccactcgctactacgtttacgtcgggccgtaccgtacccgggtacgtcccggggtccctacgaccgtatcgaggtcggcacgggtcggtcgtcgggacgacgttacttccaccttctaccactacgtccgacgcacgcccgtggacgacgtcgtaagaacgtgtacggtcggtatttacgttttaattcgttcgtacgaacgtactaaagtttctttaacgttccttcccgtactccgtaaggttacccggtacggaaccgtaacgggtacctaagggtaacaaacgtaccgaaacgtagtacggtacggactacgctaccgtacg

SEQ ID NO: 182145 - DNA, 642 bp, Homo sapiens
  misc_feature: GYAE6OF01A44OA.22.14.B03.1.454.CMB.1.raw
  modified_base (328)..(328): a, c, t, g, unknown or other
  misc_feature (328)..(328): n is a, c, g, or t
  modified_base (439)..(439): a, c, t, g, unknown or other
  misc_feature (439)..(439): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccgatcaactgacaagtccagccagtagttatttttacagcctaccaaccaataagagtttacttagtcttcggttccagacagaaaccaggaccatcgtcctcgcactgctactatttacgngggtcctaccgtacccgggtaacgtcccggggtccctacggtaccgcttacgagtcggccaggtcggtcgtggacaggtacttcacgtcctcacactcacgtcacgtcccngaccaggtcaggtagtagtcggtaggtcttagttttactagttcgtacagtactaagttacttattactttaccctccgttacgtacggttaacccggtttccgggaacccgttaaacggggaacccgttaaagggtaacggtaaaacttaccccgaaaaggtaccgttaggaccggttacctaacggtacctaccgttaacg

SEQ ID NO: 182146 - DNA, 657 bp, Homo sapiens
  misc_feature: GYAE6OF01EE9AA.22.14.B03.1.454.CMB.1.raw
tcagacatacgcgtcacgaccggtgctcgatttagtgtgagtagttccgcgggggagctacaacacggcaggcaggggcagcaagatggtgttgcagacccaggtcttcatttctctgttcgctctggatctctggtgccgtacgggacattgtgatcgacccagtctccacgacctccctggctgtcgtctcgtgggcgaggacggccaccatacaactcgacaacgtccacgccaggtagttactttttacacgtcctaccaacctaattaagtacgtttacttagtacttcggttacctagacgtaacgaaaccgtacggacctactcgtcctgtacactgtctactacgttacgcggtccgtaccgtacccggtacgtcccgggtcctcgaccgtactcgaggtcggcgacggtcggtcgtacgggtacgtacgtactttaccacttctaccacctacgtccacgccgtacgccgttcgacctacggcctaaggacgttgtacggtacgacgtttacgttttacttaggttctaagtacgaactttaatttacttaaccttcgttacctcgtaccgacgttaccgtcggaacgaacggtacgaaggttacaacgttaccaaacggtacgttcgacgactacgctaaccgtacg

SEQ ID NO: 182147 - DNA, 694 bp, Homo sapiens
  misc_feature: GYAE6OF01AI1DR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagttactttttacagtctccaccaataacgagttacttagcttggttccagcagaaaccaggacatcctcctctactcgctctatttacgtgggtcgtcgtacccgggtaatcccgggggtccctcggtaccgtagttcgacggtcggcgtacgggtccgggtcgtaggggtaaccaggtactttccaccgttctacctaccgattaccgacgccgtaacggcccttaggaccgtaacggggtccttaagggaacgtagttggtacgggtacttaacggttttattagtttcgtactagtactaagtttaacttacttaactttccctacctacgtacggttaccggttaccggaacccgtaaacggggtaacccgtaaaggggttacggtaaaacgttacccggtaaaaacgtaccgttacgggtacggtacccgttacggaccttaacccgtagtttaccccgg

SEQ ID NO: 182148 - DNA, 599 bp, Homo sapiens
  misc_feature: GYAE6OF01AL0GG.22.14.B03.1.454.CMB.1.raw
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
  modified_base (434)..(434): a, c, t, g, unknown or other
  misc_feature (434)..(434): n is a, c, g, or t
tcagacatacgcgtcacgaccggtgctcgatttagtgtgagtagttccgcgggggagctacaacaggcaggcaggggcagcaagatgggtgttgcagacccaggtcttcatttctctgttgctctggatctctggtgcctacggggacattgtgatgacccagtctccagactccctggctgtgtctctgggcgaggagggccaccatcaactgcaagtccagccagtagttatttttacagtcctaccaacctaataagtagtttaacttagtcgtttacggttccagacaacgaaaccgaggacagtccgtcctgcactgctctattacgcggtcgtaccgtaccggacgtccgggtcctcgaccgtatcgaggtcggcgaggtcggtcgtgggactagtacttcactctacactncgagcacgtccngacnggctagagtagttgagtacttagtttatgttacgacgagtacttaattagttaccttacgttccctacgtacgtaccggtccggttacggaaccgtaaacgggtaccgtaagggacgtaaacgtaaccgtaaacgtacggtgtacgatccgtaccgtacgttacg

SEQ ID NO: 182149 - DNA, 674 bp, Homo sapiens
  misc_feature: GYAE6OF01BZBPG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagaggccacatcaactgacaagtccagccagtagttatttttacagtctaccaccaataagagttactagtcttggttccagacaagaaaccaggacatcgtcctgcactgctctatttacgtgggtaccgtcgtacccgggtaactcccggggtccctacggaccgtattcgacggtcgacgaggtccgggtcgtacgggactacgtctttaccactcgtaccaccgtataccgacgcagtcccgtagaccgagggtacctagggaaacgtcggtaggttacgggtacgttaagtttttaacttaacgtttggaacctaaggttaacctaattaattttaattacctttacccttaccgtacgttaacggtaccgtttccggaacccgtaaacgggtaacccgtaaagggttaacggaaaacttaaccggtaaaacgtaacgttacgggtacgtacctacgtaccctaacccgttaccg

SEQ ID NO: 182150 - DNA, 826 bp, Homo sapiens
  misc_feature: GYAE6OF01DGJ1D.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtgccgtacggggacattgtgatcgaccagtctccagacctccctggctgtgtctcgtgggcgaggacgggccaccatacaactgacaacgtccagaccagtagtttactttttacacgtcctaccaacctaaagtaacgtaagtttaacttacgtctttcggttaccagacaaacgaaaacgacggacactccgtcctgcctacgtcgcctcttaagtttcgtacggggtccgtaccggtaacccgggaaccgttcccggggtccctacggaccgtacgttccgtacgggtcggacgtacgggtccgggtccgtacggggacgtacgttaacgtttaccgaccttccgtaccaacccgtgttacccaggcctacggtccccgtaggaccgagggtccctaagggtaagtacgggttaggtacgggtaaccgttttaaggttttttaacttaggttttccggaacgttaacggttaaacctttaaaatttttaccgttttaaactttacctttttaacccccgttaccccgttaggttaaaaccccgggttaccggggttaccccgggtaaaccccgggtaaaacgggggtaaaaccgtaaacgggggtttaaacgaaaaaacccggtttaaaccgaaaacgggttaccgttacggggtacgtccgtaaccggtaccgttacccgtaaaccg

SEQ ID NO: 182151 - DNA, 632 bp, Homo sapiens
  misc_feature: GYAE6OF01CI7XZ.22.14.B03.1.454.CMB.1.raw
  modified_base (300)..(300): a, c, t, g, unknown or other
  misc_feature (300)..(300): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactcgacaacgtccacgccagtagttatttttacagctccacaataagagttacttagcttggttccagcagaaccaggacatcgtccngcactgctctatttacgtcgggtcgtaccgtaccgggaacgttcccggggtcctcggaccgtagttacgaggtcggcgtacggcggggtcgtacggggacgtaacgtacgtttcactcctaccgaccattccgaacgcctacggtcccgtggccgtagggtctagggaagtgtcggtacggtacttaagttttattagttcgtcaagtactaaattatttagttacttccctaccgtatacggttaccgtccgggacgaaacggggtaccctaaagggtacggtaaactaccgaaaaacgtcgtacggtaggaccttacggccctaacgtcg

SEQ ID NO: 182152 - DNA, 736 bp, Homo sapiens
  misc_feature: GYAE6OF01EDZMD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctgctgtgtctcgtgggcgagagggccaccatcaactgcaagtccagccagtagttatttttacagtcctaccaaccaataacgtagttaacttagtctttcggtaccagacaacggaaacccaggaccagtccgtcctgcactgcctactatttacgtgggtacccgttaccgtaacccggggtaacttcccgggggtcccctacggtaacccgtatttccgaaggtcgggacgtacgggccgggttacgtacggggtaccgtacggttactttaccgtacccgttacgtaccctaccgtactaccgtaacgaccgtacggtccccgtaggaccgtaacggggtaccgtaacggtaaacgggtaggttcgggttaacgggttacttttaacggttttttaatttacggtttacggtaacttaaggtaactaaagttttaacttttacgttacctttccctaccgtactacggtaccgttccggaacccgtaaagggaaccgtaagggtaacggtaaactaccgtaaacggtacgttggaccgtagtcgaccctacgtaccg

SEQ ID NO: 182153 - DNA, 703 bp, Homo sapiens
  misc_feature: GYAE6OF01DJJ2L.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggcccaccatcaactgacaagtccacgccaagtagttatttttacagcctaccaacctaaataagtagtttactagtcttacggttccaagcaacgaaaccgaggacctatccgtcctggacctacgtgtcctctaacgttttacgtcggggtccgttacccgtaacccgggtaaccggttcccggggtcctacggaccgtattccgaaggtcggacgtaggtcgggtcgtacgggactagtacgtttctactcgtaccacgtataccgaagtccacgtcccttggactaaggccttaaggaagtacggttgtacggtacgtttaagtttactttacgttgtacgaacgttaacttaaagtttatttaaccttaacgtttcccctaccgttacgtaaccggttaccggttaccggggaaccgtaaacggggtaacccgtaaagggtaacggtaaaacgtacccgtaaaacggtagtcggtacggtctaacggctaacccgtag

SEQ ID NO: 182154 - DNA, 681 bp, Homo sapiens
  misc_feature: GYAE6OF01C3IHR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtgtctcgtgggcgaggagggccaccatcaactgcaacgtccagccagtagtttatttttacagctaccaacaataagattactagcttgtcagacaagaaccagactatccgtcctgctactcgtctactaactttaccgcgggtaccgtaccggtaaccccgggtaacggtcccgggtccctcggaaccgtacttaccgaggtcggacgacggtcgggtcgtaggggactagtactttaccgactccgttaccaaccgtactaccgaacggtaccaccggtcccgttaggacccgaacgggtcgtaaggaaacggtcgtaggtcgggtacttaaggttttatttacgttcgtacgaacgtactaaatttagttaacttacctttccctacgtacggtaccggttacgttacccgggaacgaaacgggtaccgtaaaggggtacgtaaaactaccgaaaacgtaacgttcgggtacgtaccgtgaacccctattaccg

SEQ ID NO: 182155 - DNA, 648 bp, Homo sapiens
  misc_feature: GYAE6OF01DY0FB.22.14.B03.1.454.CMB.1.raw
  modified_base (526)..(526): a, c, t, g, unknown or other
  misc_feature (526)..(526): n is a, c, g, or t
tcagacatacgcgtcacgaccggtgctcgatttagtgtgagtagttccgcgggggagctacaacaggcaggcaggggcagcaagatggtgttgcagacccaggtcttcatttctcttgttgctctggatctctggtgccgtacggggacattgtgatgacccagtctccagactccctggctgtgtctcgtgggcgagacgggccaccatacaactgacaagtaccagccagtattaatttttacagtcctaccaactaaattaagtaacttacgttaagtcgtttcggttaccagacaacgaaaaccgacggtaccaacgttccgtactcgactacgtcgtacctacttacgttacggtcgtaccgtaccggtaccggtaccggtccggtccgtacgtacgtactcgagcggacgcggtacgggtggacggacgtacgttacttactacctacttaccaactaacgcaacgcaccgtcgcgacgagtcgtaagagtcgtaggtcgtatttagttattacgtgtanactataattcttattctacccgtctacggtaccgtacgggtaccgtaacggaacggtaacgtaagggtaagtaaacgtaaaaccgtagttacggtagtacggtactaacgtcctaacggtcc

SEQ ID NO: 182156 - DNA, 803 bp, Homo sapiens
  misc_feature: GYAE6OF01B8T03.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactcctggctgtgtctcgtgggcgaggacgggccacatcaactgacaagtccagccagtagtttatttttacacgtctaccaacctaagtaacgtagtttacgttacgtcgttacggttaccagtacaacgaaaccgaaggtacagttccgtcctaggacctactcgtacctacttaacgttttcggtcggggtaccgtccggtaaccccggggtaacgttccccggggtaccctacggaccgttacgtccgtagggtcggacggtacgggtcgggttcgtacggggactaggttactttacaccgttcctaccgaccttacgaccgtacggtacctacggtacccgttcgacgtacgggttaccgtaagggtaaaccggttagtccgggtttaggtaccgtttttaaagtttttacttagtttacggaccgaaggtttaacttaaaggtttaaccttttaacttaaccccgtttacccttacccgttaacgtaacggggtttacccggttacccgggaaaccgggttaaaccggggtaaaccggttaaagggttaaacgggtaaacttaaacccgggtaaaaaccgtttcggtacggttacggacccttaacgtcccgtaaaccgtttacgg

SEQ ID NO: 182157 - DNA, 824 bp, Homo sapiens
  misc_feature: GYAE6OF01BOQ8X.22.14.B03.1.454.CMB.1.raw
  modified_base (357)..(357): a, c, t, g, unknown or other
  misc_feature (357)..(357): n is a, c, g, or t
  modified_base (618)..(618): a, c, t, g, unknown or other
  misc_feature (618)..(618): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctcccgtggctgtgtctcgtgggcgaggacggcccaccatcaactgacaagtccagccagtagtttactttttacgacgtcctaccaccaataaggtacgtttacttacgtctttcggttaccagactaagaaaccgaggaacctactccggtcctcgctacgtcgtcctactacgtttacggngggtccgtaccggtacccgggtacgtcccggggtcccgtacggaccgtagttcgacggtcggacgacgggtccgggtacgtcgggtacgtagtacttcctaccgttcctaccacgtactaccgacgtccgacgtcccctagggacccgtaggggtaccaagggtaacgttagggtcggttacggttaaccttttaggtttttaaactttcgggtttacgtaacgttaacggtaaacgtttaaacgttaacgttttttaacncccgtttttaccctacccggttaaccggttaaaccgggtttacccgggtttaaccccgggaaaaccccgggttaaacggggggtaaacccgtttaaaacgggggttaaacggttaaaaaacccgtaacccgggtaaaaaacccgtttacgggtagggtttacccggttaacccggtttaccgaaacccgttaccggtttaacccgg

SEQ ID NO: 182158 - DNA, 767 bp, Homo sapiens
  misc_feature: GYAE6OF01CKB0E.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaacgtccagccagtagttatttttacagtctccaaccaataagtagttacttagtcttcggttaccagacaacgaaaccgaggacactccgtcctgaccactcgtccttactacgttttacgtacgggtccgttacccggtaacccggggtaaccggttccccgggggtacccgtaccggtacccggtacgttccgaggtcggaccgtacgggtcgggtcgtcggggaacgtagtacgtttccgtaccgttacgtacctaccgataccgacgtaccgacgtccctaggtccgaacggtccgtaagggaacgttaacggttggtacggtaacgtttaaggtttttacgttacggttttacgctaaacgttaccttaaaagttttactttaaacgtttacctttacccgttcccgtaagtaaccggttaacccggtttcccgggaaacccggtaaaccggggtaaccggtaaacggggttaaacggaaaacgttaaaacccgaaaacggttacgtacgggttacgacccggttacgacccgttaacccgttacg

SEQ ID NO: 182159 - DNA, 743 bp, Homo sapiens
  misc_feature: GYAE6OF01API1I.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaacgtccagccagtagttatttttacagcctaccaaccaataagtagttacttagtcttggttccagcaagaaaccaggactatcgtcctgccactcgctctagtttacgtcgggtccgtaccggtaacccgggtaacgttccccggggtccctacggaacccgtacgttacgaggtcggcgtacgggtccggggtgtacggggacgtaggtactttcgaccttcctacctaacctacgttccgacgtacctacggtcccgtaggaccgtacggtacgtaggtaaacggtgttcgggtacggtacgtttaagttttacgttaacgtttacggtaccgtaacgtaaccgttaaatttaacgtttaactttaacctttcccctacccgttacgtaaccggttacccggtttaccgggaaccccggtaaacggggtaaacccgtaacggggttaaacggtaaaccttaacccggaaaaacgttaaccgggttacggtacgggtacctcggtaacccgtaacccgtaaccg

SEQ ID NO: 182160 - DNA, 572 bp, Homo sapiens
  misc_feature: GYAE6OF01A1UFL.22.14.B03.1.454.CMB.1.raw
  modified_base (404)..(404): a, c, t, g, unknown or other
  misc_feature (404)..(404): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctctatttacgtcgggcgtaccgtacccgggaacgtcccggggtccctcgaccgtattcgaggtggcaggcgggtcgtgggacagtacttcactcctccacctntcagcacgcctgcaggctagaagtgtgtgtacttagtttattagttgtcagtactaattacttattacttccctctacgtacgtaccggttaccggaccgtaaacgggtacctaagggtacggtaaactaaccgaaaacgtacgtcggtacgtctacgcctacttacg

SEQ ID NO: 182161 - DNA, 620 bp, Homo sapiens
  misc_feature: GYAE6OF01BQ082.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggcattgtgatgacccagtctccagactcctggctgtgtctctgggcgagagggccaccagtcaactgcaagtccagccagagttatttttacagctccacaataagagttacttagcttgttaccagtcaagaaccaggacatcgtcctgcactgctctactttacgtgggcgtacgtacccgggaagttcccgggtccctacggaccgtacttcgaacggttggacaggtccgggtcgtggggacagtactttccacgttcctacacctagtcgaacgtccgaagtccctggtaccgaaggtctagaacgtagtcggtacggtacgtttaagttttacgtttacgttcggtactaacggtcctaaagtttacgtttacttacttccctacgtactaggtaccgtttccgggaccgtaacgggaccgtagggtaacggaactacgtaaacgacgttggtacggctacgcctatacg

SEQ ID NO: 182162 - DNA, 819 bp, Homo sapiens
  misc_feature: GYAE6OF01ALG4L.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggacattgtgatcgacccagtcctccagacctcccgtggctgtcgttcctcgtgggcgaggacgggcccaccataccaactcgacgaacgtccacgaccagtagtttactttttacgacgtccgtaccaactaaagtaacgtacgtttacgttacgtcgttacggttacccagacctaaacgaaacccgtaggaacctacgtaccgtacctacgacctactacgtcttacttacgtttacgtacgggtcccgtaccggtaaccccgggtaaccggttccccgggtaccctacggtaacccgttagtaccgtaggttccggaccgtacgggtccgggttacggtaccggtacgtaacggttacctttaccgtacccgttacctaccgaaccctagtaccgaacggaccgtccgtaccctacgggacgacgggttaactacgggtaaagtcggttacgtagggttaccgttttaaagtttttacgtacggtttcgaaccgtaagttaaccgtttaaactttaacgttttacctacccgttttcccgtacccgtaacggttaccgggttaccccgttacgggaaacccggtaaaacgggtacggtaaacgggtaacctaaacggtaaacccgtaaacgtccggtaggttaccgacctcgaacccgtaccgtttaccg

SEQ ID NO: 182163 - DNA, 742 bp, Homo sapiens
  misc_feature: GYAE6OF01CYYZ0.22.14.B03.1.454.CMB.1.raw
  modified_base (182)..(182): a, c, t, g, unknown or other
  misc_feature (182)..(182): n is a, c, g, or t
  modified_base (487)..(487): a, c, t, g, unknown or other
  misc_feature (487)..(487): n is a, c, g, or t
  modified_base (617)..(617): a, c, t, g, unknown or other
  misc_feature (617)..(617): n is a, c, g, or t
  modified_base (727)..(727): a, c, t, g, unknown or other
  misc_feature (727)..(727): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggactattgtgatcgacccagtcctccagacctcccnggctgtgtctcgtcgggacggaggacgggcccaacactacaactcggacaacgtaccgagaccagtagtttacttttacagtcctaccaaacaataagtaacttactagtcttcgtaccacgacaacgtaaaccgagacacgtccgacctcgactacgtctctactacgttaccggtgggtacccgtaccggtaacccggtaccggtcccgggtacccgtacggaccgtacgtcgtacggtcggacgtacgggtaccgggtcgtacgggaactaggttacttacgacctaccgtcctaaacctanaccgaacgaccgtaccgacctggaacgtcggtaacgagtaaggtcgtcggttagtaacgttttagtttaataccgtggtaaactaacggttacttaaaattctaacttaccgttccctaacccgggtaanaccgggttaacccgggtacccgaaagggtaaaaccgggaccgttaaaaggttaacgggaaaaccttaaaccgtaaacgtacggttacgggtaaccgggttacgtaaaccnccgttaaaccgtacg

SEQ ID NO: 182164 - DNA, 758 bp, Homo sapiens
  misc_feature: GYAE6OF01DPAZZ.22.14.B03.1.454.CMB.1.raw
  modified_base (537)..(537): a, c, t, g, unknown or other
  misc_feature (537)..(537): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggacattgtgatcgacccagtcctccagacctccctggctgtgtctcgtcgggcgaggacgggccaacactaccaacgtgacctaacgtccacgccagtaagtttactttttacacgtcctaccaacctaataagtacgttacttacgtcgttggttaccagacgaacgaaccgacggactacgtccgtcctacgtcacgtcgtaccttacgttaacgtttacggtcgggtccgttacccggtaacccgggtacggttcccggggtcctacggaccgtagttcgtaggcggacgtcggcgggttcggagggactacgttcttaccaccgtcctaaccactacgtacgacgcaacggtccgtacgacggtacggaccttaagggactcgggtntacgggtacttttagttaagttctacgtagtaaccgttaattaacgttactttaacttaccgtttcccgttaactaacgggttaacccgttacccgggttaaacccgggaaacggtaaaacccggggtaacgttaaacgggggtaactaaaacccggtaaaccgttaaacggtccggttaacgggttacggaaccttcgggaaacccctcgtttaacccgg

SEQ ID NO: 182165 - DNA, 922 bp, Homo sapiens
  misc_feature: GYAE6OF01DK5ZR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgccgtacgggacagttgtgagtcgaccctagtcctaccgaacgtacctcccgtggtcgtggttcgttcgtcggtcggggcggaacggaccggggacccaaccctaactaccaacgtcggaaccgtaaccggtacccgaacggaccgtaaggttaacgtttttaactttttttaaccgaccgtaccctaacccctaaaccgtaaaacggttaaacggttacgttttaaccgtttacgttaccggtttcggttaaccgaagtaaccgaaaacggaaacccgacgggtaacctaccgttaccgtccgtaccgtaccgtaccgttacgtaccttaacgtttaaccgtttaccgggtaccgggtcccgttaccccgggtaaccccggggtaccggttccccgggtacccgtacggtacccgttagttaccggagggtcggacggtcgggtccgggtacgtacgggtactaacgttcttacctaccgtctacccgtacgtacgtacgtcgaccgtacgcgtcggacgacgttagacgtaagtcgttagggtacgttacgtttaacgttttgttacgtacggttaacaagtttaacgttaaactttacttaccgttttaccgttaccccgttacgtaaacccgggttacggttaacccgggtaccccggttaaaagggggaaaccccggttaaggggtaaacccggttaaaaggttaaacccgtaaacccgggtaaaacgtttacgggtaccggttccgaaccggtttacgaaacccgttaaccggtttacc

SEQ ID NO: 182166 - DNA, 719 bp, Homo sapiens
  misc_feature: GYAE6OF01DWDV5.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctgggtgcctacggggacattgtgatgacccagtctccagacctccctggctgtgtctcgtgggcgaggacggccaccatcaactcgacaacgtccagccagtagttactttttacacgacctaccaacctaagtaagtagttacttagtcttaggttccagacaagaaaccaggactatccgtcctgaccactcgtcctacttacgttacggtcggtccgttaccggtaccggtaccggtcccggtaccacgtacgtagtcgacgtcggacgtcggtcggtcggacggacgtacttacgtacctacgtaccttccacgtactacgacgtaccgccgtacgtacggacggaacggtacgtaaggtaacgttccggttagggtacgttacgttttaagttttaccgttagtttacggaacgtaagttaaacttaatttaccttaactttacccgttcccttacgtaacggtacccgggttacggttaaacccgggaaacggtaaaccgggttaaggtaaacggtattaaaacccggaaaacgtaaccggttagtcgggtaacgtacccgtacaccccgttaacgttaccg

SEQ ID NO: 182167 - DNA, 617 bp, Homo sapiens
  misc_feature: GYAE6OF01EWFAB.22.14.B03.1.454.CMB.1.raw
  modified_base (414)..(414): a, c, t, g, unknown or other
  misc_feature (414)..(414): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagttatttttacagctaccaacctaaataacgtagttacttagtcttcggttaccagcaagaaaccaggactatccgtcctgacctacgtgtcctactacgtttacgtcgggccgttaccgtacccgggtacgtcccgggtaccctagaccgtacttcgaggttcggacgtaggtccgggtacnggggaccagttactttccacttccacctacacttcgagcctacgccctagaccgaggtccagaagtgtggtcggcttaggtttattgtgtacagtactaattacttattccgttcctacctagtacggtaccgttccggaaccgtaaggtaccgtaagggtacaaacgttagaaaccgtagtcgtcgatacggcctacgtacg

SEQ ID NO: 182168 - DNA, 729 bp, Homo sapiens
  misc_feature: GYAE6OF01DMPTR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggcccaccatacaactgactaacgtccacgaccagtagtttatttttacacgtctaccaaccaaataagtagtttactagtcgttggttaccagacaacgaaacaggactataccgtcctgccactgtacctctactttacgtcgggtcgtaccggtacccggtaacgtcccgggtccctacgaccgtagttcgaggtcggcgtaggtcgggtctcggggactagtactttacgacctcgtaccactactaccgacacgtacgtcccgtcggacggtaacggccgttaagaaacgggttgttagggtcggtacgtttaagttttagtttacgttacgtcgtaaactaccgttaaattactttaacgtttacctttacccgttaccttaacgtaccggttacccgggttacggaaccggtaaacccgggggtaaaccgtaaagggttaaccggtaaaaacgtaacccgtaaacgggttaaacccgttcgggtaaccggttacgtaaccggtaacccgtaaccccgtttaag

SEQ ID NO: 182169 - DNA, 592 bp, Homo sapiens
  misc_feature: GYAE6OF01CDXCC.22.14.B03.1.454.CMB.1.raw
  modified_base (398)..(398): a, c, t, g, unknown or other
  misc_feature (398)..(398): n is a, c, g, or t
  modified_base (454)..(454): a, c, t, g, unknown or other
  misc_feature (454)..(454): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccagtcaactgcaagtccagccagagtatttttacagctccaccaataagagttacttagcttggttccagcaagaaacaggacatacgtcctgcactgctcgtatttcgtgggtcgtacgtacccgggaatcccggggtcctcgaccgtattccgagtgacgagtcggggtctggggacagtagtttcactcctanacccatcacgtcacggtcctgcgaacggtctagacgtactgtggacctaagttttntttaagttgttacagttacaaattacgtttaattacttccttcctacgtacggtacgttaccggaaccgaaacggtaccgtaagggtagaaaacgttaccgaaacgtaacgtcgtacggattacgcgtaacccgtacg

SEQ ID NO: 182170 - DNA, 663 bp, Homo sapiens
  misc_feature: GYAE6OF01DDZ0L.22.14.B03.1.454.CMB.1.raw
  modified_base (342)..(342): a, c, t, g, unknown or other
  misc_feature (342)..(342): n is a, c, g, or t
  modified_base (526)..(526): a, c, t, g, unknown or other
  misc_feature (526)..(526): n is a, c, g, or t
  modified_base (610)..(610): a, c, t, g, unknown or other
  misc_feature (610)..(610): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaacgtccagccagtagttatttttacacgtctaccaaccaataagacgttacttacgtcgttacggttccagtacaagtaaaaccgaggaccaacttccgtcctagcctactcgctctatttacgngggtcgtacgtacccggacgtcccgggtcctagtccgattcgagtcggcgtaggccgggtcgtagggactagtagttccactcgtccacctataccgagcctagccctgacgtaggactaggaagtacgttggtcgtacgtttagttttaacgtttagttcggtaacaacgtacttaaagtttntttaactacgtttcccctagtccgtaaaccgggttccgtaccggtaacggaaaccgggtaccggtaaacgggttacggtaaaanacccgtaaaacggtcgttacgggtaacggcttaaccggcctaacccgttacgg

SEQ ID NO: 182171 - DNA, 899 bp, Homo sapiens
  misc_feature: GYAE6OF01ALKCA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgccgtacggggacattgtgatcgacccagtcctccagacctcccgtggtctggtgtcctcggtgggacgaggacggacccaccactaccaacgtcgacaacgtaccgacgacctagtagtttacttttacgacgtacctaccaactaagtaacggtaacgtttaacgttacgtcgttccggttaccagaccgaacgaaaccgacggactacgttaccgtaccgttcgacctacgtcgtacccttacgtttacgttaccggtccgggtaccgtaccccggtaacccggggtaccggttccccgggtacccgtacggtaccggtattacggagggtccggacggtaccgggtccgggtacggacgggtacgtaacggtttacgtttacccgtactaccgtaccccgaactaccgtacggaaccggacgtacccgaccggttacgaccgggtaacggtacccggttaaggaacgtttacggtacgggtttaccggtaacgttttaacggttttaacgtttacggttaccgtaacgtaaccgttaaagtttaaacgttttacctttaaccgttacccttttaccccgttaccgtaaccgggttaacccgggttaccccggttaccgggggtaaaaccccggtaaccggggttaaaccggtaaaagggtttaaacccggtaaaacccgttaaacggggttaaaacccgttcgggttaaaccggtcgggttaaccccgtaccggtaaacccgttcgtttaaaccccgg

SEQ ID NO: 182172 - DNA, 698 bp, Homo sapiens
  misc_feature: GYAE6OF01AXQ6P.22.14.B03.1.454.CMB.1.raw
  modified_base (685)..(685): a, c, t, g, unknown or other
  misc_feature (685)..(685): n is a, c, g, or t
  modified_base (693)..(693): a, c, t, g, unknown or other
  misc_feature (693)..(693): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtggcgagaggccaccatcaactgacaacgtccacgccgtagtagtttatttttacagtcctaccaactaaataagtacgttaacttagtcgttacggttaccagacgaacgaaaccgacgacacgtccgtcctgaccactcggtcttcgtactttacggtcgggtaccgttaccggtaccccgggtaacgttcccggggtaccctacggtaccgtacgttcgaggtcggacgcgggtcgggtcggtcgggaactagtacttacgactacctaccgaaccgtactacgacgtaccgtacgtcccgtacgacgtaacggacgtaaggaaacgtaggtaggttacggtactttaacggtttttacttagtttcgtaacgtagttaacgttaaagttaactttaggtttaaccttcccgtacttacgtacgttaccggtaccggaacggtaaacgggtaccgaagggttaacgaaactaaccgaaagtacgtgtacgganactccgtntaacg

SEQ ID NO: 182173 - DNA, 585 bp, Homo sapiens
  misc_feature: GYAE6OF01D6Y7W.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactcgcaagtccagccagtagtatttttacagtctccaccaataagagttacttagcttggttccagcagaaaccaggactatcgtcctgcactgcctcgtacgtttacgtgggtcgtaccgtacccgggtaacgttcccggggtccctacggaccgtagttcgaggtggacgaggtcgggtcgtgggacagtacgttcacttctcacctagtccagcacgtcctggacaggcctaggaatgtggtcgcttaagtttattactgacctagactaagttattactacttccctcgtacacggtaccgttccggaaccgtaaggggaccctaagggtacggaaactaccggaaacgtactgggtacgcctgccactcg

SEQ ID NO: 182174 - DNA, 745 bp, Homo sapiens
  misc_feature: GYAE6OF01B4R24.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactcctggctgtgtctcgtgggcgaggacgggccaccatcaactcgacaacgtccacgccaacgtagtttaatttttacacgtcctaccaaccaaagttaacgtagtttacttagtcgttcggttccagtcaaagaaaccgaggactatccgtcctagcctactcgtacctactacttttacgtcgggtacgtaccggtaccgggaacgttcccggggtcctacggaccgtattcgaggttcggacgtacggtccgggtcgtacggggactaacggtacttttaccgaccttccgtacctaaccgagttaccgaacgggtcctaaccggtacgacggacggtacgtacgaagtaacggttcgtacggtacgttaagtttacgtttattcggttacgtagtaacttaacggtttaatttacgttaacctttccgttacccgtacgtaccggttaacgggttacccggtacccgggtaaacggaaccgggttaaacgtacgggtaaaaccgtaaccgtaaaccggttaacggttacggttaccggtacgttaccggacctaacccgttcggttaaccgg

SEQ ID NO: 182175 - DNA, 943 bp, Homo sapiens
  misc_feature: GYAE6OF01BLEJE.22.14.B03.1.454.CMB.1.raw
  modified_base (158)..(158): a, c, t, g, unknown or other
  misc_feature (158)..(158): n is a, c, g, or t
  modified_base (346)..(346): a, c, t, g, unknown or other
  misc_feature (346)..(346): n is a, c, g, or t
tcagacatacgcgtcacgaccggtgctcgatttagtgtgagtagttccgcggggggtagctacaacaggcaggcaggggcagcaagatggtcgttagcagacccaggtcttcatttctctgttgctctggatctctggtgcctacggggacattgtgntgacccagtctccagacctccctggcttgtcgtctcgtgggcgaggacgggcccaccatacgaacgtggcaacgtccagccagtagttatttttacagcctaccacaataagatttacttagtcttggttccagacgaagaaaccaggactaactcgtacctgccactcgcctactacgttttaccgngggtccgttaccggttaacccggggtaacgttcccgggggttaccctacgggtaaccgtagtttcgacggtcggcgtagggtccggggttcgtagggggtacctaaggttaccttttaccgaccttccgttaccaccgttaacgtcccggtaacgcctaacggtccccgttagggtacccggtaagggtacccgttaagggtaacggttacgttaacgggtacgggtttaacccgttaagggttttttaaccgtttaacgggttttccggtaaccggtaaacgggttaacccgtttaaaaacgttttaaccgttttttaaacccgggttttaccctttaaccccccggtttaccgtttaacccggttaaaaccggggtttaacccccggggttttaaaccggggtaaacccccgggggttaaaaaccgggggggttaaaacccccgtttaaacgggggggtttaaaccggggtaaaaaacccggttttaaacccccggtaaaaaaaccggggtttaacccccgggttagggggtttttaaccccgggaaccggttttaacccgggaacccccgtttaaaaccccggtttaaacccgg

SEQ ID NO: 182176 - DNA, 645 bp, Homo sapiens
  misc_feature: GYAE6OF01D6SH0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagtatttttacagtctaccaccaataagagttacttagtcttggttccagcaagaaccaggacatcgtctgcactgctctatttacgtcggtcgtccgtacccgggtaacgttccccggggtccctacggaccgtattccgagtcggacgacggcgggtcgcggggacaggtactttccgtaaccttccgtacctaacctactaccgacggccacggtccccgtgccgagggtccgttaggaaagtaggtgtcgggtacttaggtttttattagtttgtcaagtactaaattaactttattaacctttccctacgttcctacggtaccggtttaccgggaccgtaacggggaacccgtaagggtacggtaaacgtaaccgaaaccgtaccggttaggtacggacctcgacctccgtacg

SEQ ID NO: 182177 - DNA, 670 bp, Homo sapiens
  misc_feature: GYAE6OF01CJNQ6.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagtagtttactttttacacgcctaccaaccaaataagagtcttacttagctttcggttccagacaagaaccaggacactcctcctctactgctactatttacgtgggtccgtccgtacccgggaacgtcccggggtccctggaccgtagttcgacggtggcgaggccgggtcgtagggactaggtactttccgacgttcctaccaccgtactaccgacggtccacggtccgtacggactacgggaccgttaggaaaggtcggttacggtcggttacgtttaacggtttttacttaaccgtgtaccgtaaggtacttaaattactttaagttacctttacccgttccgtacgtaacggtaccggttccggaaccggtaaacgggacccgtaagggtaacgtaacgacgtaaaaccgtcgtaggtcggactacgaccgtacgttacg

SEQ ID NO: 182178 - DNA, 766 bp, Homo sapiens
  misc_feature: GYAE6OF01D5P3E.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgacccagtctccagacctccctggctgtgtctcgtggcgaggacggccacatcaactgacaacgtccagccagtagtttactttttacacgtcctacctaaccaaataaagtacgtttaacttagtccgtttacgttaccagactaacgaaaccgtaggactacgtccgtcctgcactgactactacttacgtcgggtccgtaccgtacccgggtaacgtcccgggtaccctacggtaccgtagttaccgacggtcggacgtacgggtcgggtacggtagggaacgtacgttacttaccgaccgttcctaccgtacgtacttaccgaacgtccgaacggtcccgtacgccggtaacggtccttaacgggtaaaggtcgtttagggtcgtaaccgtttaggttttttaacgtttagttacggtaacctaacggtacttaaagtttaactttacttaaccgtttcccttacccgttaacggtaccggtttaaccgggtacccggaaacccgggttaaacggggaaacccgttaagggtaacggttaaaacccaaccggttaaaaccggacgttacgggtacgggttacctaaccggccctaagttacccg

SEQ ID NO: 182179 - DNA, 756 bp, Homo sapiens
  misc_feature: GYAE6OF01BAZ66.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccgtggctgtgtctcgtgggcgaggacgggccaccatcaactgacaacgtccagccagtagtttactttttacgacgtcctaccaaccaataagtagtttacttagtcgttcggtaccagaccaaagaaaccgaggaacctacgttccgtcctgacctactcgtccttactaacgttttaccggtcgggtacccgttaccccggtaacccggggtaaccgttccccggggtaccccgtacggtaacccgttacttcggaacgggtcggacgtacgggtcggtacggtacgggacgtagttacgtttccacgttcctacaacgtcgtacgagccgacgtcccgtaggactacggtactagggtaacgtggtacggttcgtacgtttaagtttttacgttaagttcggaactaacgtaacgttaaattttacggtttaaactttccgtttaccccgttacctaaccggttaaccgggttacccggtacccgggtaaacccgggtaaaggtaccggttaaagggtaacggtaaacctaacccggtaaaacggtcgttacgggtacgactcgaacctacgttacg

SEQ ID NO: 182180 - DNA, 638 bp, Homo sapiens
  misc_feature: GYAE6OF01CWS5F.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagctccaaccaaataagagttactagtcttggttccagcaagaaaaccaggacatcgtcctgcactgctctatttacgtgggtccgtaccgtacccgggaacgtcccggggtccctacggaccgtacttcgaggttcggcgacggtccgggtcgttacggggactaagtacgtttccacctccgtaccaaccctatccgaagcaacgcccgtgacgagggctaggaaagtgttgggtgacgttaagttttatttagttcgtcaagtactaaattagtttacttacttcccttctacgtaacgtaccgggttccggacccgaaagggtaccaaaggggttaacgtaaaacgtaccgtaaaaccggtagttcggtacggtacgtacgaccctaaccgttacg

SEQ ID NO: 182181 - DNA, 662 bp, Homo sapiens
  misc_feature: GYAE6OF01BT9CC.22.14.B03.1.454.CMB.1.raw
tcagacatacgcgtcacgaccggtgctcgatttagtgtgagtagttccggcgggggagctacaacaggcaggcaggggcagcaagatggtgttgcagacccaggtcttcagtttctctgttgctctggatctctggtgcctacggggacattgtgatgacccagtctccagacctccctggcctgtgtctcgtgggcgaggagggccaccatcaactgacaagtccagccagagttatttttaacacgtctaccaacctaaattaagtaagtttacttagtcgttgttaccagacgaagaaaccaggacactacgtcctgccactgctactatttacgtgggtccgtaccgtacccgggaacgttcccggggtccctaggtaccgtagttcgaggtcggacgtaggtcgggtcgtgggactacgtagttccacttctaccacctactccaagtcgacgtcccgtagacgaggtaccgttagaaaggtcgttacggtcggtaacgtttaagttttagttacgttagtacccgaagtaccttaattagtttactttacgtcctacgtctaacgggtaccgttaccggaaccggtaagggaaccgtagggtaacggtaactaaccgaaacgtaccgtaggttacgattaccgcgtaaccgttacg

SEQ ID NO: 182182 - DNA, 742 bp, Homo sapiens
  misc_feature: GYAE6OF01D30CI.22.14.B03.1.454.CMB.1.raw
tcagacatacgcgtcacgaccggtgctcgatttagtgtgagtagttccgcgggggagctacaacaggcaggcaggggcagcaagatggtgttgcagaaccaggtcttcatttctctgttgctctggatctctggtgccgtacggggactattgtgatcgacccagtcctccagacctcccgtggcgtgtgtcgtcgtcgggcgaggacgggcccaccatacaacgtgaccaacgtccgacgaccagtaacgtttactttttaacgacgtcctaccaacctaaataagtaacgttacttacgtacgttcggtaccagacaacgaaacgacggactacgtaccggtcctcggtaccacgtcgtaccttactacgtttacggtacgggtaccgtaccggtaacccgggtaaccggttcccggggtacccgtacggtaaccgtacgttacgagggtcggtacgagggtccgggtcgtacgggacgtagttacttccgtactacctaccgactagtccgaacgtcacggtctagaccgtggtactaggaacgtgtcgggtacgttattacgttttatacgtcgtagtacgtaattaagtttacttactttacgtcccttaacgtcggtaacgtttaccccgggacggaaccgggtaaacgggtaaccgtaacggggttaacttaaaaccaaacgggttaaacgttacgggtacggttccgaaaccggtccgtactaacggttacccg

SEQ ID NO: 182183 - DNA, 654 bp, Homo sapiens
  misc_feature: GYAE6OF01EGIOG.22.14.B03.1.454.CMB.1.raw
  modified_base (429)..(429): a, c, t, g, unknown or other
  misc_feature (429)..(429): n is a, c, g, or t
  modified_base (471)..(471): a, c, t, g, unknown or other
  misc_feature (471)..(471): n is a, c, g, or t
  modified_base (632)..(632): a, c, t, g, unknown or other
  misc_feature (632)..(632): n is a, c, g, or t
  modified_base (641)..(641): a, c, t, g, unknown or other
  misc_feature (641)..(641): n is a, c, g, or t
tcagacatacgcgtcacgaccggtgctcgatttagtgtgagtagttccgcgggggagctacaacaggcaggcaggggcagcaagatgggtgttgcagacccaggtcttcatttctctgttgctctggatctctggtcgccgtacggggactattggtgatcgaccctagtctccgagtacctcccgtggtcttgtgtctcgtgggcgaggacggccaccactacaactcgaacaacgtccacgaccgaaggtaacgtttactttttacgagtccctaccaacctaataagtaacgtttaacgttacgtccgtttacggtaccaaggactaacgaaaccgaggactactccgtctcgactacgtgtctactagttacgtcggtcgtaccggtacccggtacggtcccgggtaccctagaccgtatacggnggtcggacgtcgggtcgggtcgaggtacgtacgttacttacnccgtactaccactactacgacgtcaccgtcgtgacgtacgtacgtagagtgtcgtgtacgtttatttagtatcgatagacttaattcttaattcgtcctacgtagtacgtccggtacgaacggaacggtacgaagttagaaactaacgtaaacgtcggtanacggttacncgtaccagttacg

SEQ ID NO: 182184 - DNA, 734 bp, Homo sapiens
  misc_feature: GYAE6OF01DFM9E.22.14.B03.1.454.CMB.1.raw
  modified_base (222)..(222): a, c, t, g, unknown or other
  misc_feature (222)..(222): n is a, c, g, or t
  modified_base (571)..(571): a, c, t, g, unknown or other
  misc_feature (571)..(571): n is a, c, g, or t
  modified_base (633)..(633): a, c, t, g, unknown or other
  misc_feature (633)..(633): n is a, c, g, or t
  modified_base (721)..(721): a, c, t, g, unknown or other
  misc_feature (721)..(721): n is a, c, g, or t
tcagacatacgcgtcacgaccggtgctcgatttagtgtgagtagttccgcgggggagctacaacaggcaggcgaggggcagcaagatggtgttgcacgacccaggtcttctatttctctgttgctcgtggtatcctcgtggtcgccgtaccggggactagttgtgtagtaccgacccgtacgtcctccgaacgtcctccgtcggtccttggtcgtcgtcggnggggacgacgggaccggccacctactaccgaacgcgactaacgtccgacgtaccaggtaacgtttttacttttaccacgtacctaaccaaactaagtagacgttacttaccgttagttccgtttacgaccagaccgaaacgtaccgaagacctcttacccctcttcgtactccgtactcgtttacgttcgcgggttaccgtccggtaccggtacggttcccggtacgtaccgacgttacctggacggtcgtacggtacgggtcggttagtaccgggaatccgttaactccgtacctagtacctacgtactacggacaccgttcgacgacgcgtacggacggagttacgngtagggtaccttagttttacgtaattccgtaacgtactacgtaattcttaacgttctttacncccgttacggtacctaacgggttaccggtaccgtaaaccggggtaaggtaactaaccgggtaagaacgtacgtaagtcgtgacgtacncacgtacccttgg

SEQ ID NO: 182185 - DNA, 783 bp, Homo sapiens
  misc_feature: GYAE6OF01EG1PN.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtaaggggacattggtgatcgacccagtctccagacctcccgtggtctgtgtctcgtgggcgaggacgggccaccagtacaactgacacgtccagccagtagtttactttttacgacgtacctaccaaccaaagttaagtaacgtttaacgttacgtcgttttacggttacccgaaggaccgaaacgaaaaccgacgggtaacctaagttcccggtccgtcgaccgtaccgtcgtccttacgttacgttttaaccggtcgggtaccgttacccgggtaaccccggggtaaaccgttccccggggttacccctaccggtaacccggttacttccggacgttacgggcgacggggtccgggtcggtacggtaacgtacggttactttcccgaacctttcccgacctaacctactaccgaacgtccgaaccgtcccgtacgaccgtacgggttactaaggaaacggtcgttggtacggtacgtttaacgtttttaagttcgtttacgacgtaacgtaattaaattactttacgttacttccctacgtactacgggttaccgtacggtaaacgtaaccgggtaacgaagggttacgaaaaccgtacgtaaacggtacgttccgggtaagtaccgactcgaacgttaccg

SEQ ID NO: 182186 - DNA, 759 bp, Homo sapiens
  misc_feature: GYAE6OF01CBWQW.22.14.B03.1.454.CMB.1.raw
  modified_base (341)..(341): a, c, t, g, unknown or other
  misc_feature (341)..(341): n is a, c, g, or t
  modified_base (372)..(372): a, c, t, g, unknown or other
  misc_feature (372)..(372): n is a, c, g, or t
  modified_base (436)..(436): a, c, t, g, unknown or other
  misc_feature (436)..(436): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacgggccaaccatcaactgacaacgtccagccagtagtttatttttacagcctaccaaccaaataagtagttaacttagtcgttaggttccagacaacgaaaccaaggacactccgtcctgccactcgctctagtttacgnggtcgtccgtaccggtacgtcccgggtcccncgacgtacgtcgtaggcggcgaggcgggtcgtacgggactagtacttaccactctaccaacccngtaccgacgaccgcgtacccgtcgacgtacggtacgtacgggtaagtaggtgggtacgggtaaccttttaaggtttaagtttacgtttacggacgtaacgtaccttaaaagtttacgttttaacttaccgttttcccctaccgttacggaaacccggtttacccgggttacccggtaaacccgggtaaaaacgggggtacccgttaaaagggggttaaacggttaaaaacccgttaaacccggggaaaaaacccggttaaccggtttcggggaaaccggttaccccggttaaacggtacccccggttaaacccttaacccggg

SEQ ID NO: 182187 - DNA, 860 bp, Homo sapiens
  misc_feature: GYAE6OF01B2APD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggacattgtgatgaccagtctcagactccctgctgtgtctcgtgggcgaggacgggccaccatcaactcgcaagtccagaccagtacgtttaatttttacacgtctaccaacctaaagtaagtagttacttagtcgttaggttaccagacgaacgaaaccgaggactacgttaccgtaccttgacacgtgcctacgttaagtttaccggtcgggtaccgttacccggttaacccggggtaaacgttccccgggggtccttacggaccccgtaaattcgtaacggggttcggacggtacgggtacccggggttgtacggggtaacctacgttaacgttttacccgaacgttcccttaaccgtacccaactaccggaacggcccgtaacgtccccggtaggaccggttaaccgggtacttaaggaaaccggtaagtttcgggtacggtaaccgtttaagttttttaagtaacgttttcggtaaaccgtaacgggttaaaccttaaaaagtttaacggttttaacctttaaacccttttacccccgttaacccgtaccggttaaaccgggtttaaaccccggggtttaaccggaaaccccgggttaaaaacgggggtaacccgttaaaagggggttaaacgtaaaacgttaaacccggtaaaaacccggtaacggttacgggtacccggtacgtaacggtaaacccaacccggttttacg

SEQ ID NO: 182188 - DNA, 780 bp, Homo sapiens
  misc_feature: GYAE6OF01DK77E.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtcctccagacctccctggctgttgtctcgtcgggcgaggacgggcccaccactacaactcgacaacgtccacgccaagtacgtttatttttacacgtcctaccaactaaataacggtacgtttaactaacgtcgtttacgggttaccaagtacgtaaacgaaaaccgaggaaccgtatccggttacctcgacctaccttcgccttaccgttaacgttttaccggtgggtaccccgttaacccggtaccccggggtaaccggttccccggggtacctacggtaccgttacttacgaggtcggacgacgtcgggtcggtacggacgtaagttcgttacctacgtaccgttccaaccgtacgtaccgtaacgtccgacgtcccgtagaaccgggtagtcccgtaagggaggtctttacgggtaggttaccttttaaggttttacttacgttgtaaccgtacgttaacttatttacgtttactaccgtttccctacggtaacgtaccgggtttaaccgacccgggtaacggtaaaacccgggacgttaagggtaccggtaaactaaaccggaaaccgttagggtacggttacgtacccggttacgccgttacttaacccgg

SEQ ID NO: 182189 - DNA, 701 bp, Homo sapiens
  misc_feature: GYAE6OF01BXC74.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgacagtccagccagtagttatttttacacgtctaccaaccaataagtagtttactagtcttcggttaccagtacaacgtaaaccacggacctacgtccgtcctacgcgaactcgtacttactactttacgtcgggtccggtccgtaacccgggtacggttccccggggtcccgtacggaccgtacgttctaggtcggacgcgggtcggtcgtacgggactagtactttccgaccttccgtaccacctactacagtaccacggtccctgaccgaggtactaggtaagtgtcggtacggtacgttaaggttttatttagtcggttacgaacgttacgtaaactttagtttaacttacccgtttacccgtacccttacggaaccgggtttaccggtacccgggtaaccggtaaaccgggaccggttaaagggttaacgtaaaacgtaccgtaaaacgtacgttcggtacggtacgtcgaacccgttacgtacg

SEQ ID NO: 182190 - DNA, 833 bp, Homo sapiens
  misc_feature: GYAE6OF01EY295.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtccggggacatcgtgatcgacccagtctccagacctccctggctgtgtctcgtgggcgaggacgggccaaccatacaacgtgacaagtccacgcctaagtagtttatttttacagtcctaccaaccaaataagacgtacttacgttacgtctttacggttaccagactaacgaaaccgaggtaactactccctcctacctactcgtctcttaacgttttacggtcgggtaccgttacccggttacccgggtaaccgttccccgggggtaccctcggtaaccgtacgttacgaggtacggtcgtacgggtccggggttacgtacggggtaccagtttacgtttacctaaccttccgttaccaaccgtacttaccggaactccggtaccgtacccggttaccggacggtacgggtaccgttaagggaaacggttaacgggtttcgggtaccggggtaacctttttaaggtttttaaaccccgttaccggttaaccggttaaccgtaaggttaaccgtttaaatttaacgttttaaactttacccgtttaaccccgtacccgttaacggttaccgggttacccggttacccggggaaacccgggtaaaaccgggtacccgttaaaaggggtaacgtaaaactaaccggtaaaacgtacgtaccgggtacggtaaccgtcgtactaaacccgttacgg

SEQ ID NO: 182191 - DNA, 705 bp, Homo sapiens
  misc_feature: GYAE6OF01EHE4Q.22.14.B03.1.454.CMB.1.raw
  modified_base (432)..(432): a, c, t, g, unknown or other
  misc_feature (432)..(432): n is a, c, g, or t
  modified_base (500)..(500): a, c, t, g, unknown or other
  misc_feature (500)..(500): n is a, c, g, or t
tcagacatacgcgtcacgaccggtgctcgatttagtgtgagtagttccgcggggggagctacaacaggcaggcaggggcagcaagatggtggttcgcacgacccaggtcttcgatttcctctgttgctctgggatctcgtggtcgacctacggggacattgtgatgacccagtctccagtacctccctggctgtcgtctctgggcgagacgggccaccatcaactgacaaggtccagccagagttatttttacacgtcctaccaccgaatacgtagttaacttacgtactttcggttaccgaagacgaacgtaacccgaaggacctacgtccgtaccgtgacctactcgctactagtttcgcggtcgtaccgtaccgggtaacgtcccgggtacctcggaccgtattcgaggtcggacgtcggccgggtcgnggtaccagtacttacgtactctccgacctattaccgagacacgtccctagctagggctaacgaaggtntacggtggtaccgttagttttaattcgttagtaccgaagttaaccgtaagtttactttaacggttacttcccgtaccgttaacgtacggggttaacccgtttccggggaaaaccttaaccggggggaaccttaaaggggggttactaaaacaacccggtaaacgtaccggttagggtacccggaatttccgaccgtacgtaccgg

SEQ ID NO: 182192 - DNA, 796 bp, Homo sapiens
  misc_feature: GYAE6OF01DNG83.22.14.B03.1.454.CMB.1.raw
  modified_base (576)..(576): a, c, t, g, unknown or other
  misc_feature (576)..(576): n is a, c, g, or t
  modified_base (651)..(651): a, c, t, g, unknown or other
  misc_feature (651)..(651): n is a, c, g, or t
tcagacatacgcgtcacgaccggtgctcgatttagtgtgagtagttccgcgggggagctacaacaggcaggcaggggcagcaagatggtgttgcagacccaggtcttcatttctcttgttgctctggatctcgtgggtcgtccgtacgggactattggtagacgtcgaccgagtcctccacgacctccgtggctgtcgtcgtcgtgggcgaggcggaccacctagtacaacgtgacgtacgtacacggacctaagttacgtttaacttttacgaccgtacctaacccgaaaacttaaaagttaacggttaacgtttaaccggttacgttaccggtttaccgggttaccaaagaaccgtaaacgaaaaccgtacgtaactacgtccgtaccgtcgacctacgtcgtacttacgtacttacgggtcggaccgttaccggtaccggtaaccgtcccgggtacctacggtacgttactacggtaaggtccgtacggtacgggtaccgggttcgacgggtactacgttacttacgtaccctacgtaccaacgtactaccgagtaaccgtctacccgggtanaaccgggtagtaacggtacgtaaagggtcgttagggttacccgtaaatttttagttttaacgttacgacggtaanaccttaattaaaccgttatttacccgttacttccctacggtaacggttaccggtacggaacccggtaacggaagggtaaaccggaaggtttacaaaccgtaaccgtaagaccggttggtacacccggaaactccagtttaccggg

SEQ ID NO: 182193 - DNA, 728 bp, Homo sapiens
  misc_feature: GYAE6OF01CFZNR.22.14.B03.1.454.CMB.1.raw
  modified_base (214)..(214): a, c, t, g, unknown or other
  misc_feature (214)..(214): n is a, c, g, or t
  modified_base (562)..(562): a, c, t, g, unknown or other
  misc_feature (562)..(562): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggacattgtgatcgacccagtcctccagacctccgtggctgtcgtctcgtgggcgaggacgggccaccntacacgtcgacacgtaccgcgaccaagtacgtttatttttacgacgtacctaccgaacctaagtaagtacgtttaacttacggttacgttcggttaccaacgacgaaacgaaaccgtacggaacctacgttccgtacctcggtacctacgtcgtcttacgttacggtttaccggtcgggtacccggttacccggtaacccggggtaaccggttccccggggtccgttacggtaaccgtagttccggtaggggtccgtacggacgggtcccgggtacgtacgggtacacggtttacttccgtacgttccctaccgacctctaccgactccgactccgtacgcgtacggntacggagtgtaggtcgtagttattatgtacgtctaagtacttaacttattcgttaccttcccgtctaccgtaacgtcggttaccgaacggaacgggtacctagggtaaaccgtaataaaccgggtaagtacgttaaccgggtgtaccgaccggtactaacgtaccg

SEQ ID NO: 182194 - DNA, 614 bp, Homo sapiens
  misc_feature: GYAE6OF01A3LCW.22.14.B03.1.454.CMB.1.raw
  modified_base (434)..(434): a, c, t, g, unknown or other
  misc_feature (434)..(434): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctccaccaataagagttaacttagcttggttccagcaagaaaccaggacatcgtcctgcactgctcatttactgggcgtcgtacccgggaatcccggggtccctgaccgattcgagtggcgaggccgggtcgtggggacaggtactttccacttctccaccatccgaagcacgtccctgccgaggcctagaagntggtgtacttagttttattagttcgtactaagtacctaaagtttattaacttacttcccttacctctacggtaccgttccgggaaccgtaacggggtaacccgtaaagggttaacggtaaaactaccggtaaaaccggtaaccgttgggtacgggaaccttacggacctaacccgtaacg

SEQ ID NO: 182195 - DNA, 785 bp, Homo sapiens
  misc_feature: GYAE6OF01C07MR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgaccgtacggggactattgtgatacgaccctacgtcctccgacgtacctcccgtggtctggtcgtctcggtgggacgaggacggaccacctactaccactgacaacgtccacgaccagttaactttacttttacgacgtcctaccgaactaaagtaagtacgtttacgttacgtccgttacgtaccagaacgaacgaaaccgacgactactccgtctacgcctactcgactacgttaagttcggtcggtaccgtaccggtaaccggggtaccgtcccgggtccgtacgtaccgtacgtcgacggtcggacgtacgggtcggtacggtacggacgttagttacgttaccctacgtacctaccgaacttactaccggacgtaccggtacgtcgtacgacggtaacggtataagggaacgtagttcgggtacgttaagttttaacggtttcttaacgttacggtaactaacgttaaatttaactttacttccgttaacccctttccgtacgtaacgggttaacccggttaacggtaacccggggtaacggtaaaaccgggtaacggttaaacggtaaaaccgttaaacgaaacccggttaaaagttccggttaacgggtaacctaccggtaacctcccgttaacgtaccgg

SEQ ID NO: 182196 - DNA, 776 bp, Homo sapiens
  misc_feature: GYAE6OF01EXJQ4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacgggactagttgtgatcgacccagtcctccagacctccgtgctgtgtctcgtggcgaggacggccaccatacaactgacaacgtccacgaccgaagtacgtttaacttttacgacgtcctaccaaacctaaagtaacgtaacgtttacgttacgtacgttacggttaccaacgacgtaaacgaaaccgagtaacctacgtccgtacctcgacgtacgtcgtcctacgtagtttaccgtgggtccgtaccgtacccgggtaaccggtcccggtccgtacgtaccgtacgtcgtaggtcggacgtacggtccggtcgtaggtaacctacgttacgttacgtacctacgtaccgaaccgtacgttaccgacgtacccggtaacgtcccgttacggacggtaacggtacccgtaaaggtaaacgttcggttacgggtaccgttaaccgttttaaagttttaacgttttacgtaacgggttaactaaaccggttaactttaaaggtttaacctttaactttaaccgtttccccgtacgttaaccgtaacggttccgttaaaccgggaacgtaaacggtaaccgtaaaggtaaccgtaaactaaccgaaagtaccgttggacgctacgactaccgtaacg

SEQ ID NO: 182197 - DNA, 673 bp, Homo sapiens
  misc_feature: GYAE6OF01AZES0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgcaagtccagccagtagttatttttacagctaccaacctaataagagtttacttagcttggttccagcaagaaccaggacactcgtcctgcactcgctactatttacgtcgggtcgtaccgtacccgggtaacgtcccggggtaccctggaaccgtattccgaggtcggcgtacgggtcgggtcgtacggggactaggtactttccgacttcctaccaaccgtataccgacgccgtacgcccgtcgacgtacggtacgtaaggtaacggtagttcgggtacgtactttaggttttaatttacgttcggtaactacggtaacctaaagtttacttaactttaccttacccgtacctaggtaaccgttaccggtacccggtacccggaaaaggggtacctaagggtaacggtaaacctaacgaaacgtacgttcggtacgtaccctagacccgtaactacg

SEQ ID NO: 182198 - DNA, 749 bp, Homo sapiens
  misc_feature: GYAE6OF01C1CET.22.14.B03.1.454.CMB.1.raw
  modified_base (589)..(589): a, c, t, g, unknown or other
  misc_feature (589)..(589): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggactattgtgatcgacccagtctccagacctccctggctgtctctcgtgggcgaggacggccaccataccaactgacaacgtaccacgaccagtatttacttttacacgtcctaccaactaagttaagtacgtttactagtctttcggtaccagacaacgaaaccgaggtacaacttccggtacctgacctacgtcgaccttacttacgtttacggtcgggtaccgtaccggtaaccccggggtaacggttcccccggggtacctacgggtacctaacgttccgaagggtcggcggtaacggtcgggttccggagggtacctagttactttccgaacttcccgtacacccgtagttacccgaacgccgtaaccgtccttaccgacgtacgggacttaaggacggttggtcgtacggtactttttagttaacgtttgtacgtanaacgttacttaatttaacctttagttacctttccgtaccttacggtaaccggtttaccgggaaccgtaaccggaaccggtaaacgggtaaggttaaaccggtaaacctacgtaaaaccggttcgtacggtaacgtcctaaccgacctaagtttaccccgg

SEQ ID NO: 182199 - DNA, 861 bp, Homo sapiens
  misc_feature: GYAE6OF01C8LXO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctcgtggtatctcgtggtcgccgtacggggactagttgtgatacgaacccagtcctaccagaccctcccgtggtcctggtcgtcgtcggtcggggacggacgggacgggacccaaccgataccgaacgtgaccgtaacgtaccgacggaccgtaggttaacgttttaactttttacgacgtacctacctaaactaaagttaaggttacgtttaacgttacgtccgtttaccgggttaccaacggaaccgtaaacggaaaacccgaggtaacgtaccgtccgtcctacgtacctaccgtacgtcctacgtttaaccggttaccggtcgggttacccgttacccggtaacccggggtaccggttccccgggtaccgtaccggaacccgttacgttaccgtacggggtccggacggtaccgggtccgggtaccggtacggggtaacctacgggtttaccttaccgtacccttacgaaccctaccgtacgtacaccggtaccgaccgtccggacgtacggtaggttaccgaaggtaccggtaaggtcggttaagttacgtttaagtttacttacgttacgacgtaacttaagttactttaattaccttacccgttcctacgtaacgtacggttaccgggtaaccggaacggtaaacccgggtaacgtaaggggtaaactaaacccggtaaacggtaaacgttcggggtaccttaaccggacttacccgtaaacgtccgtttaccg

SEQ ID NO: 182200 - DNA, 670 bp, Homo sapiens
  misc_feature: GYAE6OF01DHPV0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccacgccagtagttatttttacagctaccacctaaataagtagttacttagtacttggttaccagacaagaaaccaggactatcgtcctgcactcgctctatttacgtgggtaccgtccgtacccgggaacgtcccggggtccctgaccgtacttcgtacgtcgggactagggtccgggtcggtagggactaggtactttacaccttctacctaaccctagtccacgacgtacgtccgtacgaccgacggtcctaagggtaagtaacgttggtaggtacctttaagttttacttagtttcggactaacgtacgtaaattatttaacgttaccttcccttacgtcgtaaccggtaccgttccggaaccgtaaacgggaaccgtaaagggtaggtaaacctaaccgtaaaacggtaacgttacggtacggtacctcggtaacctccgtaaacg

SEQ ID NO: 182201 - DNA, 724 bp, Homo sapiens
  misc_feature: GYAE6OF01EE5P8.22.14.B03.1.454.CMB.1.raw
  modified_base (583)..(583): a, c, t, g, unknown or other
  misc_feature (583)..(583): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacgggcccaccataccaactggaccaacgtcccacgccaggtagtttactttttacacgtcctaccgacctaaataacgtacgtttacttacgtcgttcggttccacgacgaacgaaaccgaggaccactccgtacctcgacctactcgcctactactttacgtcgggtaccgtaccgtaaccccgggtacgtcccgggtcctcggaccgtagttcgaggtcggcgacgggtcggtcggtacgggacctaggttacttaccgtaccttccgttaccacccgtactcgaccgaccgtacgtcccttaggaccgaggtaccgtaaggaacgttgtacggttggtacttagttttaacttgttacgaccgtaatacttaaacgttntttaacgttcccttccttaccgaccgttacggtacccgggttaaccggaaccggaaccggggttaaacgagggtttaacgaaaacgtaacccggtaaaagttacccgtacggtacggacccttacggcctaacccggtacg

SEQ ID NO: 182202 - DNA, 765 bp, Homo sapiens
  misc_feature: GYAE6OF01BNPVH.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctcccgtggctgtgtctcgtgggcgaggacgggccaccatcaactgacaagtccagccagtagttatttttacacgtctccaacctaaataagtacggttacttagtcttggttaccagacaagaacgaggactacgtccgtactcgactactcgcctactattacggtcgggtccgttaccggtaaccccgggtacgtcccgggtacccgtacggaccgttacgttccgagtcggacgacggtcgggtcgtacgggactacgtacttacactcgtaccacgtatccgagcctacgcccttacgcgtacggtacacggtaagtactggggtacgtacgttaacgtttttaagtaccgtggttaacccaaggttaccttaaaacttttactttaaaccgtttacgttaccccctaaccgtaacggttaccgggttaacccggttaccccggggtaaacccgtaaaaccggggggtaaccccaaaagggggtttaacccgaaaaacccgttttaaaccggggaaaaacccgtttaccgggtaacgggtttacgggaaccccgttacggtaaaccccggtaaccctttaaaccggg

SEQ ID NO: 182203 - DNA, 781 bp, Homo sapiens
  misc_feature: GYAE6OF01A6B51.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccgtggctggtgtctcgtgggcgaggacggccacatcaacgtgcaagtccagaccagtagtttatttttacacgcctaccaactaataacgacgtactacttagtcgttacggtacctagacgaacgaaaccgaggacctacgtcctacctactactcgactacgtactttacgcggtcgtaccggtaccggtacgtcccgggtacctcgaccgtagttcgagtcggacgtaggtccgggtagtacgggacgtacgttacgtttaccaccgttccgtaccaaccgtagtaccgacgaaccgtccgtacccgtacggtaccggtaggtacccgttaagtaacggttacgtcgggttaccggttacgtttaacggtttttaacgttaaccgtttacggtaccggttaacgttaacgtttaaacgtttaagttttaacccgtttacgtttaccccgttaccgtaccggttaacgggttaccccgggttaaccgggttaaaccccggaaacgggggtacccgtaaagggtttaacggtaaaaacccgttaccggaaaaaccggttcggttacgggtaccgggttaaccgtacccgacgtaccccgttaacgg

SEQ ID NO: 182204 - DNA, 875 bp, Homo sapiens
  misc_feature: GYAE6OF01AMJ1S.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctcctgctgtcgtcctcgtgggcgaggacggccaccataccaactgacaacgtccgacgccagtagtttactttttacgacgtcctaccaccaataagtacgtttactagtcgttcgttcctagaccgtaacgaaacccgaggtaacctacgttaccggttaccgttcgaccgtacctcggtccctttaccgttaacggtttttaaccggttcggggtacccggtttaccccggttaaaccccgggggtaaaccggtttccccgggggttacccctacggtaaccccggttagttaccggtaacgggtcgggtaccgtacgggtccggggttcggtacggggaacgtacggttacgtttaccgtaccgttccgtaccctaaccgtacgttacccgaacggacccggtaccgtacccgttacggaccgggaacggttaccgtaagtaacgggaacgtttcggtacccggttagttttaagttttaacgtttcgttaacggttctaaagtacctttaacgtttaagttaccctttaactttccccgttaacccgtaccggttaacgggttaccccggtttaaccggaaacccgggttaaacggggtaacccggttaaaggggtaaacggtaaacccgtttaacccggaaaaccggttaacgttcgggaccggttaacccgtacgaacccccgtaagttacccgg

SEQ ID NO: 182205 - DNA, 681 bp, Homo sapiens
  misc_feature: GYAE6OF01BTH4V.22.14.B03.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgtgagtagttccgcgggggagctacaacaggcaggcaggggcagcaagatggttttgcagaccccaggtcttcatttctctgttgctctggatctctggtgcctacggggacattgtgatgacccagtctccagactccctggctgtgtctcgtgggcgagagggccaccatcaactgacaagtccagccagagttatttttacagctccaccaataagagctacttagcttgttccagcagaaccaggacatcctcctctactnctctatttacgtgggcgtacgtacccggaacgtccggggtccctgaccgtacgttcgaggtggcgtaggtcggtcgtagggacagtacgtttcactctcaacctatacacgacacgcctgcgtacggcgtagtaaggattcggtacgtacttagttttaacttagtttcgtacgtaacgtaacgttaaatttaacgtttacttaaccttttacccctaccgtttaccgttaaccggtaccggttttaccggggaaaccccggttaaacggggaaacccggtaaaggggttaaaccggtaaaaccttaaacccgaaaaaccggttaacgttacgggtaacgggtacccgttaggaacccctaaccgtaccgtttaacccgg

SEQ ID NO: 182206 - DNA, 686 bp, Homo sapiens
  misc_feature: GYAE6OF01CA676.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctcgtgggcgagagggccaccatcaactgacaagtccagccagagttatttttacagctaccaactaataagtagttacgttagtacttcggttaccagtacaagaaaccaggaactagtaccgtcctgcctactcgtacctctaacttttacggtcgggtccgtaccggtaccccggggtaacgttcccggggtaccctacggacccgtagttccgtaggtcggacgacggtccgggtcgtaggggactagtacgttttccaaccgttcctaccaacctgtaccgaacgtccgacgtcccgtgacgaggtcctagaagtcgtggtcggtacttacgttttatacgtttacgtacgtagtaacgtaatttatttacgttaactttcccgtacgttaccgtacggttaaccgttacccgggaaaccgtaaaccggggtaaccttaaagggtacggtaaaacctacggtaaaacgtcgtaaggtacggactacgactacgttacg

SEQ ID NO: 182207 - DNA, 528 bp, Homo sapiens
  misc_feature: GYAE6OF01AYW6N.22.14.B03.1.454.CMB.1.raw
  modified_base (307)..(307): a, c, t, g, unknown or other
  misc_feature (307)..(307): n is a, c, g, or t
  modified_base (399)..(399): a, c, t, g, unknown or other
  misc_feature (399)..(399): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaccaggacatcgtctgcactgctcatttacnggctctaccggatccgggtcctgaccgatcagtgcagcggtctggacagtattcactcgtcaccatcagcagtcctgcaggctgaagtatgngtctagtttatattgtcacgtataattattacttattcctacgtacagtaccgttcggaccgtaacgggacctaagggtacgtaaaactaccgaaacggtacgtaggtacgacgtacgcctaccgtacg

SEQ ID NO: 182208 - DNA, 787 bp, Homo sapiens
  misc_feature: GYAE6OF01EOO18.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggactattgtgatcgacccagtctccagacctccctggctgtgtctcgtgggcgaggacggccaccatcaactgacaagtccagcctagtagtttaactttttacgagtcctaccaactaaagtaacgtacgtttacttagtcgtttcggttacccagtaccaaacgaaacccgaggtaacctagtccgtaccgtcgacctaccgtactccttacttaacgtttacgtcgggtaccgttaccggtaaccccgggtaaccggttcccggggtaccctcggtaacccgtacttcggtacggtcggacgacgggtccgggtcggtcggtacgtagttacgttctaccttaccgtaccacgtactcgacgtaccgtaacgtcccttaggaccgtacggtaccgtaacggtaaaggtcgttagggtacggttaccgtttaagtttttaacgtttcgttaccggaccgttaacgttaaccgttaattttaacgttttaccttaaaccctttcccgtacccgttacggtaaccggtaacccggtttccggaaacccggtaaacgggttaaccgtaaagggttaacgtaaaccgttaaaccgaaaaccggttacgtcgggtaacgtacgttacccaaccgtaacgttaccgg

SEQ ID NO: 182209 - DNA, 391 bp, Homo sapiens
  misc_feature: GYAE6OF01DOCHO.22.14.B03.1.454.CMB.1.raw
  modified_base (351)..(391): a, c, t, g, unknown or other
  misc_feature (351)..(391): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctgggggccagggaacccctggtcaccgtctcctcagccctccaccaagggcccagtccggtccttccccctggccgccctgcctccgaaggacgccaccgtccgagacgcacgacggccggccccgtgggcctgccctggacaacggactaccttccacgcgtatgtctaggaggcgggtcgtggacgaacggcgactataggnnnnnnnnnnnnnnnnnnnnnnnnnnnnnnnnnnnnnnnnn

SEQ ID NO: 182210 - DNA, 793 bp, Homo sapiens
  misc_feature: GYAE6OF01EGAL7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgactgacccagtctccagacctcccgtggctgtgtctcgtgggcgagacgggccaccatcaactgacacgtaccacgacagtattatttttacacgtacctaccaactaataagtagttacttacgtcgttcggttaccacgacgaacgaaaccgacggactacgtccgtcctacggactacgtcgtacctacttacgttacgtacgggaccgttacccggtaacccgggtaaccggttccccgggtccctacggtacccgtagttacgacggttacggaccgtacgggtcgggtaccggtagggtacgtaacgttacttccgtaccttacccgtaaccctaccgtactacccgaggtcccgtacgtacccgtcgtacgacggtaccgtaaggaacgttagggtcgtagtacgtttaagttttaacttcgttagtacgtaactacgtttaaaagttacttttaacgttaccctttacccttaccccgtaaacgttaacccggggttaccgttaacccggggtaaacccggtaaaaccggggtaaacccgtttaaagggttaaacggttaaaacccctaaaacgggtaaacccgttaaccggttacggtacggttaccgtacggttaccctaaccgttacg

SEQ ID NO: 182211 - DNA, 779 bp, Homo sapiens
  misc_feature: GYAE6OF01BHMIU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgacccagtctccagacctccgtggctgtgtctcgtgggcgagacgggccaccgactacgaactcgacaacgtccacgcctagtatttactttttacacgtcctaccaaccaataagtaacttacgttagtcgttaggttaccagaccgtaaacgaaaccgtacggaactacgttaccgtaccgacgtaccgtaccgttcgtccttacgtaacgttttaccggtacgggtaccgttacccggttaaccccgggtaccggttaccccgggtacccgtccggtaaccgttacgttcgtacggtacggccgacgggtccgggtcgtacggggtactacgttaccgtttaccgtaccgttacccgtaccgaacctacgtcccgaaggcccgtaacgtacccgcggacggaccggtactaagggtatacggttgggtacggtaccttttaaggttttactttagttacgggtataaaccggttcttaaaattccttttaagttacccttccgttacccgtaagtaccggttaccgttaccggaaacggttaaccgggtaagtaaacgggttagtaaaacctaccggtaaacgtacggttcggtacgtactccggacttaacccgttg

SEQ ID NO: 182212 - DNA, 787 bp, Homo sapiens
  misc_feature: GYAE6OF01BGTV8.22.14.B03.1.454.CMB.1.raw
  modified_base (391)..(391): a, c, t, g, unknown or other
  misc_feature (391)..(391): n is a, c, g, or t
  modified_base (397)..(397): a, c, t, g, unknown or other
  misc_feature (397)..(397): n is a, c, g, or t
  modified_base (780)..(780): a, c, t, g, unknown or other
  misc_feature (780)..(780): n is a, c, g, or t
tcagacatacgcgtcacgaccggtgctcgatttagtgtgagtagttccggcgggggaggctacaacaggcaggcaggggcagcaagactggtgttgcagacccaggtcttcatttcctctgttcgctcgtggactctcgtggtcgccgtaccggggactattggtgagtacgacccgagtcctccgacgtaccttcccgtggtccgttgtcgtcgtacgtgggacgacggacgggcccaccactaccgaactcgacgtaacgtccgacgacctaaggttacgtttaactttttaccgacgttacctaacctaaccgtaaagttaaggttaacgttacgttacgtcgttcgtaccgagacgaaacgaaacccgagaactactccgttaccgngtaccncgtcgaccttacgtacgtttacccggtggtccggttacccggtaccgggtaccggttcccgggttcctacggtacccgtacgtacgtacggtacggccgacggtaccggggttcgaacggggaccttacgttaccttaccgtcctacccgttccaacctcgtaccgaagccgtacggtatccgggtacgtagtacgtaacggagttacgttcgggtaagtttaccgttaaatttacgggtttacgtacgtacgtaaacggttgttaaaacttccgtttaaacgtcgttaacccgtagtaccgtaaccggttaccggtacggaacccgtaaggtaaccggtaagtacggtaaataaccaacggttcgacgtccgataccgtacncccgtag

SEQ ID NO: 182213 - DNA, 687 bp, Homo sapiens
  misc_feature: GYAE6OF01C69EF.22.14.B03.1.454.CMB.1.raw
  modified_base (115)..(115): a, c, t, g, unknown or other
  misc_feature (115)..(115): n is a, c, g, or t
  modified_base (117)..(117): a, c, t, g, unknown or other
  misc_feature (117)..(117): n is a, c, g, or t
  modified_base (121)..(121): a, c, t, g, unknown or other
  misc_feature (121)..(121): n is a, c, g, or t
  modified_base (125)..(125): a, c, t, g, unknown or other
  misc_feature (125)..(125): n is a, c, g, or t
  modified_base (127)..(127): a, c, t, g, unknown or other
  misc_feature (127)..(127): n is a, c, g, or t
  modified_base (161)..(161): a, c, t, g, unknown or other
  misc_feature (161)..(161): n is a, c, g, or t
  modified_base (301)..(301): a, c, t, g, unknown or other
  misc_feature (301)..(301): n is a, c, g, or t
  modified_base (644)..(644): a, c, t, g, unknown or other
  misc_feature (644)..(644): n is a, c, g, or t
  modified_base (662)..(662): a, c, t, g, unknown or other
  misc_feature (662)..(662): n is a, c, g, or t
  modified_base (669)..(669): a, c, t, g, unknown or other
  misc_feature (669)..(669): n is a, c, g, or t
  modified_base (673)..(673): a, c, t, g, unknown or other
  misc_feature (673)..(673): n is a, c, g, or t
  modified_base (677)..(677): a, c, t, g, unknown or other
  misc_feature (677)..(677): n is a, c, g, or t
  modified_base (679)..(679): a, c, t, g, unknown or other
  misc_feature (679)..(679): n is a, c, g, or t
  modified_base (681)..(682): a, c, t, g, unknown or other
  misc_feature (681)..(682): n is a, c, g, or t
  modified_base (684)..(686): a, c, t, g, unknown or other
  misc_feature (684)..(686): n is a, c, g, or t
tcagacatacgcgtcacgaccggtgctcgatttagtgtgagtagttccgcgggaatttcgcctctgccccggaggttctggtgcgtaactagtgtaccaaaaggagggagatcancnctcnctcncncgcgtacgcgcgacgtacgcgtagtcggagtagnggttacgcgtacgtctactcgtaccgtacgtacgtacgtactacgaacgccgtacgacggaccgacggacgtacgacgtacgtaccgacgtaaccggtaacctaccgaaccacgtacgaggtacctagtaacgtgacgtnacgtagcgtacgatacgtcgtaagacgtagtaccgcgtaacgttacgttacgtagttacgttggtaacgtacggtacgttacggccggtacggtccggtcgggtacccgtacggtcggtaaccggtccgtcgtaaccgtcgtaaccgtccgtacgccgttacggaccacccggtactaccggccgtaccgtccgttaccgccggccgttccggacccgtccgtacgaccgtcgtaccgacgtacggtacaccgcgtaaccgccgtacgccggtaccgcgtcgaccggtgacccgtacgtacgtacgtcctaaggtcgtacgtacggtcgtagcgtcgtacggnggtacgtccgagtcccgngtaccgngtanacgncncnncnnnc

SEQ ID NO: 182214 - DNA, 747 bp, Homo sapiens
  misc_feature: GYAE6OF01E4FQM.22.14.B03.1.454.CMB.1.raw
  modified_base (328)..(328): a, c, t, g, unknown or other
  misc_feature (328)..(328): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggacattgtgatcgacccagtctccagacctcccgtggctgtgtctcgtgggcgaggacgggcccaccatccaactgcaagtccagccagtagtttatttttacacgtcctaccaaccaataacgtagttacttagcttcggtccagacaacgaaaccgaggacactccgtcctgcctacgtntctactacttttaccgtcgggtcccgtaccggtaaccccgggacggtccccggggtacccctcggaacccgtacttcgaggtcggcgacggccgggtcgtacgggactacggttattaccgacctcctaccaaccgacttaccgacgtaccgaccgtccgtacgccgggtaagggtcccgtaaggaacgttacggttggtaccgggtacttttaaggtttttattacggtttacggtacgtaaaccgttaaccttaaagtttaattttacctttacccgttttacccctaccggttaaccgtaaccgggttacccggttaccggggaaacccggtaaacggggtaaacccggtaaaggggtaacgaaaacgttacccggaaacgttaacgttcgggtacgactcgtacccacgtttacg

SEQ ID NO: 182215 - DNA, 853 bp, Homo sapiens
  misc_feature: GYAE6OF01C8JZ4.22.14.B03.1.454.CMB.1.raw
  modified_base (828)..(828): a, c, t, g, unknown or other
  misc_feature (828)..(828): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtgccgtacggggacattgtgatcgacccagtctccagacctccctggctgtgttctcgtgggcgaggacggccaccatcaactcgcaacgtccagaccagtacgtttactttttaacgacgtccttacccaacctaaagtaagtaacgttttaacttacgtacgtttcgttaccgaacgccaaaacggaaaaccgtaggaacctacgttacccggttaccctagaccgtaccgttggacctttcttaacgttttaccggtcggggttacccgtacccgggtaaccccggggaacggttccccgggtaccgtaccggtaccgttacgttccgaacgggtccggacggtcgggtaccgggtacggtacggaccttaaggttaccgttcctaccgtacctaccgaacctacgtaccgacgggtccaccgttacccgtacgaccggtagggttaccgaagggtaacggttacggttggtaaccggtttatttttaaggttttaaccgtttggtttactaaccgttaagtttaacgttaaactttttaccttaaactttaccccttttccgtaccggttaacggttaacccgggtttaacccggtcggggtaaaacccgttaaaccggggaaccggttaaagggttaaaccgtaaaaccggtaaaacctaaacggggttacgttcgggtaacccggtntaaaccccgacgttccgtttaaccg

SEQ ID NO: 182216 - DNA, 873 bp, Homo sapiens
  misc_feature: GYAE6OF01CZ569.22.14.B03.1.454.CMB.1.raw
  modified_base (217)..(217): a, c, t, g, unknown or other
  misc_feature (217)..(217): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacctagtctccagacctcccgtggctgtgtctcgtgggcgaggacggccaccatcaactnacgaacgtccagccaagtagtttactttttacacgtcctaccaacctaaagttaacgagtccttaacttacgtcgtttacgtaccagtacaacgaaaaccgacggtaacctacttcccctccgttaccttaaccttcgtacccttacgtaacgtttttaccgggtacgggttaccggttaccccggtaaaccccggggttaccgggttacccccggggttaccccgttacggaacccggttacgttaaccggtacggggttccggggtaaccggtaccgggggttcccggggttacggttacgggggttaaccgtacgggtttaacctttttaacccgtaaccctttcccgttaacccgtacccgtaaacttcccgtaacggtaccccgtaccggtcccggttacgaacccggtagggtaccgttaggtaaacggttagttccgggtaaggttaccttacggtttttaacggttaaccgtcggtaacgtaaccgtaccttaaagggtttttaacttaaccttttaccttacccggttacccttaggtaccggtttacccggttacccggaaacgggtaaacgggtaaccgttaaagggtaagttaaaccgaccgaaacggttacgtacggtacgtacgttaccacgttaccgtacg

SEQ ID NO: 182217 - DNA, 713 bp, Homo sapiens
  misc_feature: GYAE6OF01CU4M1.22.14.B03.1.454.CMB.1.raw
tcagacatacgcgtcacgaccggtgctcgatttagtgtgagtagttccgcgggggagctacaacaggcaggcaggggcagcaagatggtgttagcagacccaggtcttcatttctctgttgctctggatctctggtgccgtacggggacattgtgatgacccagtctccagacctccctggctgtgtctcgtgggcgaggagggccaccatcaactgcaagtccagccagtagttactttttacagctaccaacaaataagtaacgtttacttagtccgttggttaccagacaacgaaaccaggacactccgtcctgcactcgctactatttacgtcgggtccgtaccgtacccgggaacgtccccgggtacctccgaccgtacgttacgaggtcggcgtacgggtcgggtccgtagggacgtagtactttaccgacttaccgtccaaccctactaccgacgtaccgaaccgtccgtcgacgtaacgggtctaggaaacgtaggttcggtaggtactttaaggtttatttacgttagtaacctaggtaaccttaatttacgtttaacttaccgttaccccttacgttaccgtaacggggttacccgttaccgggaacccgggtaaacggtaaaccggttaaagggaaacggtaaactaaacccgggtaaaacgtagtacgggtacgtccggtaacgtaaccctaacggttacg

SEQ ID NO: 182218 - DNA, 694 bp, Homo sapiens
  misc_feature: GYAE6OF01A75Q4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagtagttatttttacagctccaccaataagagttacttagcttggttccagcaagaaaccaggacatcgtcctgcactgctctatttacgtgggcgtaccgtacccgggtaagttcccggggtaccctggacccgtattccgaggtcggcgacggtcgggtctaggggactaggtactttccgactctcaacctatcagacacggcctgccgaaggctaggaagactggtacgacttaagttttatagtttcgggtctaaggtacttaaacgtttactttaaacgttaccttttccccgtaccgttacgtaaccgggttaacccggttttacccggggaaccccggttaaaacgggggtaaccccgaaacggggtttaaacgggtaaaacgtttaaacccggaaaaaccgttaaccggtttacgggtaacccgggtacttaccgggtaacccctaaacccggttaaccgg

SEQ ID NO: 182219 - DNA, 736 bp, Homo sapiens
  misc_feature: GYAE6OF01CWYYW.22.14.B03.1.454.CMB.1.raw
tcagacatacgcgtcacgaccggtgctcgatttagtgtgagtagttccggcgggggagctacaacaggcaggcaggggcagcaagatggtgttgcagacccaggtcttcatttctctgttgctctggatctcgtggcgaccgtacggggatattgtagatcgacccgagtcctccagccctccgtggctgtcgtcgtcgtgggcgaggcggacccaccatacactgactaacgtccacgccgaagttagtttattttaacgacgtcctaccaaacaaattaagtaagttaccgttagtcgttacggtacaagacgaaacgtaaacgacggtacctacgtccgtacctgtaccacggttctacccttacgttaacgtttacgggaccgggtacccggttaacccggtaaccccggggtaaccggttccccgggtacgtaccggaccgtaagttccggagggtacggacgacgggttaccgggtcgttacgggacttagttaccttacgaaccgttccacgtacccgtacgtacgaacgtcgaaccggtcgtagaccggtaggtacgtaggaagtacgttcgagttacgttagtttactacgtgaactagtactaagttcttactcttaccgacgtacgtaacggttaccgacggaaccggttaaacgaacgggttacgaaacgttaaaccacggtaaaccgtacggtacggtaacgtccgaactacgtacctaccgg

SEQ ID NO: 182220 - DNA, 645 bp, Homo sapiens
  misc_feature: GYAE6OF01CHWGG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatccaactgacaagtccagaccagtagttatttttacagctaccaactaataagattactagtcttggttccagcaagaaccaggacatccgtcctgcactcgctactactttacgtgggtccgtaccgtacccgggtaacgttcccggggtccctacgaccgtacttacgtaagtcggaccgtaaggccgggtcgtacgggaccgtagtactttaccacttcctaccaccctattccaggaccaaggccctcgacgacggtcgtaaggaagtacgttggtcggtactttagtttttacgtagtttacgcgtaacggtactaaattatttaccgttacttccccgtcttacgtacggttaccgtccggaaccgtaaagggtacccaagggttaacgtaactaccgaaaacgtacgtcggtacgactaccggctacgtacg

SEQ ID NO: 182221 - DNA, 791 bp, Homo sapiens
  misc_feature: GYAE6OF01BG6UA.22.14.B03.1.454.CMB.1.raw
  modified_base (291)..(291): a, c, t, g, unknown or other
  misc_feature (291)..(291): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctggtgccgtacgggacattgtgatgacccagtctccagactccctggctgtgtctcgtgggcgagaggccacatcaactgcaagtcagcagagtattttacagctaccacaataagagttactagcttgttaccagcgacgaaccaggactatcgtacctnactacgtcgtcttactactttaacgtcgggtacccgtacccgtacccggggtaacgttccccggggtacccctcggtaaccgtacgttccgaaggtcggacgacgggtaccggggttacgacgggtacgtaagttacgtttaccgacgttaccctacgaacccgtaacgtaccgtaacgcgtaaaccggtccccgtaggaacccgaaggtaccgtaacgtaacggttatacggttaccgggttaccttaaggtttttaacgttacgtttacgtacgtaaaccggttaactttaaagttaaccgttttaacttaacccgttttaccccgttccgtttaaaccgtaaccgggtttaacccgggttaaccgggtaaaccccggtaaaacggggttaaccccggtaaaagggtaaacgggttaaaacccttaacccgggttaaaaaccgtaccgttacggggtaaccggttcccgttaaccggtaaccctaacccgggtttaac

SEQ ID NO: 182222 - DNA, 700 bp, Homo sapiens
  misc_feature: GYAE6OF01A5LBP.22.14.B03.1.454.CMB.1.raw
  modified_base (198)..(198): a, c, t, g, unknown or other
  misc_feature (198)..(198): n is a, c, g, or t
  modified_base (322)..(322): a, c, t, g, unknown or other
  misc_feature (322)..(322): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagngggccaccatcaactgcaagtccacgccagtagttatttttacagtcctaccgaacctaataagtagtttacttaagtcgtttggttaccagcaagaaaccaggactactcgtacctgcacgtnctactagtttacgcggtcgttaccgtacccggaacgttcccggggtccctacggaccgcttcgagtcggacgacggtcgggtacgtcgggacctaggttactttccacgttcttaccgaaccgtactacgacgtaccgacgtacccgttcggaacgtacgggtacctaaggtaacgttaggttacgtcgggtaacctttaagggttttaactttagtttacggtacgtaagttaaccgtaaatttacgtttaacttaactttccccgttaccgtacgttaaccggtacccggttttaccggaaccccggtaaacgggtaaccgtaagggtaacgtaaacgttaccgaaacgtacgtagtcgacgtcgactacccgtag

SEQ ID NO: 182223 - DNA, 772 bp, Homo sapiens
  misc_feature: GYAE6OF01EIF0G.22.14.B03.1.454.CMB.1.raw
  modified_base (516)..(516): a, c, t, g, unknown or other
  misc_feature (516)..(516): n is a, c, g, or t
tcagacatacgcgtcacgaccggtgctcgatttagtgtgagtagttccgcgggggagctacaacaggcaggcaggggcagcaagatggtgttggcagacccaggtcttcatttctctgttgctctggatctctggtcgaccgtacggggactagttggtacgagtcgaccctagtcctaccgacgtaccttcccgtggctggtcgttcgtcggtgggacgacggaccgggcccaaccgtactaccgtaacgtcgaccgtaacgtccgacgaccgtaagttacgttttacttttacgacgtaccctaccgaaactaagtaacgtacgtttaacgttacgtcgttacggtacacgtacaacgaaaccgacgaactcgtaccgtctgtacctacgtcgacttacttacgttacggtcggtacccgttaccgggtaccccgggtaacgtccccggggtcgacgtaccgtcttacggcggtcgacggtcggtccgggtagaccgtacgtcgtttctacccngttaccgctaccgtacgacgacggactacgcccgtgacgtacggtactaaggtaactcggttagttacgggtaccttttaaggtttacgttaggttaccgtaagggttacctaattaaacgttttacgtttaacctcccggttcccccttaaggtccggtaccgttaaccgtcccggggaaacgtacgggtaactaacgggtaaggtaacctaacgaacggtaccggttcgaaggtcccctaagtcgtccgttacg

SEQ ID NO: 182224 - DNA, 711 bp, Homo sapiens
  misc_feature: GYAE6OF01DI0N3.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgcaagtccagccagtagttatttttacagctccaacaataagagttacttagtctttcggttaccagacaagaaaccaggacatcgtcctgcactgcctctatttacgtgggtccgtaccgtacccgggtaacgtcccggggtccctacgaccgtattcaggtcggcgacggtcgggtcgtaggggacctagtactttacgacctctccgaacctactccgaacgcgtaccgtccgtggacgaggtccgttaaggaaagtggttggtacgggtactttagttttaacgtttgttacgtacgtagtaaaccttaatttaactttaacgttcccttttacccctacgttaaccgtaacgggttaacccggttccgggaaacccggtaaacggggtaaacccgttaaaaggggtaaccgttaaaaaccgttaaacccggtaaaaccgggttacgttcgggttaacgggtaccctttaacggaccccgttaaactaaccgg

SEQ ID NO: 182225 - DNA, 688 bp, Homo sapiens
  misc_feature: GYAE6OF01DRZ6M.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtccggggacatcgtgatgacccagtctccagactccctggctgtgtctcgtgggcgaggacgggccacatcaactgcaacgtccagaccagtagttatttttacagtctaccaaccaataagacgtacttacttagtcgtttacggttaccagacaacgaaaccaggactactcctccttactactctcctactactttacgtagggtaccgttaccgtaaccgggtaacgtcccggggtcctacgaccgtatacgtaggtcggacgtacggtccggggtacgtagggaacctaggttacttacgactcctacaaccgacttacgacgacgacgtcctacgtacgaggtcctaagtaagagttggaggtacttaagtttacttacgtacgtacacgtaacgtaattaacgttaacttaacgtttccctaccttacggaaccggttaccggttaccggaaaccggaaacgggtaaccgaaagggttaacgtaaaaccgtacgaaaaaccggttacgttagggacgtaccgtaggaccctaacggttaacc

SEQ ID NO: 182226 - DNA, 899 bp, Homo sapiens
  misc_feature: GYAE6OF01CNCE5.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctcgtggcgagacgggccaccatcaactcgacaacgtccagccagtagtttactttttacacgtccttacccaacctaaagtaaagtaacgtttaaccgtttacggtccgtttacgggtttacccaggtaaccaaccggaaaacccgtacgggaacctaacggttccccgttccgttacggaccttaaccgttcggtacccttacgttaatttttaacccgggtcggggtaacccgggttacccggtaaaccccggggtaaaccgggttttcccccgggggtaccccgttacggtaaccccgttaacgtttacccgtaacggggttccggtaccggtacgggtccggggttaccgtaacgggggtaccttaacgggttaacctttttcccgaaacccggttcttaccccgaaaaccgttcgtaccgaacggtccaacccggttcgacggtacgtacgggtaccgtagggaacgtacggtggtcggtaacgtttagttttacgttaacgtcggttacaaacggttactaaagttttacgtttaacgttacctttaccccgttcccgttaacggtaccgggttaacccggttccccggggtaaaccggtaaaaccggggtaaccccggttagggttaaaacgggttaaaaccctaacggtaaaacccgtttacgggtacgtttacgggtaacctaaccgggccccttaacggttacgg

SEQ ID NO: 182227 - DNA, 714 bp, Homo sapiens
  misc_feature: GYAE6OF01AQRJK.22.14.B03.1.454.CMB.1.raw
  modified_base (697)..(697): a, c, t, g, unknown or other
  misc_feature (697)..(697): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggaggccacatcaactgcaagtccagcccagtagtttatttttacacgtctaccaaccaaataacgtacgtttacgttagctttacggttccagacgaagaaaccgaggaacatccgtacctgactactcgtcctactatttacgtgggtcctaccggttacccggacgtacccgggtcccgtacggtacgtacgttaccgaggttcggaccgaggtcgggtaccggtacgggacgtacgtacgtttaccgacttcccgtacacccgtacgttacaaccgggtctccggtacccttcggaccgtaggtacccgtaggtaaacggtaggttacggtaccggtaagttacgttttaagtttaccggtttagtaccaacggttaataacgtttaaacttaatttcccgttacttccctagtaaccggtacgtaccggtaacccgaagggtaaccgaacggtaacgtaaacgaaccgttaaaacggaccttacgggacgttaccncgtaacccgtcttaacg

SEQ ID NO: 182228 - DNA, 734 bp, Homo sapiens
  misc_feature: GYAE6OF01AIZ56.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgaccagtctccagactcctggctgtgtctcgtgggcgaggacggccaccactaccaacgtgactacgtccgacgaccgagtacgtttactttttacgacgtacctaccaacctaaagttaaggtaacgtttacttacggtccgtttacggttaccgagtaccaacgaaaccgtaggaacctacgtccgtaccgtacggtacctacgtcgtactactacgtttacggtcgggtacctaccggtaacccgggtacgtcccgggttacctacggtaccgtagtcgaggtacgcgtacggtcggtgtacggtactacgttattaccgactacgtacaacgtactacgtacaccgtacgccgtcgacgtacgtacgtagaagttcgtacgtacgtagtttacgtttattacgtcggtacaagtacttaagtttaacttacgtttaccttacccggtacctaacgtaccggttaccggtttaacggacccggttaaagggtaacccgtaaagggtaacgtaaaacgttaccggtaaacccgttagtaccgggtacggtacctcggtaacctaaccgttaccgg

SEQ ID NO: 182229 - DNA, 781 bp, Homo sapiens
  misc_feature: GYAE6OF01D3P0D.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggtctgtgtctcgtgggcgaggacgggccaccataccaactgacaacgtccacgccgaagtagtttactttttacgacgtcctaccaacctaataacgtagtttacttagtcgttcgttccagaccgaacgtaaaccaggactacgtccgtccgtgtaccgactcgtccttcgttaacgttttaccggtcgggtccgtaccggttacccggggtaaccggttcccggggtccgtacggtacccgtacgttccggtacggtcggaccgtacgggtccgggttcgggtcgggaacgtagttacgttttaccgtaccgttccgtaccctaactcgttaccgcgtaccgtaacgtccccggtacggacgtacgggtacgtaacggtaaggtagttacgggtcgggttaaccttttaaggtttttacgtttagtttacggtccgtaaagtactttaaagtttaactttaacctttacccgtttcccttaccgttacgaaccgggtttcgtacccgggaacgtaaacccggggttactaaaggggtaacgtaacgtaaaaccgaaccggttacgttacgggacggttacgtaccgtacccagtttacccg

SEQ ID NO: 182230 - DNA, 652 bp, Homo sapiens
  misc_feature: GYAE6OF01A27O3.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctctgggcgaggacgggccaccatcaactgacaagtccagccagtagtttatttttacagctaccaaccaataaggatttaacttagcttggttccagacaagaaaccaggactatcgtcctgcactgctctattactgggctaccgtacccgggaactcccgggtcctcgaccgtatacgaggtcggcacggtcgggtcgtacggggactacggttactttccgacttaccgtacgaacctacttaccgaacggtacccacgtaccccgtagccggaacggtcctaagggaactcgtgggtacgtactttaaggtttaacttagttcgacaagttacctaaatttaaccttattcccttaccgtaccttacggagtttaacccggttccggaaccggtaacgggtaaccgtaagggtaaacggaactaaccgaaacgtagtcggacgtactacgcccaacgttacg

SEQ ID NO: 182231 - DNA, 852 bp, Homo sapiens
  misc_feature: GYAE6OF01EUQ45.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacgggcattgtgatcgacccagtcctccagacctcctggctgtgtctcgtggcgagacggccaccatacaactgacacgtccacgaccgagtagtttactttttacgacgtacctacccgaacctaaataacggacgtaccttacgttaacgtccgttacggttaccaagtacgaaaccgaaaccgaacggtacctaccttccccgttacccttccttacgtcgtccttaccttacgttttacgtccgggtccgtaccccggtaacccgggtacgttccccggggtaccctaccggtaaccgtcgttacggacgtcggaccgtacggtccggggttcgtagggactaagttaccttacgtaccttcctacctaccgacttcgaacggccgtacgtccccgtaggaccgtacgggtacctaagggtaagacggtttagggtacggttacgttttaaacggttttaaccttagttaccggtattaaccggtaaaccttaagttttaacctttaccgttttaacccgttacccgttacccgttaaccggttacgtttaacccccggggtttacccgggaaaccggttaaacccgggggttaaaacccggaaaggggtttaaacccgtaaaacggttaaccccgggtaaaaacgttaccgggttacgggttacccgggtaacccgttaaacccgtcccgttaaaaccgttcccgg

SEQ ID NO: 182232 - DNA, 720 bp, Homo sapiens
  misc_feature: GYAE6OF01BQCHU.22.14.B03.1.454.CMB.1.raw
  modified_base (631)..(631): a, c, t, g, unknown or other
  misc_feature (631)..(631): n is a, c, g, or t
tcagacatacgcgtcacgaccggtgctcgatttagtgtgagtagttccgcgggggagctacaacaggcaggcaggggcagcaagatggtgttggcaagacccaggtcttcatttctctgttgctctggatctctggtgccgtacggggacattggtgactcgaccagtcctccaagcctcccgtggtctgtgtcttacggcgggcgaggacgggccaaccataccaacgtgacgaacgtccgagactagtattttaacttttacgacgttcctaccaacgtaaataaggttacgttaacgttcgtcgtttcggttacccagacctaaacggaaaccgtaggtaaacctcgttaccgttccacgactaccgtctacttctaacgtttcggtccgggtaccgtacccgggtaacccgggttaccgtcccgggtaccctacggtaacccgtcgtaacgtggcgggtaactcgggtcggtcgtagggaacctacgttacgttccaacttcaacccgtacgtactaccacggccgtaaccgtcggtcgacgggactaccgggagtaacggtgttcgtagtttaccgttagtttatagtacgtcgtactaaatacgtttataacctttccgttaccncgttacgaaccgtacgggtacccgaagtacggaacgtaacgtaactaacggtacctaaacggtggtcgtaacggtccacgactacttcg

SEQ ID NO: 182233 - DNA, 863 bp, Homo sapiens
  misc_feature: GYAE6OF01EX3HQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggggacattgtgatcgaccctagtctccacgactccctggctgtgtctcgtgggcgaggacgggcccaaccgataccaacgtcgactaacgtccagccagtagttatttttacgagtcctaccaaccaaagtaagtagtttaccttagtccgtttcggttaccagtacgaaacgtaaaccgacggaactacgttccgtccgtcgtaccgtaacgtcgtaccgtaccttaacgtttttacgggtacggggttcccggttaaccccgggtaaccccggggtaaacccgggtttccccgggggttacccctaacgggtacccgtaacgtttaccggacggggtttacggaccggtacggggtccgggggttaccgggtaacggggtaacctacgggtttaaactttcccggaactttacccgtaaccccgtaccttaaccgttacccgacggtacccgtacgtacccgtacggccgtaaccggtacggtacgtaaacgtcgtacggggtacgtaccgttttaagtttttaacgtttcgtacggtaaccgtaagttaaccgtaatttacgtttaactttacccgtttacccggttcctaacggtaaaccgttaccgggttaacccggaaccggtaaaacggggtacccggtaacgggtaacggtaaaaccgtaaccgaaaacggttacgtaccggtcggttacgtacggaacctacgttaacccg

SEQ ID NO: 182234 - DNA, 765 bp, Homo sapiens
  misc_feature: GYAE6OF01BNCK8.22.14.B03.1.454.CMB.1.raw
  modified_base (742)..(742): a, c, t, g, unknown or other
  misc_feature (742)..(742): n is a, c, g, or t
tcagacatacgcgtcacgaccggtgctcgatttagtgtgagtagttccggtcgggggagctacaacaggcaggcaggggcagcaagatggtgttgcagacccaggtcttcatttctctgttgctctggatctcgtggtcgaccggtacggggactagtttggtagtacgtcggaccctacgttccgttaccacggtacctcccgtggtccttggttcgtcctcggtcgggcggacggaccgggccaaccgtatacgaacgtcgacctaacgtccacgacctaaggttacgtttactttttaccgacgtccctaaccaactaaataacgtacgttaccgttacgtcgttacggtaccagacgtaacggtaaccgacggactcttaccgtacgtcgactaccgtgtccttacgttaccgttaccgggtcggtacccgttaccggtaacccggtaccggttcccggtacccgcggtaaccgtcgtcggtaggtcggtacgtacgggtcggttccggacgtaccgagttactccgtacgtactaccgaactacctacgcgacggtaactcgagacggacgttagaacggtagtacgtcggttagttacttacggttttattagtcgtaacgtaccgttatttacgttaaacttccgtttaactaccgttacggtacggtaccgttacgggtaacccagggttaaccggacgtaacggtataacccgagtaaccggtgtacccggtntacccgtacgttctccgttaccg

SEQ ID NO: 182235 - DNA, 860 bp, Homo sapiens
  misc_feature: GYAE6OF01AXDBO.22.14.B03.1.454.CMB.1.raw
tcagacatacgcgtcacgaccggtgctcgatttagtgtgagtagttccgcgggggagctacaacaggcaggcaggggcagcaagatggtgttgcacgacccaggtcttcatttctctgttgctctggatctctggtgccgtacggggacattgtgatcgacccagtctccagacctcccgtggctgtcgtctcgtgggcgaggacggccaccactcaacgtgctaacgtccacgccagtagtttactttttacacgtcctaccaactaaataacgtagtttaacttacgtcgtttcgttacccagacgaacgaaaccgaggacctacgtccgtccgtcgacctacgttcgtccttacgttacgtttaccggtcggggtaccgttaccccgggtaaccccggggttaccgggttccccggggtaccccgttacgggtaaacccggttaagtttaaaccgggtcgggaccggtacggggtccggggttacggtacggggtaaccgttaacgtttaccgttttaccgtacccttacccgtacccgtaacccgtacgttacccgaacggtcccgaacccggttcccggttacgacccggtacggtaaccgttaaaggaacgttaggttcgggttagttaacgttttaaggtttttaacgtttaacgttaccggtaacgttaacgtaaatttaaccgttttaaactttctttaaccccttttacccgttaccgttaaccggttaccggtttacccgggttaccggtaacccgggtaaacgggttaaaccggtaaagggtaacgttaacgaaacccgtaacggtacggttcggtacggtaccctagaacccgttacgtccgttccg

SEQ ID NO: 182236 - DNA, 610 bp, Homo sapiens
  misc_feature: GYAE6OF01A1KA0.22.14.B03.1.454.CMB.1.raw
  modified_base (600)..(600): a, c, t, g, unknown or other
  misc_feature (600)..(600): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagctccctggctgtgtctctgggcgagacgggccaccatcaactgcaagtccagccagagttatttttacagcctccaaccaataagacgttacttagtcttggttccaagcaacgaaaccgtaggaacatccgtaccttgcctactcgtactctagtttactcgggtctaccggtaacccgggtaagtcccgggtcctcgaccgtagtcagtcggtacacgggcgggtcgtcgggacagttattaccactcgtacaccgtatacgacgcacgcctgtacgacgtcagagtagtcggtacgtacgttagtttaacttagtttcgtacgtaaggtactaaagttattaacgtttcttaccgtcctacgtacgtaccgggttaccgaacggaacggtaaccgtaaggtacgaaactacgaaacgacgtggtacgntacgatcgta

SEQ ID NO: 182237 - DNA, 826 bp, Homo sapiens
  misc_feature: GYAE6OF01CLL8R.22.14.B03.1.454.CMB.1.raw
tcagacatacgcgtcacgaccggtgctcgatttagtgtgagtagttccgcgggggagctacaacaggcaggcaggggcagcaagatggtgttgcacgacccaggtcttctatttctctgttgctctggatctcgtggtgccgtacgggatattgtgatcgacccagtcctcagacctcccgtggctgtcgtctcgtgggacgagaggccaacatacaacgtgacaacgtccagtaccgaagtagtttaacttttacgacgtcctaccaaacctaaagtaagtaagtttacctagtacgttcgtaaccacgacgaaacgaaaccgaaggtacaactccgtacctacggactactcgtactacgtacgtttaacggcgggtacccgttacccggtaacccgggttaaccggttccccgggggtaccctaacggaaccgttaccgtttagggaacgggtaccgtacggaacggttacggggtcggtaacggggtaacctaaaggtttcgtttaacccaaccttaccggtaaccctaaaccctaacgtacgaacggtccgaaaccgtcccgttacggaaacgtaacgggtctaaacgggtaaaggtaccgttacgggtaacgttaattaagtttttaacttaaggtttgaaacgtacgtaaactaaaacgttttacctttaatccctttaaccgtcctaacggaacggttaaccggttaccgggaaccggttaaaagggaaacccggttaaaggaaaacggtaaactaaaacccgggtaaaacgtaaaccgtttcggacggttaacccgaactcccgtaaaccgttacgg

SEQ ID NO: 182238 - DNA, 751 bp, Homo sapiens
  misc_feature: GYAE6OF01CZ1AL.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgagacggccaccatacaactgcaacgtccagccagtagtttatttttacagtcctaccaacaaataagtagtttaaccttagtaccgttggttaccagtacaacgaaaccgaacggactacgtccggtcctgcacttcgctactagtttacgtcgggtacgtccggtaccccgggtaacggtccccgggtcctacggaccgtgttcgaggtcggcgacgggtcgggtcgtacggacgtagttacttacctacgtcctacgacctacgtcgacgaccgcgtaccccgtgaccggtagtaccgaagaagtacgttcgggtacgttacgtttaaggttttactttaaggtcgttaaccgaaggttaactttaactttaaactttcctttaaccttttaccccgtaccggttaccgttaacggggttaacccggttaccgggaaaccggttaaaccggggtaaccggttaaacggttaaagggtaaacccgtaaacggttaaaacccggtaggttaccgggtaccgacgggtttacccaaccgtaaccctttaaccggg

SEQ ID NO: 182239 - DNA, 898 bp, Homo sapiens
  misc_feature: GYAE6OF01EIM1H.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactagttgtgatcgacccagtctccagacctcccgtggctgtgtctcgtgggcgaggacggccaccatacaacgtgactaacgtccacgccgagtacgtttactttttacgacgtcctaccaacctaaagttaacggtacgtttacgttacgtcgtttcggttaccaacgtaccgaaacgaaaccgtacggaactacgttccgtccgtcgaccctacgtcgtaccgttacttaacgttttaccggtccgggtacccggttaacccgggtaaccccggggtaaccgggttcccccggggttaccctaccggtaaccgtacgttacgacgggtaccggtacggtaccgggtccggggttacggtacgggtaaccgtacgtttaccgttaccgtacccgtttccgtaaccctaacctaccgtacccgacgtaccgtacccggttcccgtacgggtaccggtacgggtaaccgtaacgggttaaacggttagggtttaccgggtaacggttttaaccgggtttttaagtttttaacggtttactttaaccgggtaacgtaacggttaactttaaccgtttaatttaacccgttttcccttaacccggttaccgttaccggtaaccgggttacccggttaacccgggaaaccggtaaccggggtaaaccggttaaaggggtaaccggtaaaaccgtaaaccggtaaaacccggttcgttaacgggtacggttacctcgtaaacccgttgttaacccg

SEQ ID NO: 182240 - DNA, 714 bp, Homo sapiens
  misc_feature: GYAE6OF01ALX80.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtcctccacgacctcccgtggctgtcgtctcgtgggcgaggacgggccaccatacaactgcgaacgtccacgccagtagtttatttttacacgctaccaaccaaattaagagtttactacgtcttcggttaccagacaacgaaccgaggactacgtccgtcctcgccactcgtcttactacgtttacgtgggtccgtccgtaacccgggtacggttcccgggtcctacggaccgtacgttacgaggtcggacgtacgggtcgggttccgtagggacgtagttacgtttacccactaccgtccaaccgtactacgacgccgacgtcccgtaggccgacgggtacacggtaagtcgtaggtcgggtaactttaagtttttagttaccgttggttacgaacgttaacttaagtttaactttactttaacctttccccgtaccgttaacggtacggtacccggttacccgggaaaccgtaaaccggggtaaccgtaagggttaaccggaaacttaaccggaaacgttacggtcggacgtagccgaccgtacctacg

SEQ ID NO: 182241 - DNA, 668 bp, Homo sapiens
  misc_feature: GYAE6OF01BX9VZ.22.14.B03.1.454.CMB.1.raw
  modified_base (451)..(451): a, c, t, g, unknown or other
  misc_feature (451)..(451): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctcagactcctggctgtgtctcgtgggcgagagggccaccatacaactgacaacgtccagccagtagttatttttacacgctaccaacctaataagagttacttagtcttacggttaccagacaacgaaaccgaggacatcgtactcgcactcgtctactattacgtcgggtcgtaccgtaccgggaacgtcccgggtccgtagaccgtacgttacgaggtcggtacgacggtccgggtcgcggggactagtacttctactctacgaacctgtacagcacgctacgngtacggacctaggaacgtcgtggtacggtacttaaggttttacttagtttcgtacgtaacgtactaaacgttactttaacgtttaaccttccccttacgtaccgttaacgggtaccggttaaccgggaccgtaaaagggaacccgttaagggtaacggtaaaacacccgggtaaaaggtaaccgttaggtaccggacttaccgtactaaccttacgg

SEQ ID NO: 182242 - DNA, 878 bp, Homo sapiens
  misc_feature: GYAE6OF01AYAHG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgtgctctggatctctggtgccgtacggggactattgtgatgaccagtctccagacctccgtggctgtcgtcgtcgtgggcgagacgggccaccgactcaactcgacaacgtccacgccacgtagtttaactttttacgagtcctaccaacctaaataacgtaacgtttacgttacgtacgttcggttacgaacgactaacggaaaccgacggtaacctaacgtccggtaccgtacgtaccgactcgtaccgtactacggtttacgtcgggtaccgtacccggtaacccgggtaccggttacccgggtacccgtacggtaaccgtacgttacgacggttcggacgtacgggtcgggttacggtacggggtaactacggttacttaccgtacttacctaaccggaacctacgtacggacgtaaccggtccgtaacccgttacggaccgtaaccggttacggtaacgttaaacgggtagttaccgggtacgggtaaccgttttaagttttaaccgttaagtttcgtaaaccggtaacgtttaaacccgtttaaaatttacccggtttaaactttacccggtttacccttaaccgcccggttaaaacggggttaccccggtttaaggggaaaaccccggttaaaacggggtaaaccgggttaaaacgggtaaacgttaaaaaacccggtaaacccgtaaaaaccggggttaacccgttaggggttaacccgaaccgggtaacctaacccggttaacccgttaaccg

SEQ ID NO: 182243 - DNA, 645 bp, Homo sapiens
  misc_feature: GYAE6OF01DRZKH.22.14.B03.1.454.CMB.1.raw
  modified_base (127)..(127): a, c, t, g, unknown or other
  misc_feature (127)..(127): n is a, c, g, or t
  modified_base (630)..(630): a, c, t, g, unknown or other
  misc_feature (630)..(630): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggntctctggtgccgtacggggacattgtgatcgacccagtctccagacctccctggctgtgtctcgtgggcgaggacgggcccaccatcaactgacaagtccagccagtagtttatttttacacgcctaccaacctaaataagtagtttaacttagtctttcggttaccagacaaacgaaaccaggactactcgtcctgaccactgtcctactacgtttacgtcgggtccgtaccgtacccgggtaacgtcccgggtccctacggaccgtagttcgaggtcggcgtacggtccgggtgtacgggactagtacttccacctctaccgactctaccacgctacgcctagcgagtctaaggaagtgtcgtaggtacttagttttatgttcgactagtaacttaattactttactccttccctcgtacgtacggtaccggtaccggaaccgtaaacgggaaccgttaagggtaagtaaacctaaccgtaaacggtacgttgggaacgtntaccgccctactacg

SEQ ID NO: 182244 - DNA, 676 bp, Homo sapiens
  misc_feature: GYAE6OF01BC5Q1.22.14.B03.1.454.CMB.1.raw
  modified_base (464)..(464): a, c, t, g, unknown or other
  misc_feature (464)..(464): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgccgtacggggactattgtgatcgacccagtctccagacctcccgtggctgtgtctcgtgggcgaggacgggcccaccataccaactgacaacgtccacgccagtagtttatttttacgacgtcctaccaacctaagtaagtacgtttacttacgtcgtttcggtaccagacgaacgaaaccgaggacctagtccgtcctgaccactcgtctactacgtttacggcgggtaccgtacccggtaacccggggtaccggttcccggggtccctacggaccgtacgttcgaggtcggtcgagggtccgggtcgtagggactagtacttacnctactacacctactccgacggtaccacgtccgtaggaccagggtacgtaaggaagtcgttagggtcgtagtttaagtttacttacggttcgtaacgtaacgtaacttaatttaattcttaacgttccctacgtacgtacgttcggtaccgaaccggtaacgggacgtaaggtacgaaacgtaccgaaagtcgtaggtcgactcgcctaatcg

SEQ ID NO: 182245 - DNA, 719 bp, Homo sapiens
  misc_feature: GYAE6OF01CU8PN.22.14.B03.1.454.CMB.1.raw
  modified_base (523)..(523): a, c, t, g, unknown or other
  misc_feature (523)..(523): n is a, c, g, or t
  modified_base (541)..(541): a, c, t, g, unknown or other
  misc_feature (541)..(541): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactagttgtgatcgacccagtctccacgacctcccgtgctgtcgtctcgtgggcgaggacggccaccagtacaactgacgaacgtaccacgaccagttagtttaactttttacgacgtcctaccaaccgtaaagttaagtaacgtttaacgttacgttaccgttacggttaccaacgtaccgaacgtaaaccgaggaacctacgtccggtacctgtacctacgtcgtaccgtacttacgtttacggtcgggtacccggtacccgtaacccgggtacggtccccgggtacccgttacgaccgtacgttcgaggtcgacggtaggtccggtacgtacgggactaacgtcgttacctacctcgtaccactacaccgtacncgtcgcgtgacgtacggngtaacgagtgtcgtagacgtttagttattacgtcggtataacgtattaagttacgttacttaccttccgtacctaggtaaccgttcggaacccgggtacgtaaaccgggaccgtaagtaaacggtaaacctaacggtaaaccgtagttacggacggtactaccgacgtcccgttaacg

SEQ ID NO: 182246 - DNA, 792 bp, Homo sapiens
  misc_feature: GYAE6OF01B3E87.22.14.B03.1.454.CMB.1.raw
  modified_base (597)..(597): a, c, t, g, unknown or other
  misc_feature (597)..(597): n is a, c, g, or t
tcagacatacgcgtcacgaccggtgctcgatttagtgtgagtagttccgcgggggagctacaacaggcaggcaggggcagcaagatggtgttgcagacccaggtcttcatttcctctgttgctctggatctctggtgccgtacggggactattgtgatcgacccagtcctccgagtacctccccgtggccttagtcgttactcggtcgggcgaacggaccgggacccaaccacttacaacgttcggacaacgtccacgtaccgaagttacgtttacttttttacgacgtcctaccgtaaccgtaaagttaacgttaacgttttaccgttaagttccgtttacggttaccaacgacgaaacgaaaccgacggacctacgtccgtcctacgtacctacgttcgacttacgtactttcgggtcggtaccgtaccggtaccgggtacggtcccgggtcacggtactgtcgtacgcggtacgcggtcgggtacggtcgggaatacggttaccgttaccacgtcttaccgattaaccgcgtacgacgtacggccctaggcgtaagaccgtaaggacgttcgtaggtccgtaagttttaggttntttaacggttcgagtaaacgttaacttaactttagttaaacccttaccctttcccgtaaccccggttaacgacggggttaccggttaacccgggaaacccgggtaaaggggtaccccgtaaagggtaaggttaaacccccggaagaaaaccggtttcgggtaccggtacggacctttagaaaccccgtccgttcg

SEQ ID NO: 182247 - DNA, 933 bp, Homo sapiens
  misc_feature: GYAE6OF01B1LWH.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccgtggctgtgtctcgtggcgagaggccaccatcaactgacaacgtaccacgaccaagtagttaactttttacgacgtcctaccaaccaaagttaaagtaacgtttaacttaagtccgtttacggttaccgaacgtacgaaacgaaaaccggaaggaacctaacgttaccggtaccgttacggacctaaccgtcgtacctttaccgtaacgtttttaaccggtcgggtccgttacccgggttaaccccgggtaaaccggtttccccggggtaccccgttacggtaacccgttacgtttaccgtaaacgggttccgggacgtaacgggtccgggttacggtacggggtaaaccgtaggttaacgtttacccgtaaccttaccgtttaccgaacccacgttaaccgaccgtacgaacgttacccgttacgaccgggacggttaacggtaacggtaaaacggttacggttacgtaaccgggtttacgtttaagttttttaaaccgtttaaagtttcggggtttaaacctaacggtaaaccgttaaacgtttaaatttaacctttttaccgtttaaccccttacccgtttaaaccgggtaaaccggtttaaccccggggtttaaaccggaaacccgggttaaaaccggggtaaccggttaaaaccgggttaaggtaaaaaaccgttaaacccggtaaaaaccggttaaaccggtttacgggtacggtaaccgtttaccggaaaacgttacccccgtttaaacg

SEQ ID NO: 182248 - DNA, 423 bp, Homo sapiens
  misc_feature: GYAE6OF01CXU0M.22.14.B03.1.454.CMB.1.raw
  modified_base (387)..(423): a, c, t, g, unknown or other
  misc_feature (387)..(423): n is a, c, g, or t
tcagacatacgcgtcacgaccggtgctcgatttagtgtgagtagttccgcgggcaaatccacgaccacagtgtacatgtcgctgagcagccctgagatctgaggacacggtccgttttattattgtgttagtgggtgagcagtcccggcggccgtgggggccaggggaacccctggtccaccgtctccgtcacgccctccaaccgaaggggcccccagtcccgggttccttcccccccgtggcccgcccctgccctaccgagggcgccacccgtccgaagacgcacgacggccggccgtgggctcgccgtggtacaacggtactaccgttccacgtctatcgtactcggacggcgggcctagggacgaacggccgaacgtagtacgnnnnnnnnnnnnnnnnnnnnnnnnnnnnnnnnnnnnn

SEQ ID NO: 182249 - DNA, 541 bp, Homo sapiens
  misc_feature: GYAE6OF01EDL9R.22.14.B03.1.454.CMB.1.raw
  modified_base (488)..(489): a, c, t, g, unknown or other
  misc_feature (488)..(489): n is a, c, g, or t
  modified_base (491)..(541): a, c, t, g, unknown or other
  misc_feature (491)..(541): n is a, c, g, or t
tcagacatacgcgtcacgaccggtgctcgatttagtgtgagtagttcccgggaatccggggtccctgaccgattcagtggcaggcgggtctggggacagtatttcactctcaccatcagcagcctgcaggctaggaagagtggtggacttagttttattagttgtacagtactaaattagttttaacttacctttccctacccgttactaacgggttaacccggtttacccggggaaccgtaaaaacgggggtaacccgtaaaagggggttaacgggttaaaaaaccttaaccggaaaaaaacccggttaaccggttgggttacgggggtacccttacgggtaaccccctaacgttacgtttccgtttacggtttccctttactaaccgtttcccttaccccggaccttaagttcgtaacggtaccgtacgttacgttcggtacgacgggtacgggtcgggtacgtacggacgaccggcgactagagnngnnnnnnnnnnnnnnnnnnnnnnnnnnnnnnnnnnnnnnnnnnnnnnnnnnn

SEQ ID NO: 182250 - DNA, 737 bp, Homo sapiens
  misc_feature: GYAE6OF01AGJ8Z.22.14.B03.1.454.CMB.1.raw
  modified_base (320)..(320): a, c, t, g, unknown or other
  misc_feature (320)..(320): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctccctggctgtgtctcgtgggcgagacgggccaccatcaactgcaagtccagccagtagttactttttacgacgtcctaccaaccaagtaagtacgttaacttacgtcttggttccagacgaacgaaaccgaggactactccgtccngccactgtcctactactttacggtcgggtcgttacccggtaacccgggtacgttcccggggtacctacggtaccgtagttcggagtcggcgtacgggtcgggtcggtacggggtactaggttacctttccacctccgttaccaccgtataccgagtctaccgtcgtacgcgacggtacgaggtaagtacgtacggtaggaccgttttaagttttagttacgttacggtacctaacgttaacttaaatttacgtttaactttaccgttacccttaccgtaacgtaccggttaccgggtttacccgggaaacccggtaaacggggtaacccgttaaaggggttaaacggtaaaacgtaacccggtaaaaaggttcccggttagggtaccggacccttaccggaacccttaaccgttacg

SEQ ID NO: 182251 - DNA, 928 bp, Homo sapiens
  misc_feature: GYAE6OF01CKSKJ.22.14.B03.1.454.CMB.1.raw
  modified_base (694)..(694): a, c, t, g, unknown or other
  misc_feature (694)..(694): n is a, c, g, or t
  modified_base (790)..(790): a, c, t, g, unknown or other
  misc_feature (790)..(790): n is a, c, g, or t
tcagacatacgcgtcacgaccggtgctcgatttagtgtgagtagtcccgcgggggagctacaacaggcaggcagggcagcaagatggtgttgcagaacccaggtcttcatttctctgttgctctggatctctggtgaccgttacggggactagttggtagtagtaccgtacccacgttccttacccaacggtaccttcccgtaggtccgttggttcgttcccgttcggttccgggacgaacgggaaccggggacccaaccgtaactaaccgtaaaacgttggaacctaaccggttacccgaacggtaccgtaaaggttaaccgtttttaacttttttaaccgaacgttaccgtaccccaaaaaccgtaaaaagttaaaacggttaacgttttaaccgtttaacgttccggtttaccggttacccgaacgtaaccgaaaaccggaaacccggaacggtaaccgtaccgtttaccccggtttacccgtaacgttcccgtaaccgtttcggaccctttacgtttaaaccgttttaaccggtcggggttaacccggttaaccccgggtacccgggttaaccgggtcccgggtacccgttaccgtaccgttacgtacggtacggtcggaccgtcggtacgggtcggtacgagtacgtcgtttacctaccgtaccgtaccaccggtataccgaccgtccnccgggttaccacggtacggtacgtaccgaggtaacgtacgtggttacgtacgtttaagtttagttccgttaagtcccgtaagtacgtttaaacttntttaacccgtttaccttaccgtacccttaaggttaacccgtacggttaccgaacccgggttaagggtaaccgtaaaggtaacgtaaaaccgtaacgtaaacggtaagttcggtaacctagtcctaaccgccttaacgg

SEQ ID NO: 182252 - DNA, 784 bp, Homo sapiens
  misc_feature: GYAE6OF01DHDGN.22.14.B03.1.454.CMB.1.raw
  modified_base (453)..(453): a, c, t, g, unknown or other
  misc_feature (453)..(453): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattggtgatcgaccctagtcctccagacctcccgtggctgtgtctcggtgggcgaggacggcccaccgatacaactcgactaacgtccacgaccgtaaggtagttttaatttttaaccgacgtacctacccaacctaaagttaacgtaacgtttacttacgtccgtttcggttacacgacgaaacgaaccgacggaccttacgtaccgtcctgaccgtacgtcgtccttacttagttttacggtcgggtaccgttaccgggtacccggttaccgggttcccgggtacccgtacggtacccgttntaccgtagggcgtacggtacgggtcgggtaccggttaacggacgtacgttacctttaccgtacctacccgtacctaaccgtaacgtaccgtacgaccgtaaccgggtcccgttaacggaaccggtaaggttcccgtaagggtaacggttacgttcgggtacgttaccgtttaaggttttacttacggttacgtccgtaagtaactttaacttaagtttaaccttccgttaccgtccttaaggtacccggttaccgtaccgggaacggtaaccggacggttaaggcgttaaaacacgtaaacgtcggtagacgtacctacgcctcgttaccg

SEQ ID NO: 182253 - DNA, 835 bp, Homo sapiens
  misc_feature: GYAE6OF01BRWA6.22.14.B03.1.454.CMB.1.raw
tcagacatacgcgtcacgaccggtgctcgatttagtgtgagtagttccgcgggggagctacaacaggcaggcgaggggcagcaagatggtgttgcagacccaggtcttctatttctctgttgctcgtggatctcgtggtcgaccgtacggggactagttgtgtagtacgacccgtacgtcctaccaacgtaccctcccgtcggtcgtggttcgttccgtcggtcggggacgaacgggacggtcccaacctacgtaccaacgtcgacgtaacgtcacgtacgtagttacgtttacttttacgacgtcctaccgtaacgtaaagtaacgtaacgtttacgttacgttcgttcgtaccgacgaacgtaaacgaaaccgtacggactacgtccgtccgtacgacctacgtacgtaccgttacgttacgttaccggtcgggtacccgtacccggtaacccgggtaccggtccccgggtaccgtacggtacgtacgttacgaggtcggtacgtacgggtcgggtacgtacggtactacgttacttacccgtacgtactacccgtacgtactccgacgtaccgtcgtacgtcggaacgtacgtaacgtaagagtacggtcgttacggttacctttaggttttaacgttcgtacgtaaacgttaactaacgtttaaagtttaccctttaacgttcccttaccggttaccgttaaccggtaaccgggtttaccggtaacccgggtaaacccggaaacgggtaaacgtaaagggtaaactaaacggaaaccgtttaacggaccggtttcggttaacgacccgttactaacccggtaacttccggg

SEQ ID NO: 182254 - DNA, 653 bp, Homo sapiens
  misc_feature: GYAE6OF01CUMRK.22.14.B03.1.454.CMB.1.raw
  modified_base (285)..(285): a, c, t, g, unknown or other
  misc_feature (285)..(285): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctccacaaataagagttactagtcttggttccagcaagaaaccnggacatccgtcctgcctacgtgctctatttacgtcggggtccgttacccggtaaccccgggtaacgtccccggggttccctacggtaacccggtagttacgacggtcgggtaccgacgggtccgggtcgtaggggactaaggtactttcacctcctacacctactacgagcacgcctaggcgtaacggctaggaagtgtggtacggtacgttagttttactgttacgtacagtacttaaatttacgttaacttaccttccttacgtaccgtacggtaccgttaaccggaaccgtaaacgggtacgtaagggtaaggtaaacgtaccgaaaaacgtcgtacggttacgacgtacgacccgtaactaccg

SEQ ID NO: 182255 - DNA, 795 bp, Homo sapiens
  misc_feature: GYAE6OF01CB74Z.22.14.B03.1.454.CMB.1.raw
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
tcagacatacgcgtcacgaccggtgctcgatttagtgtgagtagttccgcgggggagctacaacaggcaggcaggggcagcaagatggtgttgcacgacccaggtcttcatttctctgttgctctggatctcgtggtcgccgtacgggactagttgtagagtacgacccacgtctaccgacgtacctcccgtgtcttgtcgtctcggtggacgaggacggccacactacgaactcgactaacgtccgacgaccgtagttacgttttacttttacgacgttacctaacctaacgtaaagttaagttacgtttacgttacgtacgtttacggtaccaacgacgaaaccgtaacgaacggactacgtcgtaccncgtacnctcgcttacgttacgttcggcggtcctaccgggaccggtaaccggtcccggtactcgacgttacgtcgtacgtcggagtacggtcggtacggtacggacgttacgtacgttacctacctcgtaacctacctacgtaaccgacgtaccgtaaccggtcgtaccggaaccgtacggttaacggtaacggtaacggtaccgttagggtaaccgtttaacggtttttaacgtttagtttacgtacgttaaccgtaacggttaacttaaacgtttttaacgttcgtttaacccctttacccggtacttacccggttaccggttaaccggttaaccgggtaaaccgtaacccgggtacggtaaaggtaccgtaaacgtaaccgaaaacggttcggtaacgtcgtaagtaccacgtacgttaccg

SEQ ID NO: 182256 - DNA, 316 bp, Homo sapiens
  misc_feature: GYAE6OF01B9GHE.22.14.B03.1.454.CMB.1.raw
  modified_base (226)..(226): a, c, t, g, unknown or other
  misc_feature (226)..(226): n is a, c, g, or t
  modified_base (255)..(255): a, c, t, g, unknown or other
  misc_feature (255)..(255): n is a, c, g, or t
  modified_base (287)..(287): a, c, t, g, unknown or other
  misc_feature (287)..(287): n is a, c, g, or t
  modified_base (304)..(316): a, c, t, g, unknown or other
  misc_feature (304)..(316): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggctagttttattattgtcagcaatattatattccctacctcagtacgttcggaccgaaagggaccaaggtagaatacaaaacgactgnggctgccacatctgtctcattccttcccnctatcgtagaacgcgtatgtctaggagcgggntggcaaggcgacatagnnnnnnnnnnnnn

SEQ ID NO: 182257 - DNA, 900 bp, Homo sapiens
  misc_feature: GYAE6OF01BXAFO.22.14.B03.1.454.CMB.1.raw
  modified_base (874)..(874): a, c, t, g, unknown or other
  misc_feature (874)..(874): n is a, c, g, or t
tcagacatacgcgtcacgaccggtgctcgatttagtgtgagtagtcccgcgggggagctacaacaggcaggcaggggcagcaagatggtgttgcagacccaggtcttctatttctcttgttgctcgtggatctcgtggtcgtccggtacggggatagttgtgactaccgacccgtacgtcctccaacgtcccttcccgtggtcttggttcgttcgtcggtcgggacggacgggaccggacccaactaacctaccgtaactacggacccgtaacggtacccaaccggtaccgtaaggtttaacgtttttaccttttttaccgaccgttaccctaaccgtaaaccgtaaagttaaacggttaacgtttacgttacgttaccgtttacggttaccgacgaacgaaacggtaaccgacggtactaccgttaccgtccgaccgtacctacgtcgttaccttacctttacggtttaaccggtccgggtacccggttaacccggggttaaccccgggttaccggggttacccccgggttaccgtaccggtaccgtaacggttaccggtaggggtccggacgtaccgggggttacggttcgggtaacggtaccgtagttaccgtacgtaccgttcctaccgacgtacttacgacgaccgtcgtcccgaacggtcggtaacggtagtacgtagggtgtttacggtagttaaccgggttttagtttaattacgttacgttaaggaacttttacgttaaattttcgtaacctttcccgttccgtaccggtaccgttacggttaaccgggttacccgggaaacggtttaccgggaaaagggttaacggttaacggtaaacccaacggttaccggtcgtaaaccggngttacccgacgtaaccttggttaccg

SEQ ID NO: 182258 - DNA, 805 bp, Homo sapiens
  misc_feature: GYAE6OF01B6600.22.14.B03.1.454.CMB.1.raw
tcagacatacgcgtcacgaccggtgctcgatttagtgtgagtagttccgcgggggagctacaacaggcaggcagggggcagcgaagatggtggttgcagacccaggtcttcatttctctgttgctctggactctctggtgaccgtacggggactagtttgtgactcgaccctagtcctaccagacctcccgtggctgtgtctcgtgggcgagacggcccactatcaactgacaagtccacgcctagtagtttactttttacacgtcctaccgaacctaaagtaagtacgttttacgttacgtccgtttcggttccctacgaccgaaacggaaaccctagggtaacctacgtttaccgttaccttcggacctacgttcgtacctttacgttaaacgttttacccgggtacgggtacccgtaaccccgttaaccccggggtaaccgggttcccccggggtttaccctacgggtacccgtacggtttacgacggggttccggtaccggacgggtcccgggttacgtacgggggtaaccttaacggttacgttttacccacccgtttacgtaacccgtaacccggacttacccggagtaccccgaacggtcccgtaggaccgttacggaacggtacgtaacggtacgtcgggtacgtacctttagtttacctaccgtgaacctaggtacttaatttacttacttcccttaccggtaccttacggacggttacgttaccggaaccgtaaagggtaaccgaggttaacgaacctacggaacctacggtgtacggtacaccacgtcgtaccg

SEQ ID NO: 182259 - DNA, 739 bp, Homo sapiens
  misc_feature: GYAE6OF01BVK63.22.14.B03.1.454.CMB.1.raw
tcagacatacgcgtcacgaccggtgctcgatttagtgtgagtagttccgcgggggagctacaacaggcaggcagggggcagcaagatggtgttgcagacccaggtcttcatttctctgttgctctggatctctggtgcctacggggacattgtgatcgacccagtctccagacctccctggctgtgtctcgtgggcgaggagggccaccatacaactgacaacgtccacgaccgagtagtttatttttacagcctaccaaccaataagtacgttacttagtcttcggttcagacaacgaaaccaaggactactacgtcctagacctactacgtctactacttttacgtcgggtccgtaccggttaacccgggaacgttcccggggtacccgtacggtaaccgtacgttacgtacggtacggacgtacgggtcgggtacggtacggggacgtaggttactttaccgtacttccgtaccacccgtacacgtacgacgaccgtcccgtacgtacgacggtacgtacgacggaagtttcgggaggttacgttacgtttttatttcgttacgtacgtaacgtacttaaacgtttaactttaagtttaccccttacccgttaccgtaacgtaccgggttaaccggttaaccgggaacccggtaaacgggggtacctaaaggggtaacggtaaactaaacccggaaagtaacgggttcgtacggtaccgacgtaaccaccgttacg

SEQ ID NO: 182260 - DNA, 762 bp, Homo sapiens
  misc_feature: GYAE6OF01BKZMS.22.14.B03.1.454.CMB.1.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatcgacccagtcctccagacctccctggctgtgtctcgtgggcgaggacggccaccatacaactgacaagtccacgaccagtagtttatttttaacacgtactacctaaccgtaaattaacgtacgtttaacttagtacgtttcggttaccagtaccgaacgaaaccgtaggacctactccgtcctacgacacttcgtacttactaacgttttaccggcgggtaccgttaccggtaacccgggtacggttccccgggtccgttacgacccgtagttcgacggtcggacgtacgggtccggggttcgtacgggaaccgtacgttaaccttccgtaaccgtaccttaaccaccgtaacttaccggacgaccgtaccggtacccgtacggtcgaacggtactaagggtaacgttacgtcgggttacgtaacgtttaagttttatacggttagtcgtaacgttactaaagttttacttaacgttacgtttacccacgttacggacggttccggttaaacccggaacgggtaaacggttaccggtaaagggttaacgaaaccgtaaccgtaaaccggttgtaccggcgttacgaccgtaacccctgttacccg

SEQ ID NO: 182261 - DNA, 734 bp, Homo sapiens
  misc_feature: GYAE6OF01AEJOX.22.14.B03.1.454.CMB.1.raw
  modified_base (544)..(544): a, c, t, g, unknown or other
  misc_feature (544)..(544): n is a, c, g, or t
tcagacatacgcgtcacgaccggtgctcgatttagtgtgagtagttccgcgggggagctacaacaggcaggcagggggcagcaagatggtgttgcagacccaggtcttcatttctctgttgctctggatctctggtgcctacggggacattgtgatcgacccagtctccagacctccctggctgtgtctcgtgggcgaggacggccaccatccaactgacaacgtccagaccagtagtttactttttacacgtacctaccaacctaaagttaacgtacgtttacttacgtcgtttacggttacccagacgaaacgaaaccgtacggaacctacgtaccgtcctcgacctaccgtcgtaccttacttacgttttacggtccgggtccgttacccgggtaacccggggtaccggttcccgggtaccctacggaccggttactaccggtagggtcgtaccggacgggtccgggttacggtaccgggacttacggtttaacttaccgtaccttacccgtaccaccttagaccgacgaccgcgtcccgnggaccggtcggtaccgtaggaacgtggttcgtaggtactttagtttactgttacgtacgtagtacttaagttacttacgttaccttcccgtactaacgtcggtacggttaccggaacggtaaccggtacggtaaggtaacgtaactaaaccggtaacgtacgggttcgtacggtacctacaccgtctacg

SEQ ID NO: 182262 - DNA, 921 bp, Homo sapiens
  misc_feature: GYAE6OF01A86EI.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttctatttctctgttgctctggtatctcgtggtcgtaccggtacgggtatagttgtagactaccgacctacgtcctaccagtaccctccgtgtctgtcgtcgtcggtggacgaacggaccggaccaaccgtactaccgtaacgtcgaaccgtaacgtaccacggtaccgtaaggttaacgtttttaacgttttaaccacgttaaccctaacccgtaaaacttaaacgttaaacgttaacggtttaaccgttacggttaccgtttacggtaaccgtaacgaacgtaaaaaccggaaaccgtaacggtaaccttaacgttccgtaccgtacgtacctacgtcgtaccttaacgtttacgtttacggtacggtacccgttaccgtaacccggggtaccgttcccgggtacctaacggtacgttaacgtacggtaggtaccggtacgggtaggacccggggtttacaccgggtaaacgtttaacgtttacccggttaccacggttaccctaaccgaaccgtaacgttacggacgtaaccgtacccggtaccgtacgaacggtaaccgtagtaaccgggtaagttcggttaacggtaggttaatttacgttttaaagtcgttaaccgtacgtaaccgttaaacgttaagttttaacccttagttaacccgtttaccgtacccgttaacggttaccggttaacccgggtacccgtaaacgggaaaccccggttaggttaaaacgggtaaccgttaaaaccgtaaaccggtaaacgtaacgtttacgggaacggtaccgtaaccgtaacgtaacccgttaacg

SEQ ID NO: 182263 - DNA, 815 bp, Homo sapiens
  misc_feature: GYAE6OF01D9SJS.22.14.B03.1.454.CMB.1.raw
  modified_base (154)..(154): a, c, t, g, unknown or other
  misc_feature (154)..(154): n is a, c, g, or t
  modified_base (186)..(186): a, c, t, g, unknown or other
  misc_feature (186)..(186): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggcattgtgatnacccgagtctccagacctcctggctgtgtctntgggcgtagacgggccaccgatcaactgacgaacgtccacgccgagtacgtttatttttacgagtcctaccaaccaagtaacgtagtttactagtcgtttcggtaccaacgtacaacgaaaaccgtaggtaccaacgttccgtacctgccgtaactcggaccttacgtacttttaacgtgggttacccgtaccggttaacccgggtaacggttccccgggtaccacggtaccctacgttacgaaggtcggacgacgggttacgggttcgacgggtacgtacgttacgtttacgtaccgtaccgtaccgtaaccgtacttaccgacgtaccggtacgtccgtacggtacggtaccgacggtaagtaaccgttagtggtcggttaaccgttagttttacggttacttagtacgtaagttacggttaaaacttagttttaaccgttaacccgtttccgtaccccggttacgttaaacccggttcccgggtttaaccgggaacccgttaaaccgggggtaaacccgggttaacggggttaaaaccggaaaaccgtttaccgggtaaaaacccgttcgggttaacggttacccgggttaccctaaccggggtaaacccttccggtttaaacccg

SEQ ID NO: 182264 - DNA, 730 bp, Homo sapiens
  misc_feature: GYAE6OF01D6ZD5.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgacccagtctccacgtacctcccgtggtctggtcgttccgtcgtgggcggacggacgggcccaaccacgtacaacgtgacaacgtccacgccagtagtttactttttacacgtctaccaacaaagttaagtacgtttacttacgtcgttcgttaccagacgaaacgaaaccgaggacctacgtccggtacctcgacctacgtacgtctaccgttacgtttacggtcgggtacccgttaccggtacccgggtaccgggtcccgggtccctacggtaccgtacgtcgtacggtcgacgggtacgggtcgggttcggacgggtaacgtacggtttacttaccgtacctccgtaccgtaaccctagtaccaaccgggtcctaaccgggtcccgtagaccggtaagtcggttaaggaagttcggtggttaggtactttagtttacgttagttcgactaatacttaatttccttaagttctcccgttactcggtaaccgtccggtaccggagtaaccgggacgttaagggaacgtaaactaaccgaacgttacggtcgacgtcaaaccgtcacgttcg

SEQ ID NO: 182265 - DNA, 732 bp, Homo sapiens
  misc_feature: GYAE6OF01E5Q8Z.22.14.B03.1.454.CMB.1.raw
tcagacatacgcgtcacgaccggtgctcgatttagtgtgagtagttccgcggggagctacaacaggcaggcagggcagcaagatggtgttgcacgacccaggtcttctatttctctgttgctcgtggatctcgtggtcgtaccgtacggggactattggagactaccgaccctacgtcctaccgaacgtccctccgtcggtccttggtcgtccgtcgggtacgggaccggaacgggaccggaccctaacctaacgtaccgtaaaccgtcgtaaccgtaacgtacccgtaacgtaccggtaagtttaacgttttaacgtttaccgaccgtacctaacctaacgtaagtaacgttacgttacgtcgtcgtacgacaacgacgaacgacgtacgtactcgtccgtctactactcgtcgtaccttacggttacgtacggtaccggtaccgtaccggtaccggtaccggtaccgtacgtaccgtacgtcgtacggtacggtcgtacggtacggtcgtacgacgtactactactcacgtacacgacgtaccgacgtacgtacgccgtagacgtacgtagtaacgtatacgttcgtcgttagttacgttatagtacgtagtactaacgtacttacttacgtccttacgaccgtacgtacggtaccgtacggtaaaccgaacggtacgacgtaagtaacctacgtaccgttacgcgtacgtccgactacgtcgttcgtcc

SEQ ID NO: 182266 - DNA, 860 bp, Homo sapiens
  misc_feature: GYAE6OF01BBUJ6.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgtatgacccagtctccagactccctggctgtgtctctgggcgagagggccaccgatcaactgacaagtccagccacgtagttacttttttacgacgtcctaccaaccaattaaacgtaacgtttaccgtttaggtcctttaggggtttcccaaggtaccaaggtaaaaccccgaggggaacctaacggtccgttacccgtagaccgaaccttggtacctaccgtaatttttaccggtcgggggtaccgttacccgtaaccccgggggtaaacgttccccggggggttacccctacgggtaacccgtaacgtttccggtaacgggttacggggccgtaacggggtccggggttaccgttacggggggaacccgtaagggttaacctttttccgaaacccgtttcccgtaaccctaacccgtaacttacccgtaacgggacccgaaccgggtccccgttaacgggacccggtagggtaacccttagggaaaacggttcggtcggggttagggtacctttaagggtttttaactttagttacgttaacacggtacctaaatttaactttatttaacctttcccgttcccttaacgtaacgggttacccggtttacgggaacccgtaaacggggaacccgtaaggggttaacggaaaacttaccgaaaacggttacttacgggtacggtactaccgtaccgtaacgttaccg

SEQ ID NO: 182267 - DNA, 819 bp, Homo sapiens
  misc_feature: GYAE6OF01AM2Y7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatcctctggtgccgtacggggacattgtgatcgacccagtccgtcagacctccctggtcctgtcgtcctcgtcgggcggaggacggcccaccatccaaactcgacaacgtcccacggtaccaaggtacgtttaagttttttaaccacggtcctaaccctaaccgtaaacttaaacggtaacgtttaacgttacgttccgtttacgggtttaccaacgtacctaaaccgtaaaacccgaacggaacctaacgttccgttaccgtacgacctaccgtacgtacctaacgtacttttaacggtcgggtaccgttacccggtacccgggtaaccggttcccggggtacccttcggtaaccgtagtttccgaacggttcgggacccgaagggtcccgggttacggtacggggtacaaggttacctttccaacttacccgaacctaccctaacgttaccgacgtaccgtaccgtaccgtacgccgtaacggactaaggaacgttagtacgggttagtaacgtttagttttaacgtacgtttagtcgtaagacttaaattactttaactacctttcccgtaccgttaactacggtccgttaaaccgtacccgggaaacggttaccgtaaagggtaacggtaaaaccctaaacgaaacccttaacgggttccgtacgggacttacgaaccctaacgttacg

SEQ ID NO: 182268 - DNA, 820 bp, Homo sapiens
  misc_feature: GYAE6OF01BBR39.22.14.B03.1.454.CMB.1.raw
  modified_base (806)..(806): a, c, t, g, unknown or other
  misc_feature (806)..(806): n is a, c, g, or t
  modified_base (814)..(814): a, c, t, g, unknown or other
  misc_feature (814)..(814): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctcgtggatctcgtggtgccgttacgggggactagtttggtagtatcggaaccccaggtccctccgaacggaccttccccgtgggtccttggttcggttccgtggtcggggaccggaagggacgggtccccaaccctaataccgtaaaccgttggaccgtaacgtcccgaaggaccgtagttaacgttttaatttttaaccgcgtacccttaccgaacctaaaagttaacggtaacgttacttaacgtcggtttacggttaccgagtaccaaggaaacccgacgggtaactaccgttcggtacccgtagacctacgttacggcctttactaacgttttaacggtcggggtacccgttaaccggtacccggggtaaacggttccccggggtaccctacggggaacccttacgttacgtacgggcggtacgtacgggtcgggtacgtaacgggacctagtacttacgacttacaacctacgtaactacgtacggaaccacggtaccgtagacgtacgggaatacgtaaggtacgtagggtacgtacttaagttttactagttacaaccggtaatacgttaattactttaactaccgttccctacgtacgtaaccggtacggtacccggtaacgaaacgggttacgaaggttacggaaactacgtaaaacgtcggagttaccggtacncggtaacncggtac

SEQ ID NO: 182269 - DNA, 475 bp, Homo sapiens
  misc_feature: GYAE6OF01EWUCR.22.14.B03.1.454.CMB.1.raw
  modified_base (265)..(265): a, c, t, g, unknown or other
  misc_feature (265)..(265): n is a, c, g, or t
  modified_base (406)..(406): a, c, t, g, unknown or other
  misc_feature (406)..(406): n is a, c, g, or t
  modified_base (411)..(426): a, c, t, g, unknown or other
  misc_feature (411)..(426): n is a, c, g, or t
  modified_base (429)..(475): a, c, t, g, unknown or other
  misc_feature (429)..(475): n is a, c, g, or t
tcagacatacgcgtcacgaccggtgctcgatttagtgtgagtagttccgcgggcaaatccacgaccacagtgtacatgtcgctgagcagcctgagatctgaggacacggtccgttttattattgtgttagtggggtgagcactccgggcggcccgtgggggccaacggggaccctggtccaccgtctcctcacgcccctccaaccgaacgggccccacggttccggttcccttccccccgtggcccgcccgtgcctccgaggacnccaccctcggaagcgccacgtcggcccggcccctggggccgtcgtcgtggtaccgaacggtaccttaccgttaccacggccgttaagttcgtccggtggacgggcgggtaccggtggaaccgaacgggtccgcgaacgtangtacnnnnnnnnnnnnnnnncgnnnnnnnnnnnnnnnnnnnnnnnnnnnnnnnnnnnnnnnnnnnnnnn

SEQ ID NO: 182270 - DNA, 949 bp, Homo sapiens
  misc_feature: GYAE6OF01CE6B0.22.14.B03.1.454.CMB.1.raw
  modified_base (154)..(154): a, c, t, g, unknown or other
  misc_feature (154)..(154): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacgggactattgngatccgaacccgtacgtcctacccgacgtaccctcccgtcggtcgtgttcgttaccgtcggtcgggacggacgggaccgggaccccaccgtactaaccgaacgttacggactaaccggtcccgacgtacccgtaaggttaacgtttttaactttttaacaccgtaccgttaacccaaaccggtaaattaaacggttaagtttaaccgttttacgttaccggttttacggtacccgtaagtaaaccgaaaccggtaaaacccggtaggtaaccttaccggttccccgttaccgtcgtaaccgttaccgtaccgtaccttaaccgtttaccggtttacgggtcccgggttacccggttaaacccccgggttaacccggggtaaccccgggtttacccgggtaccccttaaggtaacccggttgtacgggtaagggtccggtaaccggtcggggtaccggttcggaacggggtaacttacgtttaccgtttccaccgttaccgtaccgaaaccgtcgtaccgaacgtaccgtaccgtaccggtaggacccggtaggtaacgttaacggaaggtttcgttccgggtaagtaacgttttacgtttactaggtacacggtaacgttactaagtttaccttacgttacccttacgttacccgtacgttaaacccgggttaccggtaaaccgggaaaccggttaaccgggtaaacgttaaccgggttaaaactaccggttaaaacggtaaccggtaacgtttaccgggcgttaaccccgtaaagtccccggttaacttaccgg

SEQ ID NO: 182271 - DNA, 964 bp, Homo sapiens
  misc_feature: GYAE6OF01BMBKV.22.14.B03.1.454.CMB.1.raw
  modified_base (367)..(367): a, c, t, g, unknown or other
  misc_feature (367)..(367): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgagtcgaccctagtcctaccgagacctcccctgggtctgtcgttcgtcgtgggacgaagggacggcccaacgtactacaacgtcgacgtaacgtccacgtacctaaggttacgtttaactttttaccgagtcctacctaaccgtaaagtaaacggtaccgtttaacttaacgtccgtttacggttaccaaggtaacccaaggtaaaaaccccgnggtaaacctaccgttccgtacccgttacgaccgtacgtcggtaccttaccgtacgtttaccgggtcggtaccgttacccgggtaaccggttaccgggttccccggggtccctaggaaccctgttaccgaacggtcggcgaacgggtcggtacgtacgggtactaagttccggttcaaccgttccctaaccgaccgtaaccgtcgtacgtacggtaacccgtccggtacggtaccggacggttacggtaacgtaaacggtcgggttacggtaacggtttaccgttttaaggttacggttttaacggtaccggtaaccgttaccgggttaaacttaaaccgttttaacgtttaaacccgttttaccccgttaccccttttaaccgggaacccgttttaaaccgggttacccccgggtttaaaccggggtaaaaccccgggttaaaccgggggtaaacccgggttaaaaccggggttaaaaccgggtaaaaaaaccccggttacccggttaaaaaaacggggttaccctttaaaccgggggggttaccgttaaaaccgggttacccggtaaacccccgttaaacggtttaaacccccggg

SEQ ID NO: 182272 - DNA, 484 bp, Homo sapiens
  misc_feature: GYAE6OF01C1DOP.22.14.B03.1.454.CMB.1.raw
  modified_base (187)..(187): a, c, t, g, unknown or other
  misc_feature (187)..(187): n is a, c, g, or t
  modified_base (258)..(258): a, c, t, g, unknown or other
  misc_feature (258)..(258): n is a, c, g, or t
  modified_base (278)..(278): a, c, t, g, unknown or other
  misc_feature (278)..(278): n is a, c, g, or t
  modified_base (416)..(416): a, c, t, g, unknown or other
  misc_feature (416)..(416): n is a, c, g, or t
  modified_base (418)..(419): a, c, t, g, unknown or other
  misc_feature (418)..(419): n is a, c, g, or t
  modified_base (421)..(484): a, c, t, g, unknown or other
  misc_feature (421)..(484): n is a, c, g, or t
tcagacatacgcgtcacgaccggtgctcgatttagtgtgagtagttccgcggacaaatccacgaccacagtgtacatgtcgctgagcagcctgagatctgaggacacggtccgttttattattgtgttatgggtgagcagtcccggcggcctgggggccaggggaacccctggtccaccgtctcctnacgccctccaaccgaaggggccccagttccggtcccttccccccgtgggcccgcccctgcctccgaaggcnccacccgtccgagacgcacnggcccggtccctcggggctcgtccgtagggtaccgaaaggtacccttaaccgtttaccccgaccggtcgttaattcggttcgtcgggaggtccggggggaccttggggaccgtaaacggggcccgactaaggttcgcngnngnnnnnnnnnnnnnnnnnnnnnnnnnnnnnnnnnnnnnnnnnnnnnnnnnnnnnnnnnnnnnnnn

SEQ ID NO: 182273 - DNA, 797 bp, Homo sapiens
  misc_feature: GYAE6OF01A8W4N.22.14.B03.1.454.CMB.1.raw
  modified_base (355)..(355): a, c, t, g, unknown or other
  misc_feature (355)..(355): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgccgtacggggacattgtgatcgacccgagtcctccagacctccctggctgtgtatcgtgggcgaggacggccaccatcaactgacaacgtccagccagtagttattttacacgcctaccaacctaataagtacgttacttagtcgttcggttaccagacaacgaaaccgaggacctagttccgtccgtacgtctacgtcgtacctactagtttaccgngggtaccgtaccggtaacccgggtacgttcccgggtacccgtacgaccgtacgtcgtacggtacggcgacgggtcggtacgtacgggtactagttacttccactacctaccgaccttagtccgaacgtccgtacggtcccgtagggaccggtacggtacgtaaccgggtaaaggtccgttagggttaccggttaacttttaagggttttacgttacgttcggtaaccgttaaggtaacctttaaaggttaccttttacgtttacccgtttacccctaggtttaccgtaacccggggttaaccggttacccgggaaacccggttaaaaccgggtcccgggttaaaagggttaacccgggttaaaaacccgttaccggtaaaaaccggttacggggttcggttaaccggtaccgttacccggtaaccccgttacggttaaaccg

SEQ ID NO: 182274 - DNA, 699 bp, Homo sapiens
  misc_feature: GYAE6OF01DRVJA.22.14.B03.1.454.CMB.1.raw
  modified_base (389)..(389): a, c, t, g, unknown or other
  misc_feature (389)..(389): n is a, c, g, or t
tcagacatacgcgtcacgaccggtgctcgatttagtgtgagtagttccggcgggggagctacaacaggcaggcgaggggcagcaagatggtgttgcacgacccaggtcttctattttctctgttgctctggattctcgtggtcgccgtacgggactagttgtagagtcgacctacgtcctccgaagtacctccgtggtcttggtcgttcgtcggtgggacggaggaccgggaccactactaccaacgtcgaccgtaacgacctacgaccgtaaggttaacgtttttacttttaccgacgtaccctaccaaacttaaataacggttacgtttaacgttacgttccgtttacgtaccgacaacgaaaccgaaacgacgactactccgtccncgacactcgtctacttacgttcggtcggtaccgtaccggtaccggaccggttccggtccgacgtacgtctacggacgtcggacgcgggtcggtcggtagtactacgtactctactcacgtacacgcgacgactccgtacgtcgacgtcgcgagagttcgtaggtattagtttatttgttactacgagttaactattaagttacttacgttcttcccgtacgtacgttaccggtaacgtaccggacggaaacggtacgtaaaggtaacggtaactaaccgagtaaccggtgtaacgctaacgcctcgtacg

SEQ ID NO: 182275 - DNA, 729 bp, Homo sapiens
  misc_feature: GYAE6OF01DOZT0.22.14.B03.1.454.CMB.1.raw
  modified_base (127)..(127): a, c, t, g, unknown or other
  misc_feature (127)..(127): n is a, c, g, or t
  modified_base (304)..(304): a, c, t, g, unknown or other
  misc_feature (304)..(304): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggntctcgtggtgccgtacggggactagttgtgatcgacccagtcctccagtacctcccgtggctgtgttcgtcggtgggcgaggacgggacccaccgtatacaacgtgacaacgtccacgccagtactttattttacacgcctaccaactaatagtaacgttctatcgttacgtaccanacgaacgaaccaggactacgtccgtcctgacctacgtcgtacctacgttacgttacggtcgggtaccgtaaccggtaccccgggtaccggtccccgggtcctaacggtaccgttagtccggtacgggtcgtacggacgggtccgggtacggtacggtacgtacggttacttcgacctaccgtacaaccttacgccgtacgcctaaccgtcgacggacgacgtcgaaggtacgtcggttgacggtttatttaacgttgttaacgtgaaccgttaagtaacctttaagttactttaacccgtgtttaccctacggtaacggtaccgttaacggtaccggaacggtaaacgggtaaaccgagggttaactaaaaccgaaccggtttaacggacgttgggaaaccctccgtaacgaccctggttacccg

SEQ ID NO: 182276 - DNA, 858 bp, Homo sapiens
  misc_feature: GYAE6OF01A400M.22.14.B03.1.454.CMB.1.raw
  modified_base (112)..(112): a, c, t, g, unknown or other
  misc_feature (112)..(112): n is a, c, g, or t
  modified_base (124)..(124): a, c, t, g, unknown or other
  misc_feature (124)..(124): n is a, c, g, or t
tcagacatacgcgtcacgaccggtgctcgatttagtgtgagtagttccgcgggggagctacaacaggcaggcaggggcagcaagatggtgttgcgacgacccaggtcttctntttcctctgttnctgtgtatctcgtggtcgtccggttacgggactagttgtgtacaccgtacctacgtcctccgacgtacccttcccgtggtccgttaggttccgttcgttccgggtcgggaccggaagggccgggtacccaaccgtacgtaccgaactcggaaccttaccggtcccacgtaccggtaagtttacggttttaacttttaccgacgtcctaacctaacctaaagttaacgttaacgtttaacgttggttaccttccggtaacgacgacgaaacggaaccgtagtaccgtacgtccggtctacgtcctactcgtccttacgttacgtaccggtcggtaccgtaacccgggtaccggtaccggttcccggtaaccctcggttaaacccgtgtaccggttcggcggtcgtcgggtaacgggtcgtaacggggtacttaccggttacttacctaccttccgtaccgtaacctacggtacccaggtaccgtaccggttacccacgggtacccggtaaggttaagtttacgggaaacgtttaaccggttgggtaccggttagttttaaacgtttacgtttacggtaaacgttaccgttaactaacgtttaaactttacttaacctttccggtttaaccctacggtaccgtaacggtaccggtacggtaacggtaacggtaacggtaaggaacggtaaccctagtaacggtccgtacggtaacggtccacggtacctccggttc

SEQ ID NO: 182277 - DNA, 829 bp, Homo sapiens
  misc_feature: GYAE6OF01CZPQ8.22.14.B03.1.454.CMB.1.raw
  modified_base (386)..(386): a, c, t, g, unknown or other
  misc_feature (386)..(386): n is a, c, g, or t
tcagacatacgcgtcacgaccggtgctcgatttagtgtgagtagttccgcgggggagctacaacaggcaggcaggggcagcaagatggtgttgcagacccgaggtcttcatttctcttgttgctctggatcctcgtggtgcccgtaacggggactattgtgatcgacccgagtcctaccagacctcccgtgctgtcgtctcgtggacgaggcggacccacctactacgtaacgtgacgacgtccacgccgagtagtttattttacgcgtcctaccaactaataagtacgtttaacgtacttaccgttcggttaccgacgtacaacgaaaaccgtaggacctaccgtacgtccctgtccacgtcgtactacctttacgtttaccggnggtacccgtccggtacccgggtaaccggtcccgggtaccctaccgtaccgttacgtccgtacggtcggacggtacggttccggggtcgtacgggtactagttaccgtttacctacgtaccctacccgtactaccgtaccgtaccgacgtacccgtacccgtacggaccgaacggcgttaaggtaaaccggtggttacggtaacggtttacctttaaaggtttttaagtttaccgtttaggtaacccgttacgttaaacgtttaaacttttagtttaacctttcccgtttacccccgttaaccggtcgttaaacccgggtttaccggtaaccccgggtaacccggtaaaacgggtaccggtaaaggttaacgtaaaacggtaacccgtaaaaccggttcggtaccggtaaccgggtacgtaccccgtaacccgtaacgttaccg

SEQ ID NO: 182278 - DNA, 693 bp, Homo sapiens
  misc_feature: GYAE6OF01EFBCL.22.14.B03.1.454.CMB.1.raw
  modified_base (669)..(669): a, c, t, g, unknown or other
  misc_feature (669)..(669): n is a, c, g, or t
  modified_base (677)..(677): a, c, t, g, unknown or other
  misc_feature (677)..(677): n is a, c, g, or t
  modified_base (688)..(688): a, c, t, g, unknown or other
  misc_feature (688)..(688): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgaccctagtctaccagtacctcccgtggctgtcgtctcgtcgggcgacggacggccaccataccaacgtcgactaacgtccacgcctagtagtttactttttacacgtcctaccaacctaaagtaacgtacgtttaacttacgtctttcggtaccagacctaacgaaaaccgaggacctaacgttccgtccgtacgacctacgtcgtcctacttacgtttacggcgggtaccgttaccggtaacccggggtaccgtcccgggttccctacggtaccgtacttcgaggttcggacgtcgggtcggtaggtacgggatacgtacttccgtacgtacctacgtacccagtacggactccgtacgtccctaggaccgtacggtacgtagtaacgttacgtggtacggtaatttaagttttgtgtacactacgtattacgtttatacttcctacgtcacgtaaggtcccgttcggaaacggttaacggaccgttaggaagtaaccacggtaaacgngttaccgngcctacgaccngtacg

SEQ ID NO: 182279 - DNA, 505 bp, Homo sapiens
  misc_feature: GYAE6OF02IHADL.22.14.B03.1.454.CMB.1.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccggggtcctgaccgattcagtggcagcggtctgggacagatttcactctcaccatcagcagcctgcaggctgaagatgtggctagtttatattgtcagcaattattatattcctctcagtacgttcggcctaagggaccaaggtgtaaaatcgaaacgactggtaggactgccacctac

SEQ ID NO: 182280 - DNA, 317 bp, Homo sapiens
  misc_feature: GYAE6OF02I8RR7.22.14.B03.1.454.CMB.1.raw
  modified_base (316)..(317): a, c, t, g, unknown or other
  misc_feature (316)..(317): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagccacctccgagagcacagcggccctgggctgcctggtcaaggactacttccacgcgtatgtctgagcgggctggcaaggcgcatagnn

SEQ ID NO: 182281 - DNA, 501 bp, Homo sapiens
  misc_feature: GYAE6OF02IOHSK.22.14.B03.1.454.CMB.1.raw
  modified_base (403)..(403): a, c, t, g, unknown or other
  misc_feature (403)..(403): n is a, c, g, or t
  modified_base (442)..(442): a, c, t, g, unknown or other
  misc_feature (442)..(442): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtggcagcgggtctgggacagattcactctcaccatcagcagctgcaggctgaagntgtggcagtttatattgcagcaattattatattcctctnagtacgttcggactaagggaccaagggtgaaactcgaaacgactgtggctgccactacg

SEQ ID NO: 182282 - DNA, 496 bp, Homo sapiens
  misc_feature: GYAE6OF02GJHFN.22.14.B03.1.454.CMB.1.raw
  modified_base (443)..(443): a, c, t, g, unknown or other
  misc_feature (443)..(443): n is a, c, g, or t
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtgcagtttatattgtcagcaatattatattcctctnagtacgttcgccaagggcccaaggtggaaatcaaacgactgtggctgcaccta

SEQ ID NO: 182283 - DNA, 549 bp, Homo sapiens
  misc_feature: GYAE6OF02FY5RG.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaacctgcaagtccagccagagttatttttacagctccaaccaataagagttacttagcttggttccagcaacgaaaccaggacatccgtcctgcactgctctatttacgtgggctccgtaccgggtagtcccgggtccctgaccgtattcagtcggcaggcgggtgtgggacagtactttcactctcaccatcagcacgcctgcaggctagaagatggtggactagttttattgttgtcagactaaattattattacttccctctacgagtaccgttcggaccgaagggacctaaggttacgtaaataccgaaaacgtacttggtacgctacgaccactacg

SEQ ID NO: 182284 - DNA, 296 bp, Homo sapiens
  misc_feature: GYAE6OF02HAST1.22.14.B03.1.454.CMB.1.raw
  modified_base (290)..(296): a, c, t, g, unknown or other
  misc_feature (290)..(296): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggcagtttattactgccagcaatattatgatactcctcggacgttcggccaagggaccaaggtggaaatcaaacgaactgtggctgcaccatctgtcttcatcttcccgccatctgaacgcgtatgtctgagcgggctggcaaggcgcatagnnnnnnn

SEQ ID NO: 182285 - DNA, 497 bp, Homo sapiens
  misc_feature: GYAE6OF02IJMZH.22.14.B03.1.454.CMB.1.raw
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttactagcttggttccagcagaaaccaggacatcgtcctgcactgctcatttactggcgtctaccgggaatccggggtcctgaccgattcagtgcagcggtctgggacagatttcactctcaccatcagcagcctgcaggctgaagatgtggcagtttatattgtcagcaatattatattccctctacagaccgttcgacctaagggaccaaggtgaaaatcaaaagactgtaggctcgacactac

SEQ ID NO: 182286 - DNA, 318 bp, Homo sapiens
  misc_feature: GYAE6OF02GFR42.22.14.B03.1.454.CMB.1.raw
  modified_base (315)..(318): a, c, t, g, unknown or other
  misc_feature (315)..(318): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctgggccagggaaccctggtcaccgtctcctcagcctccaccaagggcccatcggtcttcctcctggcgccctgctccaggagcacctccgagagcacagcggccctgggctgcctggtcaaggactacttccacgcgtatgtctgagcgggctggcaaggcgcatagnnnn

SEQ ID NO: 182287 - DNA, 497 bp, Homo sapiens
  misc_feature: GYAE6OF02FQAKI.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtcctgaccgattcagtggcagcgggtctgggacagatttcactctcaccatcagcagcctgcaggctgaagatgtggcagtttattactgtcagcaatattatattcctctcagacgttcggaccaagggccaaggtggaaatcaaacgactgtgctgcactac

SEQ ID NO: 182288 - DNA, 506 bp, Homo sapiens
  misc_feature: GYAE6OF02IGOFY.22.14.B03.1.454.CMB.1.raw
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgnggctagtttatattgtcagcaatattatattcctctcagtacgttcgaccaagggaccaaggtggaaatacgaaacgactaggtgactgacacctacg

SEQ ID NO: 182289 - DNA, 518 bp, Homo sapiens
  misc_feature: GYAE6OF02HL9EE.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtggcagcgggtctgggacagatttcactctcacatcagcacgcctgcaggctagaagtatggtcggcttagtttattattgtcagactaattattattacttcctctcagtacgtcgaccgaacggaacaggtagaaactacaaacgtacgtggcgtactgaccactacg

SEQ ID NO: 182290 - DNA, 513 bp, Homo sapiens
  misc_feature: GYAE6OF02H009I.22.14.B03.1.454.CMB.1.raw
  modified_base (296)..(296): a, c, t, g, unknown or other
  misc_feature (296)..(296): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (402)..(402): a, c, t, g, unknown or other
  misc_feature (402)..(402): n is a, c, g, or t
  modified_base (430)..(430): a, c, t, g, unknown or other
  misc_feature (430)..(430): n is a, c, g, or t
  modified_base (436)..(436): a, c, t, g, unknown or other
  misc_feature (436)..(436): n is a, c, g, or t
tcagacatacgcgtcacgaccggtgctcgatttagtgtgagtagttccgcggggaggctacaacaggcaggcagggcgagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtatttttacagctccaccataagagctacttagcttggttccagcagaaaccaggacatcctcctctacngctcattttactgggcgtctacccgggaatccggggtccctgaccgnttcagtgcagcggtctgggacngatttcatctcaccatcagcagcctgcaggctgaagntcgtggcagtttatactgtacagcaatnttaatnttcctctcagacgttcgcctaagggcctaaagggtgaaaacttcgaaacgaacgtggtaggtacctgccgactaacg

SEQ ID NO: 182291 - DNA, 320 bp, Homo sapiens
  misc_feature: GYAE6OF02IFA2U.22.14.B03.1.454.CMB.1.raw
  modified_base (317)..(320): a, c, t, g, unknown or other
  misc_feature (317)..(320): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctgggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcatagnnnn

SEQ ID NO: 182292 - DNA, 555 bp, Homo sapiens
  misc_feature: GYAE6OF02JA109.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctaccgggaatccggggtcctgaccgattcagtcggcaggcggtcgtgggacagtactttcactctaccacctatacagtcacgcctgcaggcctagaacgatggtcggcttaagtttattagttgtacacgtactaattattattacttccctacctacacgtaccggttcgaccgtaacgggaacctaagggtacgtaaactacgaaacgtactggtacgtcgtacgacacctaacg

SEQ ID NO: 182293 - DNA, 603 bp, Homo sapiens
  misc_feature: GYAE6OF02HKNA5.22.14.B03.1.454.CMB.1.raw
  modified_base (455)..(455): a, c, t, g, unknown or other
  misc_feature (455)..(455): n is a, c, g, or t
  modified_base (468)..(468): a, c, t, g, unknown or other
  misc_feature (468)..(468): n is a, c, g, or t
tcagacatacgcgtcacgaccggtgctcgatttagtgtgagtagttccgcgggggacgaacctacaaccacggtcgaggacacggggcagcaagatggtcgttgccagacccgaggtcgttccagtttctctgttgtcttctgggatctctaggtagccgtacggggaccattcgtggtatggacccaggtctccagacgtccctggctgtgtctcgtgggcgaggacgggccaccatcgaactcgcaagtccagtccaggtaagttacttttttacagtctccgaccaataagaggttacttagcttggttcccaggcaaggaaacctaggacagtcgtccgtgcgactgctcatttactgggcgtctaccgggaatccggggtcctgaccgattcaagtcggcgagcgggtctgggacagtattcactctcaccatcagcacgcctgcaggcngaagagtgtcggntagtttattagttgtacagcaattagttattacttcctctcagtacgttcggaccgtaaagggtacccttaagggtacgtaaacgttaccgtaaacggtacgttacggtaggtaccgtacggaccgacccgtacg

SEQ ID NO: 182294 - DNA, 515 bp, Homo sapiens
  misc_feature: GYAE6OF02I1BA7.22.14.B03.1.454.CMB.1.raw
  modified_base (445)..(445): a, c, t, g, unknown or other
  misc_feature (445)..(445): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctaccgggaatccggggtcctgaccgattcagtgcagcgggtctgggacagatttcactctcaccatcagcagcctgcaggctgaagatgtggctagtttatactgtcagcaatattatattcctcctnagtacgttcggacctaagggaccaagggtacggaaattacgaaacgaacgttggtaggctacgcacctac

SEQ ID NO: 182295 - DNA, 507 bp, Homo sapiens
  misc_feature: GYAE6OF02FRF7U.22.14.B03.1.454.CMB.1.raw
  modified_base (495)..(495): a, c, t, g, unknown or other
  misc_feature (495)..(495): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtggcagcgggtctgggacagatttcactctcaccatcagcagcctgcaggctgaagatgtggctagtttattattgtcagcaattattatattcctcctcagacgttcggccaagggccaaggtggaaatcaaacgacgtggacgngtcaccactacg

SEQ ID NO: 182296 - DNA, 599 bp, Homo sapiens
  misc_feature: GYAE6OF02JVXV7.22.14.B03.1.454.CMB.1.raw
  modified_base (353)..(353): a, c, t, g, unknown or other
  misc_feature (353)..(353): n is a, c, g, or t
tcagacatacgcgtcacgaccggtgctcgatttagtgtgagtagttccgcgggggaggctacaacaggcaggcaggggcgagcaagatggtgttgcagacccaggtcttcatttctctgttgctctggatctctggtgcctacgggacattgtgatgacccagtctccagactccctggctgtgtctctggcgagagggccaccatcaactgcaagtccagccagagtatttttacagctccacaataagagttactagcttggttccagcagaaccaggacatcgcctgcactgctcatttactggctcgtacccggaatccggggcctgaccgattcagtggcagcgggtntgggacagtacttacactctcgaaccactcagcaagtcctgctaggctagaagatcgtggctagtttattagttgtacagtactaattaacgtttattaactttcccttaccgtacgtacgttaccggttacggtaacccggtaaacggggtaaccccgtaaagggttacggtaaaaaccttacggtaaaacccggttaacgtttacgggtacggttaccggtacgtaccgtaacccgttaaccgg

SEQ ID NO: 182297 - DNA, 503 bp, Homo sapiens
  misc_feature: GYAE6OF02II9E7.22.14.B03.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacngggctctacccgggaatccggggtcctgaccgattcagtgcagcgggtctgggacagntttcactctcaccatcagcagcctgcaggctgaagatgtggctagtttatattgtcagcaatattatatttcctctacagtacgttcggaccaagggaccaaaggtggaaatcaaaacgactggtgactgaccacta

SEQ ID NO: 182298 - DNA, 920 bp, Homo sapiens
  misc_feature: GYAE6OF02F90SQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatcctcgtggtcgccgtacgggactattgtgatcgacccagtctccagacctccgtggctgtcgtctcgtgggcgaggacgggccaccatacaacgtcgacgtaacgtccacgaccagtagttttactttttacgacgtcctacccaacctaaagtaaagtaacgtttaacttacgtcgtttcggttaccagtaccgaacgaaaccgtacggaactaacgttccgttccgtcggacctacgttcgtcctacttaacgttttaccgtcggggtccgttacccggtaaccccggggtaacggttccccgggggttacccctacggaacccggtacttaccgaggtcggaccgtacgggtccggggttacggtacggggtaaccgaggttaaccgttttaccgacctttccgttacccaaacccgttactaccgaacggtacccgtaaccggtccccgttcggaaccggtaacgggtacccgttaagggaaaacgggttacgtttacggggttaccgggttaaccgtttaaaggtttttttaacttttaacggttttccgggttaaccgtaaaccggttaaccgtttaaaatttttaacgtttttaaactttaccccgtttttcccccttaaaccccgtttacggtaaacccgggttttacccgggttttacccgggaaaccccggttaaaaccggggggtaaaccccttaaaagggggttaaccgtaaaacgttaacccggtaaaaaccggtacggtttacgggtacggtaccgtacgacccgtaaccgttaaccg

SEQ ID NO: 182299 - DNA, 501 bp, Homo sapiens
  misc_feature: GYAE6OF02FI1RA.22.14.B03.1.454.CMB.1.raw
  modified_base (444)..(444): a, c, t, g, unknown or other
  misc_feature (444)..(444): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggctctacccgggaatccgggtcctgaccgattcagtggcagcgggtctgggacagatttcactctcaccatcagcagcctgcaggctgaagatgtgctagtttatactgtcagacaattattatattcctctnagtacgttcgaccaagggaccaagggtgaaactcaaagactgtaggctgaccactac

SEQ ID NO: 182300 - DNA, 297 bp, Homo sapiens
  misc_feature: GYAE6OF02HIWBY.22.14.B03.1.454.CMB.1.raw
  modified_base (289)..(297): a, c, t, g, unknown or other
  misc_feature (289)..(297): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccatctgtcttcatcttcccgcatctgaacgcgtatgtctgagcgggctggcaaggcgcatagnnnnnnnnn

SEQ ID NO: 182301 - DNA, 566 bp, Homo sapiens
  misc_feature: GYAE6OF02GI8DU.22.14.B03.1.454.CMB.1.raw
  modified_base (416)..(416): a, c, t, g, unknown or other
  misc_feature (416)..(416): n is a, c, g, or t
  modified_base (467)..(467): a, c, t, g, unknown or other
  misc_feature (467)..(467): n is a, c, g, or t
tcagacatacgcgtcacgaccggtgctcgatttagtgtgagtagttccgcgggggagctacaacaggcaggcaggggcagcaagatggtgttgcagacccagatcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttacgtgggcgtcgtacccgggaatcccggggtccctgaccgattaaggtggcaggcgggtcgtgggacagtatttcactctcaccatcagcacgcctgcaggctagaagntggtgctagtttattagttgtcagtactaattattattacttcctacctanacgttaccgttcggaccgtaaggggaccctaaagggtacggtaaaactaccgtaaaaccggtacgttcggtacgggtacctacggacccaacccgtacg

SEQ ID NO: 182302 - DNA, 534 bp, Homo sapiens
  misc_feature: GYAE6OF02JLCO7.22.14.B03.1.454.CMB.1.raw
  modified_base (296)..(296): a, c, t, g, unknown or other
  misc_feature (296)..(296): n is a, c, g, or t
  modified_base (411)..(411): a, c, t, g, unknown or other
  misc_feature (411)..(411): n is a, c, g, or t
tcagacatacgcgtcacgaccggtgctcgatttagtgtgagtagttccgcgggggaggcgtacaacaggcaggcaggggcgagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctccaccaataagagttacttagctttaggttccagcagaaaccaggacatcgtcngcactgctcatttactgggactctacccgggaatcccggggcctgaccgattcagtggcagcgggtctggggactagatttcactctcacctatcagcagcctgcaggctgaagntgtggcttagtttattattgtcagtctaagttatttataatttccctactctagtaccgttcggaccgaggtaaccaaggtacgaattacgaaacgtaactggtacgcgtacgcgaaccctag

SEQ ID NO: 182303 - DNA, 510 bp, Homo sapiens
  misc_feature: GYAE6OF02GXB2P.22.14.B03.1.454.CMB.1.raw
  modified_base (449)..(449): a, c, t, g, unknown or other
  misc_feature (449)..(449): n is a, c, g, or t
tcagacatacgcgtcacgaccggtgctcgatttagtgtgagtagttccgcggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtgcagcgggtctgggacagatttcactctcaccatcagcagcctgcaggctgaagatggtggctagtttattattgtcagcaattattatatttcctcctnagtacgttcggaccaaggggtacccaaggtaggaaatcgaaacgactggtgctgcacctac

SEQ ID NO: 182304 - DNA, 518 bp, Homo sapiens
  misc_feature: GYAE6OF02IBS3Y.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtggcagcgggtctgggacaggattcactctcaccatcagcagcctgcaggctagaagatgtggctagtttatattgtcagcaatattatatttcctcctcagtacgttcggaccgtaagggaccaaaggtcggaaattcgaaacgtactaggtacggctagacacctacg

SEQ ID NO: 182305 - DNA, 323 bp, Homo sapiens
  misc_feature: GYAE6OF02IJ5WT.22.14.B03.1.454.CMB.1.raw
  modified_base (314)..(323): a, c, t, g, unknown or other
  misc_feature (314)..(323): n is a, c, g, or t
tcagacatacgcgtcacgaccggtgctcgatttagtgtgagtagttccgcgggcaaatccacgaccacagtgtacatgtcgctgagcagcctgagatctgaggacacggccgtttattattgtgttatgggtgagcatccggcggcctgggggccagggaaccctggtcaccgtctcctcagcctccaccaagggcccatcggtcttcccctggcgccctgctccaggagcacctccgagagcacagcggccctgggctgcctggtcaaggactacgttccagcgtatgtctgagcggctggcaagcgcatagnnnnnnnnnn

SEQ ID NO: 182306 - DNA, 522 bp, Homo sapiens
  misc_feature: GYAE6OF02JAWCK.22.14.B03.1.454.CMB.1.raw
  modified_base (443)..(443): a, c, t, g, unknown or other
  misc_feature (443)..(443): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctaccgggatccgggtcctgaccgattcagtggcagcgggtctgggacagtattcactctcaccatcagcagcctgcaggctgaagatgtggctagtttatattgtcagctaatattatacttcctctnacgtacgttcggaccaagggtaccctaagggtcggaaaattccgaaaacggtacttcggtaggactcgaccaccgtacg

SEQ ID NO: 182307 - DNA, 499 bp, Homo sapiens
  misc_feature: GYAE6OF02GFK5X.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtggcagcggtctgggacagatttcactctcaccatcagcagcctgcaggctgaagatgtggctagtttattattgtcagcaatattaatattcctctcagtcgttcggacaagggaccaaggtagaaatcaaacgactgtggctgcacta

SEQ ID NO: 182308 - DNA, 532 bp, Homo sapiens
  misc_feature: GYAE6OF02F3D37.22.14.B03.1.454.CMB.1.raw
  modified_base (409)..(409): a, c, t, g, unknown or other
  misc_feature (409)..(409): n is a, c, g, or t
  modified_base (431)..(431): a, c, t, g, unknown or other
  misc_feature (431)..(431): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcaggcgggtctgggacagatttcactctcaccatcagcagtccctgcaggctgaagntgtggactagtttattattgtnagactaattattattattcctaccttcagtaccgttcggaccgtaagggacctaagggtacgaaacttcgaaacgtaactcggtaggactcggacacgtac

SEQ ID NO: 182309 - DNA, 525 bp, Homo sapiens
  misc_feature: GYAE6OF02JJRFU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccgggaatccggggtcctgaccgattcagtggcagcggtctgggacagatttcactctcaccatcagcagcctgcaggctagaagatgtggctagttttatattgtcagtacaattattattacttccctctctacgtacgttcggaccgaagggtacccaaggtacggaaataccgaaacgacttggtacgctacgaccacctacg

SEQ ID NO: 182310 - DNA, 498 bp, Homo sapiens
  misc_feature: GYAE6OF02IBCYM.22.14.B03.1.454.CMB.1.raw
  modified_base (447)..(447): a, c, t, g, unknown or other
  misc_feature (447)..(447): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatcccggggtccctgaccgattcagtggcagcgggtctgggacagatttcactctcaccatcagcagcctgcaggctgaagatgtggctagtttattatgtcagcaatattatattcctctnagcgttcggaccaagggccaaggtgaaatcaaacgactgtggctgaccaca

SEQ ID NO: 182311 - DNA, 493 bp, Homo sapiens
  misc_feature: GYAE6OF02GCS90.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccgggaatccgggtcctgaccgattcagtgcagcggtctgggacagattcactctcaccatcagcagcctgcaggctgaagatgtgcagtttatatgtcagcaatattatattcctctcagacgttcgaccaagggccaaggtcgaaatcaaacgacgtgtagactgacactacg

SEQ ID NO: 182312 - DNA, 534 bp, Homo sapiens
  misc_feature: GYAE6OF02GDNZT.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctctcagtaccgttcggaccaagggtaccaagggttacggaaaacttccgaaaacggaacttaggtagggtacctaggaccgtacctaacg

SEQ ID NO: 182313 - DNA, 502 bp, Homo sapiens
  misc_feature: GYAE6OF02IEQHQ.22.14.B03.1.454.CMB.1.raw
  modified_base (281)..(281): a, c, t, g, unknown or other
  misc_feature (281)..(281): n is a, c, g, or t
  modified_base (407)..(407): a, c, t, g, unknown or other
  misc_feature (407)..(407): n is a, c, g, or t
  modified_base (439)..(439): a, c, t, g, unknown or other
  misc_feature (439)..(439): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccnggacatcgtcctgcactgctcatttactgggcgtctacccgggaatccggggtccctgaccgattcagtggcagcggtctgggacagatttcactctcaccatcagcagctgcaggctgaagatgngcagtttatattgtcagcaatattatattccnctcagacttcggaccaagggaccaaggtggaaatcaaaacgactgtaggtcgtgcacccgtaa

SEQ ID NO: 182314 - DNA, 521 bp, Homo sapiens
  misc_feature: GYAE6OF02F9FBH.22.14.B03.1.454.CMB.1.raw
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggcgtctacccgggaatccggggtccctgaccgattcagtggcagcgggtctgggacagatttcactctcaccatcagcagcctgcaggctgaagntgtggctagtttatattgtcagtactaattattatattcctctcagtacgttcgaccgtaagggacccaagggtacggaaatcgaaaacgtactggtacggctacgccacctacg

SEQ ID NO: 182315 - DNA, 518 bp, Homo sapiens
  misc_feature: GYAE6OF02HZZSO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagtatttttacagctcaccaataagagttacttagcttggttccagcagaaaccaggacatcgtcctgcactgctcatttactggctctacccgggaatccggggtcctgaccgattcagtggcagcggtctgggacagatttcactctcacatcagcagcctgcaggctagaagatgtgctagtttatattgtcagtactaatattatactttcctactctagtacgttcggacctaagggacctaaggtagaaattacgaaacgtacgtggtacggtactacgaccactacg

SEQ ID NO: 182316 - DNA, 536 bp, Homo sapiens
  misc_feature: GYAE6OF02G2K79.22.14.B03.1.454.CMB.1.raw
  modified_base (308)..(308): a, c, t, g, unknown or other
  misc_feature (308)..(308): n is a, c, g, or t
  modified_base (405)..(405): a, c, t, g, unknown or other
  misc_feature (405)..(405): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgcactgctcatttacnggcgtctacccgggaatccggggtccctgaccgattcagtggcagcggtctgggacagatttcactctcaccatcagcagcctgcaggctagaagtntgtggactagtttattagttgtacagtactaaattatttaattattccctcctacagtaccgttcggaccgaacgggtaccaaggtacggaaataccgaaacgtaacgtcggtagcgtagaccaacctacg

SEQ ID NO: 182317 - DNA, 527 bp, Homo sapiens
  misc_feature: GYAE6OF02JKRU9.22.14.B03.1.454.CMB.1.raw
  modified_base (282)..(282): a, c, t, g, unknown or other
  misc_feature (282)..(282): n is a, c, g, or t
  modified_base (309)..(309): a, c, t, g, unknown or other
  misc_feature (309)..(309): n is a, c, g, or t
  modified_base (414)..(414): a, c, t, g, unknown or other
  misc_feature (414)..(414): n is a, c, g, or t
  modified_base (461)..(461): a, c, t, g, unknown or other
  misc_feature (461)..(461): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttaagcttggttccatcagaaaccnggacatcgcctgcactgctcatttacnggcgtctacccgggaatccgggtccctgacccgattcgaggtcggcagcgggtctaggggactaggatttcactctcaccatcagccagcctgcaggctagaagntagtgctagtttatagttgtacagtcaattattactacttcctctanacgtcgttcgacgtaagggccaaaggtggaaactacgaaacgacttggacgtctgacctacctacg

SEQ ID NO: 182318 - DNA, 506 bp, Homo sapiens
  misc_feature: GYAE6OF02GZ10D.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagctaatattatattcctctcagtacgttcgaccaagggaccaaggtgaaatacaacgtactggtagctagccactac

SEQ ID NO: 182319 - DNA, 514 bp, Homo sapiens
  misc_feature: GYAE6OF02G2KR7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcctcctctactgctcatttactgggcgtctacccgggaatccggggtccctgaccgattcagtggcagcggtctgggacagatttcactctcaccatcagcagcctgcaggctagaagatgtggctagtttattactgtcagcaatattatattcctctcagtacgttcgaccaagggacctaagggtacgaaatcgaaacgtactaggtcgctagactaccatccg

SEQ ID NO: 182320 - DNA, 547 bp, Homo sapiens
  misc_feature: GYAE6OF02IOEDX.22.14.B03.1.454.CMB.1.raw
  modified_base (444)..(444): a, c, t, g, unknown or other
  misc_feature (444)..(444): n is a, c, g, or t
  modified_base (448)..(448): a, c, t, g, unknown or other
  misc_feature (448)..(448): n is a, c, g, or t
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
tcagacatacgcgtcacgaccggtgctcgatttagtgtgagtagttccgcgggggggagctacaaccaacggcgaggcaggggcagcgaagatggtggttcgcagacccaggtcttccagtttctctgttgctctgagtctctggtgcctacgggacattgtgatgacccagtctccacgactccctggctcgtcgtctctgggcgagaggccaccgatcaactagcaacgtccagcctagacggtatttttaacagcgtaccaacctaaataaagagttacttagcttaggttccagcagaaaccaggaaccagtacgtcctagcactgcctcatttactgggctctaaccgggtaataccggggtccgtcgaccgattactagtggcgaagcggggtctgggacgacgagtttctacttctcacatcagcagcctgcaggcngaanatgtgcagttatattgtacagnaatattaatattccnctcagtacgtcggacgaacggaacaaggtagaaatcaaaacgacgtagtaggcgtgcacaac

SEQ ID NO: 182321 - DNA, 578 bp, Homo sapiens
  misc_feature: GYAE6OF02G72Z0.22.14.B03.1.454.CMB.1.raw
  modified_base (403)..(403): a, c, t, g, unknown or other
  misc_feature (403)..(403): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagattacttagcttggttccagcagaaaccaggacatcgtcctgcactgctcatttactggcgtctacccgggaatccggggtcctgaccgattcagtgcagcggtctgggacagatttcactctcaccatcagcagctgcagctgagatgtgntagtttatattgtctagtactaagttatttagtaactttccctaccgtactaacgtaccgtttacggacccgtaaacggggtaaccctaaagggttaacgggtaaaacttaccgtaaaaaccggtaaaccgtttcgggttaacgggtaccttacgggtaccctaacccgttaacg

SEQ ID NO: 182322 - DNA, 844 bp, Homo sapiens
  misc_feature: GYAE6OF02FSA4T.22.14.B03.1.454.CMB.1.raw
tcagacatacgcgtcacgaccggtgctcgatttagtgtgagtagttccggcggggtagggctacaacacggcaggcgagggcagcaaggatggtgttggccagacccaggtcttcagttctctgttgctctggagtctcctgggttgcctacggggacattgtgatggaccctaggtcctccacgtaccttccccttcggcttcgttcgttctcgttggggcgagagggccaccactcaactgtcaacggtccagccaggtacgtttactttttacagtcttccacctaagttaacgaacgttaaacggttagacgttccggtttaccgacgtccgtacgtaaacctacgggtacaactcggtacccttggacgtacgtacggtcccgtacctaagttttaccgaggggtccgttccgtaaccccggggtaacgttaccggggggtccccgttgggaccccggtaagttccgaacggttcgggtaccacggtacggggttacgtcggggtaacctagggtacgttttccaacgttacgtaccgtaaccgtagtaccctaagtaccttacggtcccgttagaccgtaacgggtaccttaggtaaaacggtgttacgggttcgggtacccttaagtttttaacgttttcggttaccggtaacgggtaacgtaccgtaaatttaacgtttaaacttaacgtttaacccgtaccgttcgtaacggtaccgttttccgggaaccctaacggggtaacctaaggggttacgggtaaaacctttaccggtaaaaccggttaaccgtttccggttaacgggaccctttacggtacccgtaaccgtttaaccg

SEQ ID NO: 182323 - DNA, 537 bp, Homo sapiens
  misc_feature: GYAE6OF02IAWZ6.22.14.B03.1.454.CMB.1.raw
  modified_base (419)..(419): a, c, t, g, unknown or other
  misc_feature (419)..(419): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacgtgggcgtccgtacccgggaacgtccggggtccctggacccgattcagtggcgaggcgggtcgtgggacagtactttcactcctcaccatcagcagcctgcaggctgaagntgtgctagtttattattgcagactaatattatacttcctcctcagtaccgttcgaccgtaagggaccaagggtagaaactcgaaaacgtacgtaggtacggtcctaggaccacctacg

SEQ ID NO: 182324 - DNA, 572 bp, Homo sapiens
  misc_feature: GYAE6OF02FZIPG.22.14.B03.1.454.CMB.1.raw
  modified_base (309)..(309): a, c, t, g, unknown or other
  misc_feature (309)..(309): n is a, c, g, or t
  modified_base (444)..(444): a, c, t, g, unknown or other
  misc_feature (444)..(444): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggctctaccgggaatccgggtcctgaccgattcagtggcaggcgggtctgggacaggtatttcgactctcaccatcagcagcctgcaggctagaagatgtggctagtttacttagtttgtacagtacaaagttntttaagttactttcccttaccttacgacgttaaccggtttccggacccgtaaaggggtaccccgaaagggttacggaaaattacccgaaaacggtaccttagggtacggtacctggaccaccttaacg

SEQ ID NO: 182325 - DNA, 530 bp, Homo sapiens
  misc_feature: GYAE6OF02GZ65K.22.14.B03.1.454.CMB.1.raw
  modified_base (406)..(406): a, c, t, g, unknown or other
  misc_feature (406)..(406): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgtggctagtttattattgtcagtctaaattattatacttcctcctacagtacgttcggacctaagggaacctaagggtacggaaataccgaaacgtaacttggtacggacctgaccacctacg

SEQ ID NO: 182326 - DNA, 317 bp, Homo sapiens
  misc_feature: GYAE6OF02G65KW.22.14.B03.1.454.CMB.1.raw
  modified_base (311)..(317): a, c, t, g, unknown or other
  misc_feature (311)..(317): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacagccggccctgggctgcctggtcaaggatccacgcgtatgtctgagcgggctggcaaggcgcatagnnnnnnn

SEQ ID NO: 182327 - DNA, 512 bp, Homo sapiens
  misc_feature: GYAE6OF02F1CPX.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtccctgaccgattcagtggcagcggtctgggacagatttcactctcaccatcagcagcctgcaggctgaagatgtggcagtttatattgtcagcaattattatattccctctcagtacgttcgaccaagggaccaagggtggaaactcgaaaacgacttggtacggctgaccacctacg

SEQ ID NO: 182328 - DNA, 321 bp, Homo sapiens; identical to SEQ ID NO: 181989
  misc_feature: GYAE6OF02IGYQF.22.14.B03.1.454.CMB.1.raw
  modified_base (316)..(321): a, c, t, g, unknown or other
  misc_feature (316)..(321): n is a, c, g, or t

SEQ ID NO: 182329 - DNA, 604 bp, Homo sapiens
  misc_feature: GYAE6OF02GK47W.22.14.B03.1.454.CMB.1.raw
tcagacatacgcgtcacgaccggtgctcgatttagtgtgagtagttccgcgggggaggctacaacaggcaggcaggggcgagcaagatggtgttgcagacccaggtcttcatttctctgttgctctggatctctggtgcctacggggacattgtgatgacccagtctccagactccctggctgtgtctctgggcgagagggccaccatcaaactgcaagtccagccagagttattttttacagctccaccaaactaagagttacttagcttggttccagcagaaaccaggacatcgtcctgcactgctcatttactgggtctctaacccgggataccgggtcctgaccgtattcagtggcagcgggtctcgggtacagtatttcgacctctccacatcagcagcctgcaggctagaacgagtgtagggcctaggtttttattagttcgtcgaagtcaaacttatttaacgttattccccttacttaccgaagtacccggtttacggacccgtaaaggggtaaccccgaagggttaaacggaaaacgttaccgaaaaacccggtaagtttcggtacgggtactaccgtaaccgaacccttaacgg

SEQ ID NO: 182330 - DNA, 536 bp, Homo sapiens
  misc_feature: GYAE6OF02FYMM7.22.14.B03.1.454.CMB.1.raw
  modified_base (411)..(411): a, c, t, g, unknown or other
  misc_feature (411)..(411): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtcgtacccgggaatccggggtccctgaccgattcagtggcaggcgggtctgggacagactttcactctcaccatcagcagcctgcaggctgaagntgtcgactagttttatattgtcagactaattattattattcctctcagtaccgttcggacctaagggccctaagggtacgaaacttaccaaacggtactagggtacgacgtacggacctactacg

SEQ ID NO: 182331 - DNA, 532 bp, Homo sapiens
  misc_feature: GYAE6OF02HTTDU.22.14.B03.1.454.CMB.1.raw
  modified_base (439)..(439): a, c, t, g, unknown or other
  misc_feature (439)..(439): n is a, c, g, or t
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccacaataagagttacttagcttggttccagcagaaaccaggacatcgtcctgcactgctcatttactgggcgtctacccgggaatccgggtcctgaccgattcagtggcagcggtctgggacagatttcactctcaccatcagcacgcctgctaggctagaagagtgtggcttagtttatatttgtacagtcaattnttaagtntttccctcctcgtagtaccgttcggccgtaacgggacctaagggtagaaattaccgaaacgtaactggtacgctacgccacctacg

SEQ ID NO: 182332 - DNA, 612 bp, Homo sapiens
  misc_feature: GYAE6OF02JDBC4.22.14.B03.1.454.CMB.1.raw
  modified_base (224)..(224): a, c, t, g, unknown or other
  misc_feature (224)..(224): n is a, c, g, or t
  modified_base (264)..(264): a, c, t, g, unknown or other
  misc_feature (264)..(264): n is a, c, g, or t
tcagacatacgcgtcacgaccggtgctcgatttagtgtgagtagttccgcgggggaggctacaacaggcaggcaggggcgagcaagatggtgttgcagacccaggtcttcatttctctgttgctctggatctctggtgcctacggggacattgtgatgacccagtctccagactccctggctgtgtctctgggcgagagggccaccgatcaactgcaagtccanccagagttatttttacagctccaccaataagattactaancttggttccagtcagaaaccaggaacatcgtacctgcactgctacattacctggccgttctaccccgggtaatcccggggtccctggaccgattcagtggtacagtacgggtctaggggactaaggtactttccgactcgtaccaacctatcaacgctaacgcccttggacagggcctagaacgtataggtgaccgttaagttttaacttgttgttacgaggtactaacgttaatttactactttcctaccgtactagtaccgttaccggacgtaacgggtaacctaagggttagaaaacgttaccgtaaacgaacgttggtacgtaaccgtcgtaacctaacccgtg

SEQ ID NO: 182333 - DNA, 549 bp, Homo sapiens
  misc_feature: GYAE6OF02I0KCU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactggcgtctacccgggaatcccggggtcctgaccgattcgagtggcagcgggtctggggacagactttcactctcaccactcagcagccctgcaggctgaagtatggtggactagttttactactgtacagactaattatttatactttcctccttacaggtaccgttcggaccgaacgggtaccgtaaaggtcggtaaaataccgaaacgtaacttggtacggcgtacgaccacctaacg

SEQ ID NO: 182334 - DNA, 514 bp, Homo sapiens
  misc_feature: GYAE6OF02GQ5AT.22.14.B03.1.454.CMB.1.raw
  modified_base (401)..(401): a, c, t, g, unknown or other
  misc_feature (401)..(401): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggtccagcagaaaccaggacatcctcctctactgctcatttactgggctctaccgggaatccggggtcctgaccgatcagtgcgagcggtctgggacagattcactctcaccatcagcacgcctgcaggctgaagntgtgctagtttatactgtacagactaagttattattacttcctcctactagtaccgttcggacaacgggacctaagggtagaaatacaaacgactggtcgctcgaccactacg

SEQ ID NO: 182335 - DNA, 560 bp, Homo sapiens
  misc_feature: GYAE6OF02IL070.22.14.B03.1.454.CMB.1.raw
  modified_base (451)..(451): a, c, t, g, unknown or other
  misc_feature (451)..(451): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtggcagcgggtctgggacaggtatttcactcctacaccatcagcagcctgcaggctagaagatggtggactagttttattagtttgtcgtagactaaattanaattttttttttacacccttcctacgtagtaccgttcggaccgtaacgggaaccgaaggttaggaaactacgaaacgtacgttacggtaggacgtacgccaccgtaccg

SEQ ID NO: 182336 - DNA, 544 bp, Homo sapiens
  misc_feature: GYAE6OF02HU6BG.22.14.B03.1.454.CMB.1.raw
  modified_base (366)..(366): a, c, t, g, unknown or other
  misc_feature (366)..(366): n is a, c, g, or t
  modified_base (402)..(402): a, c, t, g, unknown or other
  misc_feature (402)..(402): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccggggtccctgaccgattcagtggcagcggtctgggacngatttcactctcacatcagcagcctgcagctgaagntgtggctagtttatactgtcagctaatattatactttcctcctactacgtacgttcggaccgtaacgggtaaccctaagggtacggaaattaccgaaaacggtaacgttacggtacggtaccgttacgacctaaccgtaacg

SEQ ID NO: 182337 - DNA, 546 bp, Homo sapiens
  misc_feature: GYAE6OF02G53AS.22.14.B03.1.454.CMB.1.raw
  modified_base (410)..(410): a, c, t, g, unknown or other
  misc_feature (410)..(410): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggaatcccggggtccctgaccgattcgagtggcaggcgggtctgggacagatttcactctcaccatcagcagcctgcaggctgaagntgtgctagtttatattgtcagtcaattattattactttcctcctcgtacgaccgttcggaccgtaacgggaaccctaagggtacggaaactaccgtaaacggaacttcggtacggtacctaggaccgaaccgtacg

SEQ ID NO: 182338 - DNA, 519 bp, Homo sapiens
  misc_feature: GYAE6OF02GOH88.22.14.B03.1.454.CMB.1.raw
  modified_base (405)..(405): a, c, t, g, unknown or other
  misc_feature (405)..(405): n is a, c, g, or t
  modified_base (446)..(446): a, c, t, g, unknown or other
  misc_feature (446)..(446): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtctacccgggaatccggggtcctgaccgattcagtggcagcgggtctgggacagtatttcactctcaccatcagcagcctgcaggctgaagntgtgctagtttatattgtcagcaattattatacttcctctnacgtacgttcgaccgtaagggacctaagggtacggaaattacgaaacgtaacgtgtacggactgaccactacg

SEQ ID NO: 182339 - DNA, 526 bp, Homo sapiens
  misc_feature: GYAE6OF02F2X3T.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtcctgaccgattcagtggcagcgggtctgggacaggatttcactctcaccatcagcagcctgcaggctgaagatgtggctagtttattattgtcagactaaattattattacttcctcctcagacgttcggacctaacgggaccaagggtggaaatcgaaaacgactggtacggactacggaccacctaacg

SEQ ID NO: 182340 - DNA, 812 bp, Homo sapiens
  misc_feature: GYAE6OF02FH75Y.22.14.B03.1.454.CMB.1.raw
  modified_base (239)..(239): a, c, t, g, unknown or other
  misc_feature (239)..(239): n is a, c, g, or t
  modified_base (327)..(327): a, c, t, g, unknown or other
  misc_feature (327)..(327): n is a, c, g, or t
tcagacatacgcgtcacgaccggtgctcgatttagtgtgagtagttccggacgggggacgcctacaacctaggcgacggcagggcagctaagatggtgttagcctagaccccagggtccttacactttctctcgttggcctcgtggactcgtcttcggtgcctaccgggacagttgtgatcgaccccaggtcctccagacctccctcggctgtgtctcgtggcgagagggtccaccgancaacttgcagtccacgccagagtatttttacgacgctccgaccaataagagtttacttacgcgttggttacctaggtctacgaaaccnggacaacgttcgtcctagtcctaacgtgtccgtacctacggttttaacctaggggtccgttaacgtacccccggggtaaacttcccgggggtacccctaggtacccgtagtttccgaacggtcggtaccaggtccgggttctacggggaaccttacggtactttcctacctccgtaccacccgtatccgaacgccgtaacggtcccgtacggccgtacgggccgttacggaacggtacgttacgggttacggtaccgtagggtttttaactttacgtttacgggttaccaaggttaccctaaagtttaactttaactttaaacgttcccctttaacccttccgttaaccggttacccggtttccggggtaaccccgaaacgggggtaaaccccgtaaacggggtttacgggaaaaacgtttacccggaaaaaacccgttacgttacgggtaccgggtaccttacgggacctaaccccgtaaccgg

SEQ ID NO: 182341 - DNA, 499 bp, Homo sapiens
  misc_feature: GYAE6OF02GN3AU.22.14.B03.1.454.CMB.1.raw
  modified_base (309)..(309): a, c, t, g, unknown or other
  misc_feature (309)..(309): n is a, c, g, or t
  modified_base (400)..(400): a, c, t, g, unknown or other
  misc_feature (400)..(400): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacnggcgtctacccgggaatccgggtcctgaccgattcagtgcagcggtctgggacagatttcactctcacatcagcagcctgcaggctgaagntgtgctagtttatattgtcagactaatattatattccctctacagtacgttcgctaacgggccaaggtagaaatcaaacgtactggtagctgcactacg

SEQ ID NO: 182342 - DNA, 573 bp, Homo sapiens
  misc_feature: GYAE6OF02I5NAP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctcgtaccgggaatcccggggtcctgaccgattcagtcggcaggcgggtctgggacagtactttcactctcaccatcagcagcctgacaggctagaagatgtgctagtttattattgtactagtactaagttattatactttcctacctacgtaacgtacggttaccggaccgtaaaggggtaccctaaagggtaacggtaaaacttaccgtaaaaaccggtaacgttacggttacggtactacggtaccacccgttaacg

SEQ ID NO: 182343 - DNA, 571 bp, Homo sapiens
  misc_feature: GYAE6OF02HRVLX.22.14.B03.1.454.CMB.1.raw
  modified_base (415)..(415): a, c, t, g, unknown or other
  misc_feature (415)..(415): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggaatcccggggtccctgaccgattcgagtggcaggcgggtctgggacagtattcactctcaccatcaagcagcctgcaggctagaagatgnggactagtttattagttgtactagactaaattattacttactttccctctactacggtacgtttaccgggaccgtaaacggggaccctaaagggtacggaaaaacttaccgaaaaccgtaacgttacggtaggtacctacggaccctaccgtaacg

SEQ ID NO: 182344 - DNA, 625 bp, Homo sapiens
  misc_feature: GYAE6OF02JY9ZF.22.14.B03.1.454.CMB.1.raw
  modified_base (312)..(312): a, c, t, g, unknown or other
  misc_feature (312)..(312): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagtatttttacagctaccaccaataagagttacttagcttggttccagcagaaccaggacatcgtctgcactgactctatttacgngggtcgtcgtacccgggtaagtcccgggtccctgaccgtacgttcagtcgcgacggcgggtcgtgggactacggtatttccgacttccgtaccaccgtatccgaagtcgaacgtcccgtcgaccgtacggctacggaaagtacgttggtacggtaccttagttttatttacgttcgtacgaacgtactaaattagtttacttacgtttccctaccgttacacgggtaccgttaccggacctaacgggaacccgtaaggttacggaaacttaccgaaacggttacgttacggacgtacgtacgacctcctaacg

SEQ ID NO: 182345 - DNA, 565 bp, Homo sapiens
  misc_feature: GYAE6OF02HHDVL.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtctacccgggaatccggggtcctgaccgattcagtggcagcggtctgggacagatttcactctcaccatcagtcagcctgcaggctgaagatgtggctagtttatattgtcagtactaattaattattaacgtttccctaccttcgtaacgtaccggtttcggacccgtaaaggggaaccctaagggttaacggaaaacgttaccgaaaaccgtaacgttggtaccggacttacggacctaacccgtaacg

SEQ ID NO: 182346 - DNA, 811 bp, Homo sapiens
  misc_feature: GYAE6OF02H7Y5L.22.14.B03.1.454.CMB.1.raw
tcagacatacgcgtcacgaccggtgctcgatttagtgtgagtagttccgcgggggagctacaacaggcaggcacggggcacgcgaagtatggtgtttgctaggacccaggtcttcatttctctgtgctctgactctcgtggttgccgtacgggacagttgtgttattcgacccgtagttccttaaccgacggtacctcccgtggtcgtggtcgtcttcgtgggcgaggacgggccacgtaggtccaacgtgacaacgtccgaggccagacgttatttttaccgagtcctccgaacctaagtaacgtagtttaacgttagtccgtttcggttcccgagtacaaacgtaaaccgacggaactagtccgtaccgtcgaccacgtcggaccttcgtaagttttacggcgggtaccgtaccggtaaccgggtacgttcccggggtacctacggtaaccgtagtttaccgagggtcggacgtacggtaccgggttacgtcgggaactacgttaacgtttcccgacgtttccgtacccacgtacgtacccgtaaagtcccgtaacgcccgttagacccgttaaggtacccgtaaaaggaaaccgtagttcgggtacggtaacttttaacgtttataacgttagttaaccgaaacggtacctttaaaacgtttacgttaaccgtttaacctttcccccggtaaactaccggttaacggtacccggttttacccggaacggtaaccgggtaaccgttaaaggtacggtaaaacccttaacgaaacgttacgtggaccgttacgacgaccgtacttaacgg

SEQ ID NO: 182347 - DNA, 574 bp, Homo sapiens
  misc_feature: GYAE6OF02INWVI.22.14.B03.1.454.CMB.1.raw
  modified_base (310)..(310): a, c, t, g, unknown or other
  misc_feature (310)..(310): n is a, c, g, or t
  modified_base (336)..(336): a, c, t, g, unknown or other
  misc_feature (336)..(336): n is a, c, g, or t
  modified_base (403)..(403): a, c, t, g, unknown or other
  misc_feature (403)..(403): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttacnggcgtctaccgggaatccggggtccngaccgattcagtgcagcgggtctgggacagatttcactctcaccatacagcagcctgcagctgaagntgtggctaagttttatattgacaggtacaaattatttaactactttccctccgttacaagggttaccgtttccgggaccctaaaagggggacccctaaaaggggttagtaaaaacttacccgaaaaaacggtacgtttagggtacgggccttacgggaccaacccgtaacg

SEQ ID NO: 182348 - DNA, 553 bp, Homo sapiens
  misc_feature: GYAE6OF02G9PAP.22.14.B03.1.454.CMB.1.raw
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctctatttacgtgggcgtcgtacccgggaatcccggggtcctgaccgattcagtggcagcgggtctgggacaggtatttcactctcaccatcagcagcctgcaggctagaagntgtgctagtttatattntcgagactaattattatacttcctcctacgtacgtaccgttcggaccgaaacggggtaccaaagggttacggtaaaacttaccgaaaacggtacgttaggtacggtctacggaccacccttacg

SEQ ID NO: 182349 - DNA, 530 bp, Homo sapiens
  misc_feature: GYAE6OF02FUH5V.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtgctagtttatactgtcagcaatattatattcctcctcagtaccgttcggacctaagggaccaagggtacgaaacttaccgaaaacggtaaccttggtacggtctacggacctacctaacg

SEQ ID NO: 182350 - DNA, 723 bp, Homo sapiens
  misc_feature: GYAE6OF02IC2V3.22.14.B03.1.454.CMB.1.raw
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
tcagacatacgcgtcacgaccggtgctcgatttagtgtgagtagttccgcggggagctacgaacaggcaggcaggggcagcaagatggtgttgcagacccaggtcttcatttctctgttgctctggactctctggtgccgtacggggacattgtgatcgacccagtctccagacctccctggctgtgtctcgtagggcgacggacgggcccaccataccaaacgtgacaaacgtccaggccaagagttaattttttaccgaggtctaccaaccaaataaagtagttaacttagcgttgttccagcaagaaccaggactatcgtcctgctaactgctcatttcgnggctcgtaccggagtccgggtcctgaccgtnttacgagtcggcaggcggtctcgggactagtctttaccacgttcctaccactacgtaccgagacgtacgtccgtgacgtacggtacgtagaaagtacgtggtacggtaccttaagttttaacttacgtttaggtaccgtaacggttaacctaaacgttttaacgtttacgttaaaccgtttcccgttaaaccgtaccgttaaacggttacccggttaccggtaaccggtaaacggggtaaacccgtaaaggggttaaaccggtaaaaccgtttaaaccgaaaacccggttaacggttaccgggttaaccgggtaccgtttaccggtaccccgtaaccgtttaacccgg

SEQ ID NO: 182351 - DNA, 526 bp, Homo sapiens
  misc_feature: GYAE6OF02IRE13.22.14.B03.1.454.CMB.1.raw
  modified_base (402)..(402): a, c, t, g, unknown or other
  misc_feature (402)..(402): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagctacttagcttggttccagcagaaaccaggacatcctcctctactgctcatttactgggctctacccggaatcccgggtcctgaccgatcagtgcagcggtctgggacagtattcactctcaccatcacgcacgcctgcaggctgaagntgtggctagtttatagttgcagactaatatttatactttcctcctctagtacgttccgacgaacgggtacctaaaggtaggaaactacgaaaaccgtactggttacggcgtacgtaccactacg

SEQ ID NO: 182352 - DNA, 572 bp, Homo sapiens
  misc_feature: GYAE6OF02I4C0N.22.14.B03.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtctgcactgctnatttactggcgtctaccgggaatccggggtccctgaccgattcagtggcagcggtctgggacagtatttcgactcgtacaccatcagcagccctgcaggctagaagatgtggctaagttttatattgtacagctaaagttatttatactttccctacctcaagtaccgtttcgggaccctaaaggggtaccccaaaggggttgaaaaacgttccgaaaaacccggtaaacgttcgggttacgggaccttacgggtaccctaaccccgtaag

SEQ ID NO: 182353 - DNA, 552 bp, Homo sapiens
  misc_feature: GYAE6OF02HUUM2.22.14.B03.1.454.CMB.1.raw
  modified_base (406)..(406): a, c, t, g, unknown or other
  misc_feature (406)..(406): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactacaagtccagccagagtatttttacagctccaccaataagagttacttagcttggttccagcagaaaccaggacatcgtcctgcactgctctatttactgggcgtcgtaccgggaatccggggtccctgaccgtatcagtggcagcgggtctgggacagattcactctcaccatcagcagcctgcaggctgaagngttgtggcttagtttattattgtacagtactaattatttatactttccctactcaagtacgttcggaccgtaaggggacccaagggtacggaaactaccgaaaaccggtacttcggtacggtacctacggacctaccgtattaccg

SEQ ID NO: 182354 - DNA, 562 bp, Homo sapiens
  misc_feature: GYAE6OF02J0Q73.22.14.B03.1.454.CMB.1.raw
  modified_base (381)..(381): a, c, t, g, unknown or other
  misc_feature (381)..(381): n is a, c, g, or t
  modified_base (384)..(384): a, c, t, g, unknown or other
  misc_feature (384)..(384): n is a, c, g, or t
  modified_base (405)..(405): a, c, t, g, unknown or other
  misc_feature (405)..(405): n is a, c, g, or t
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaacgtgcaagtccagccagagtatttttacagctacaccaatagagttactagcttggttccagcagaaccaggacatcgtctgcactgctctattactgggctcctaccgggaactccgggtcctgacgattcgagtgcagcggtctgggactagtacttcgactctacactancancacgctgcaggctgaagctgngctagtttatnttgctagtcaattacgttatacgttccctactactaagttaccggttacgaccggtaacgggtaacccggtaaggtacgggtaaaacttaccggaaaaccggtaacgttcgggtaaccgtcggtaacgtacccgttacccgtaacg

SEQ ID NO: 182355 - DNA, 546 bp, Homo sapiens
  misc_feature: GYAE6OF02HGZFT.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttactgggctctacccgggaatcccggggtcctgaccgattcagtggcagcgggtctgggacagatttcactctcaccatcagcagcctgcaggctagaagatgtggctagtttattagttgtcagctaaattatttatactttcctacctcacgtaccgttcggaccgaagggtaacccaagggttacggaaaactaccgaaaacgtaacgttaggtacggacctacggacctaactacg

SEQ ID NO: 182356 - DNA, 596 bp, Homo sapiens
  misc_feature: GYAE6OF02HI7PL.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaccaataagagttacttagcttggttccagcagaaaccaggacatcgtcctgcactgcctctactttacgtgggcgtcgtacccgggaatccggggtccctgaccgattcgagtcggcgaggtcgggtcgtcgggacagtatttcactctacaccatcagcagcctgcgtaggctaggaagtagtcggtcggacgttagttttataccggttgtcgaagtcgtaaattacgtttaattactttcccgtacctacgtacgtaccggtttaccggaccgtaaacggggtaacctaagggttaacgaaaacttaccgaaacgttacgacggttaggacgtccgtacctaccgtaacg

SEQ ID NO: 182357 - DNA, 527 bp, Homo sapiens
  misc_feature: GYAE6OF02G8S6M.22.14.B03.1.454.CMB.1.raw
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttctgggcgtctaccgggaatccgggtcctgaccgatcagtgcgagcggtctgggacagtatttcactctccaccatcagcagcctgcaggctgagatgtggctagtttatnttgtcagactatatttattacttccctactctagtaccgttcgaccgaacgggtacctaaggtaggaaactaccgaaaacgtactcggtacggctaggtaccaaccgtacg

SEQ ID NO: 182358 - DNA, 572 bp, Homo sapiens
  misc_feature: GYAE6OF02GQ7P1.22.14.B03.1.454.CMB.1.raw
  modified_base (312)..(312): a, c, t, g, unknown or other
  misc_feature (312)..(312): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagtctccaccaataagagttacttagcttggttccagtcagaaaccaggacatcgtcctgcactgctcatttacnggcgtctacccgggaatccgggtcctgaccgattcagtggcaggcggtcgtgggacagtatttcactctcaccatcagcacgcctgcaggctgaagatgtggactagtttattagttcgtcagtactaattacgttaatactttccctactctaacgtaccgtttccgggacccgtaaggggtaaccctaagggtacgtaaaacgtaccgtaaaaccgtaacgttcgggttaccggacgttacggaccgtaaccttaacg

SEQ ID NO: 182359 - DNA, 552 bp, Homo sapiens
  misc_feature: GYAE6OF02HQ563.22.14.B03.1.454.CMB.1.raw
  modified_base (344)..(344): a, c, t, g, unknown or other
  misc_feature (344)..(344): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggcgtcgtacccgggaagtccgggtccctgaccgntcagtggcagcggtctggacagatttcactctcaccatcagcagcctgcagctagagatggtcgctagtttatagttgctagcaatattattattccctctaccgtagtaccgtttaccgggacctaaacggggaccctaaaggggttacggaaaacttacgaaaaccgtaacgttagggtacggaccttacggaccctaacctaacg

SEQ ID NO: 182360 - DNA, 598 bp, Homo sapiens
  misc_feature: GYAE6OF02H7EFG.22.14.B03.1.454.CMB.1.raw
  modified_base (359)..(359): a, c, t, g, unknown or other
  misc_feature (359)..(359): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgtttgctctggatctctggtgcctacggggacattgtgatgacccagtctccagactccctggctgtgtctctgggcgagagggccaccatcaactgcaagtcagccagagtatttttacagctccaccaataacgagttacttagcttggttccagcagaaccaggacatcgtctgcactgctcatttactgggctcgtacccgggaatccggggtcctgaccgattcagtggcagcgggtntgggacagtactttcgactctacaccatcagcacgcctgcaggtctaggaatagtgtaggcttagttttatactggtcaaggtactaattattaacttaactttcccctcttaccgtaaggtaacccggtttccggaaccctaaagggggtacccctaaaaggggttacggtaaaaactttaacccgaaaacggtaaccgttacgggttacggccgtaacggtaccctaaccttaaccg

SEQ ID NO: 182361 - DNA, 568 bp, Homo sapiens
  misc_feature: GYAE6OF02G4DP9.22.14.B03.1.454.CMB.1.raw
  modified_base (407)..(407): a, c, t, g, unknown or other
  misc_feature (407)..(407): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttactggcgtcgtaccgggaatccggggtcctgaccgattcagtggcaggcggtcgtgggacagtattcactctcaccatcagcacgctgcaggctagaagntgtggactagttttatagttcgtactagactaaattattaattacgtttccctccgttaacgtagtacccggttacggacccgtaagggtaaccctaaagggtacggtaaaacctacgtaaaaccggacgttcggtaggaccttacgaccacccgttaacg

SEQ ID NO: 182362 - DNA, 543 bp, Homo sapiens
  misc_feature: GYAE6OF02ITIIV.22.14.B03.1.454.CMB.1.raw
  modified_base (348)..(348): a, c, t, g, unknown or other
  misc_feature (348)..(348): n is a, c, g, or t
  modified_base (414)..(414): a, c, t, g, unknown or other
  misc_feature (414)..(414): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagctttggttccagcaagaaaccaggacatcgtcctgcactgctcatttactgggcgtcctaccgggaatcccggggtcctgaccgnttcagtggcaggcgggtctgggacagatttcactctcaccatcagcagcctgcaggctgagatggngctagttttatattgtcagactaattattatactttcctacctacacgtaccgttccggaccgtaaacgggaccgtaaagggtacggaaatccgaaaacgtaacttcggtaggtctcgaccgacctacg

SEQ ID NO: 182363 - DNA, 320 bp, Homo sapiens
  misc_feature: GYAE6OF02HI9QH.22.14.B03.1.454.CMB.1.raw
  modified_base (315)..(320): a, c, t, g, unknown or other
  misc_feature (315)..(320): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttcccctggcgccctgctccaggagcacctccgagagcacagcggccctgggctgcctggtcaaggactacttccacgcgtatgtctgagcgggctggcaaggcgcatagnnnnnn

SEQ ID NO: 182364 - DNA, 542 bp, Homo sapiens
  misc_feature: GYAE6OF02IMQUK.22.14.B03.1.454.CMB.1.raw
  modified_base (409)..(409): a, c, t, g, unknown or other
  misc_feature (409)..(409): n is a, c, g, or t
  modified_base (414)..(414): a, c, t, g, unknown or other
  misc_feature (414)..(414): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctcttgtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttactggcgtctacccgggaatccggggtcctgaccgtattcagtggcagcgggtctgggacagtatttcactctacaccatcagcagcctgcaggctagaagnttggngtctagttttatagttgtcagtcaattagttatactttccctctacgagtaccgttcggaccgaaggggtacctaaagggtcggaaatccaaaaacggtcttaggtacggaccgtagacccacgtacg

SEQ ID NO: 182365 - DNA, 756 bp, Homo sapiens
  misc_feature: GYAE6OF02FXR3N.22.14.B03.1.454.CMB.1.raw
tcagacatacgcgtcacgaccggtgctcgatttagtgtgagtagttaccggcgggggaaggcgtaacgaacaggcgaggcaggggcagcaagatggtcgttgcagaccccaggtcttcctactttcctctgttgcttctggagtctctggtgcctaccggggacattgttgacgtgacccagtctcccagtaactccctggcttagtgtctctggcgagaggccacgatccaactcgcagtccagccagagttatttttaccacgctccaccaataagagttacttagtctttggttacctagctaggaaaccaggacatcgtccgtgcacttgctcatttacctggtcgtcctacccgggtaatcccgggtccctacgaccgtattcgtaggtcggactacggtccgggttcgtacgggaactaggtacttttaccaccgttcctccgtaacctacgtttaccgaacggccaacgtcccgttaggaccgtaacgggtacccgtaacggaaacgttagtacgggttacggtccgttaacgttttaactttaagtttcgttaccgtacggttaccttaaacttttaaccgttttaaccgttaacttttaccccgttacccgttacgtaacggttaccgtttaccggtaacccgtaaacggggttaaccccgtaaaggggttaccggtaaacggttaacccgaaaaccgggtaacgttacgggttaccgggtacgttacggtaaccgtacccgtaacg

SEQ ID NO: 182366 - DNA, 642 bp, Homo sapiens
  misc_feature: GYAE6OF02JXFGV.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggagggccaccatcaactgcaagtccagccagagttatttttacagctccaccaataagattactagtcttggtccagcacgaaaccaggacactcgtacctgacactgctctatttacgtgggtcgtacgtaccgggacgtccgggtacctacgaccgtatacgagtggacgtacggcgggtcgtagggactagtacgtttaccacttacctaccaaccctataccgagaccgtacgcctcggaccgtagggcctaggaacgttagtaggttacggacttaggttttattacgtttcgactagacttaaattagtttacttaccttccttaccgtacgtacggttaccgttccggtaacgtaacggggaaccctaaaggggttacgaaacgttaaccgaaaccggttacgttacgggtacggttactacggtacctaacccttacg

SEQ ID NO: 182367 - DNA, 586 bp, Homo sapiens
  misc_feature: GYAE6OF02J1NA0.22.14.B03.1.454.CMB.1.raw
  modified_base (307)..(307): a, c, t, g, unknown or other
  misc_feature (307)..(307): n is a, c, g, or t
tcagacatacgcgtcacgaccggtgctcgatttagtgtgagtagtcccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaccaggacatcgtctgcactgctcatttacngggctactacccgggaatccgggtccctgaccgattcagtggcaggcgggtctgggacagtactttcgacctctaccgacctatcaacggcaagccgtgaccgaggctacggaagagtggtcgtcgtaagtttagtttaagttcgtacgagtaccgtaaatttagtttaacttacgtttccctacctaccgtaggtacccgttacggacctaacggggaccctaaagggttgaaacttaccgaaaacgtacgttacggtacggactcgaccaccttacg

SEQ ID NO: 182368 - DNA, 588 bp, Homo sapiens
  misc_feature: GYAE6OF02IY6ZH.22.14.B03.1.454.CMB.1.raw
  modified_base (312)..(312): a, c, t, g, unknown or other
  misc_feature (312)..(312): n is a, c, g, or t
  modified_base (451)..(451): a, c, t, g, unknown or other
  misc_feature (451)..(451): n is a, c, g, or t
  modified_base (560)..(560): a, c, t, g, unknown or other
  misc_feature (560)..(560): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacagctccaccaataagagttacttagcttgttccagcagaaaccaggacatcgtctgcactagctcatttacgngggtctcgtacccgggaacgtcccggggtaccctggacccgtattacgaggtcggcacggtcgggtcgtgggacagtactttacgaccttcgtccactactacagcaacgtcctagcgtaaggccaggaacgcgttggngtaccttaggtttactttgtacgtccagtacaaatttagttactatttcctcctaagacgttaccgtacggaactaacgggaacctaaggagtaaactacgaaaccggnttacggtacggcttacgactacctacgg

SEQ ID NO: 182369 - DNA, 536 bp, Homo sapiens
  misc_feature: GYAE6OF02HJLOZ.22.14.B03.1.454.CMB.1.raw
  modified_base (402)..(402): a, c, t, g, unknown or other
  misc_feature (402)..(402): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaacaggacatcgtcctgcactgctcatttactggcgtctacccgggaatccggggtcctgaccgatcagtggcagcgggtctgggacagtatttcactctcacatcagcagcctgcaggctgaatntgtgctagtttatattgcagtcaattattattacttcctctactacgacgtttccggacgtaacgggtacctaaagggttacgtaaaagtaccgaaaacgtacgttaggtacggtacctacggaccacctaacg

SEQ ID NO: 182370 - DNA, 534 bp, Homo sapiens
  misc_feature: GYAE6OF02GJJ1E.22.14.B03.1.454.CMB.1.raw
  modified_base (409)..(409): a, c, t, g, unknown or other
  misc_feature (409)..(409): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccacaataagagttacttagcttggttccagcagaaaccaggacatcgtcctgcactgctcatttactgggcgtctacccgggaatccggggtccctcgaccgattcgagtggcaggcggtcgtgggacagtatttcactctcaccatcagcagctgcaggctagaanatgtgctagtttattattgtcagtctaattaattatacttcctctacgtagtaccgttacgaccgaacgggtacccaagggtacgaaaattcgaaaacgtacgtggtacgactcgactaccgtac

SEQ ID NO: 182371 - DNA, 552 bp, Homo sapiens
  misc_feature: GYAE6OF02JQQ5Q.22.14.B03.1.454.CMB.1.raw
  modified_base (348)..(348): a, c, t, g, unknown or other
  misc_feature (348)..(348): n is a, c, g, or t
  modified_base (418)..(418): a, c, t, g, unknown or other
  misc_feature (418)..(418): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagtcagaaaccaggacatcgtcctgcactgctcatttactggcgtcgtacccgggaagtcccgggtccctgaccgtntccaggtcggcgagcgggtcgtgggacagtattcactctcaccatcagcctagcctgcgaggctaggaanagtgtcggctagtttatattgacagactaattattacttattcccgtctaagtacgtaccgtttcgggaacctaagggaccctaagggttagaaacttaccgaaacgtacgtcggtcggactacggaccactag

SEQ ID NO: 182372 - DNA, 547 bp, Homo sapiens
  misc_feature: GYAE6OF02HNVD6.22.14.B03.1.454.CMB.1.raw
  modified_base (388)..(388): a, c, t, g, unknown or other
  misc_feature (388)..(388): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactggctctacccgggaatccggggtccctgaccgattcagtgcagcgggtctgggacagtattcactctcacatcagcancctgcaggctgaaagagtgtaggctagttttatactgtactagcgaaatagttataattccctacctcgtacgtacgttacggaccgaacggggtaacccaagggtaggaaacttaccgaaaacggacgttacggtacggacttaggccctaacctacg

SEQ ID NO: 182373 - DNA, 517 bp, Homo sapiens
  misc_feature: GYAE6OF02IAGFS.22.14.B03.1.454.CMB.1.raw
  modified_base (340)..(340): a, c, t, g, unknown or other
  misc_feature (340)..(340): n is a, c, g, or t
  modified_base (405)..(405): a, c, t, g, unknown or other
  misc_feature (405)..(405): n is a, c, g, or t
  modified_base (507)..(507): a, c, t, g, unknown or other
  misc_feature (507)..(507): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccacatcaactgcaagtccagccagagtatttttacagctccaccaataagagctacttagcttggttccagcagaaaccaggacactcctcctctactgctcatttactggctcgtaccggaatccggggtcctgaccgnttcagtcggcaggcgggtactgggacagtattcactctcacatcagcagcctgcaggctagaagntgtgactagtttatactgtacagctaattattatacttcctcactagtacgttcggacctaagggactaaggtagaaactacgaaacgacgtaggtcgactnacctactacg

SEQ ID NO: 182374 - DNA, 586 bp, Homo sapiens
  misc_feature: GYAE6OF02GRLHB.22.14.B03.1.454.CMB.1.raw
  modified_base (397)..(397): a, c, t, g, unknown or other
  misc_feature (397)..(397): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttactagcttggttccagcagaaaccaggacatcgtcctgcactgctctatttactgggctcgtaccgggatcccggggtcctggaccgattcgagtcggcaggcggtctgggacagtatttcactctcaccatcagcacgcngcaggctagaagagtgtggtctagtttatattgtcaagtccaatttattaattacttcccttacctcgaacgttacccgttccgggaaccgtaaccgggggtaaccctaaaggggttaacggaaaacgttaacccgaaaacggttaaccgttaggttaccgggaactttacggcccgtaacccttaacg

SEQ ID NO: 182375 - DNA, 704 bp, Homo sapiens
  misc_feature: GYAE6OF02IPEYW.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctgctgtgtctctgggcgagacgggccaccatcaactgcaagtccagccagagttatttttacagctaccaccaataagagttacttagtcttggttccagcaagtaaaccaggacatcgtcctgcactcgctactagtttacgtgggtccgttaccgtaacccggggtaacgttccccgggggttacccctggtaacccgtacttacgtacggtacggtcgacgggtcggggttacgtacggggaactaggtacttttccgaaccttcctaccacctacgtaccaggacgacgcccgttagaccgtaaggtccctaaggaacggtacgttggttacggtacctttaaggtttttaactttagttcgttaacacggttaactaaatttaacgtttacttaacttttccctaccttaccgtaaggttaacccgttccggaaccgtaaacggggtacctaaaggggttacgtaaaacctaacggtaaaaccggtaacttcgggtacggtaccgtcgaacccgtaccttacgg

SEQ ID NO: 182376 - DNA, 575 bp, Homo sapiens
  misc_feature: GYAE6OF02GHALN.22.14.B03.1.454.CMB.1.raw
  modified_base (408)..(408): a, c, t, g, unknown or other
  misc_feature (408)..(408): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagaggccaccatcaactgcaagtccagccagagtatttttacagctccaccaataagagttacttagcttggttccagcagaaaccaggacatcgtcctgcactgctcatttactgggctcgtacccggaactccgggtccctgaccgattcagtgcgagcgggtctgggacagtatttcactctccacctatcagcagcctgcaggctagaagtntgtgacttagtttatagttgtacagtactaattattacttatttcccacttacgaggttacccgttacggacccgtaaagggtaaccgtaacgggttaacggaaaaccttaccgaaaaccggttaacgttcgggtaacggtacctcgggtaaccctacccttaacgg

SEQ ID NO: 182377 - DNA, 317 bp, Homo sapiens
  misc_feature: GYAE6OF02FT5E4.22.14.B03.1.454.CMB.1.raw
  modified_base (315)..(317): a, c, t, g, unknown or other
  misc_feature (315)..(317): n is a, c, g, or t
tcagacatacgcgtcacgaccggtgctcgatttagtgtgagtagttccgcgggcaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtcttccccctggcgccctgctccaggagcacctccgagagcacagcggccctgggctgcctggtcaaggctacttccacgcgtatgtctgagcgggctggcaaggcgcatagnnn

SEQ ID NO: 182378 - DNA, 597 bp, Homo sapiens
  misc_feature: GYAE6OF02HOHP9.22.14.B03.1.454.CMB.1.raw
  modified_base (347)..(347): a, c, t, g, unknown or other
  misc_feature (347)..(347): n is a, c, g, or t
  modified_base (431)..(431): a, c, t, g, unknown or other
  misc_feature (431)..(431): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttactgggcgtcgtacccgggaatccggggtccctgaccgtnttcaggtggcacggcgggtactgggactaggtatttccacttcctacgaccatacaagcacgcctgaccaggctagaagatggnggacttagtttactacgtgtacgagtactaagttatttacttactttccctcctacgtacgtaccgttaccggacccgtaaaggggtaaccctaagggttacggtaaaacgttaccgaaaaacggtaccgttagggtaacggtccgtacggtaccctacgtaaccg

SEQ ID NO: 182379 - DNA, 533 bp, Homo sapiens
  misc_feature: GYAE6OF02F91NS.22.14.B03.1.454.CMB.1.raw
  modified_base (365)..(365): a, c, t, g, unknown or other
  misc_feature (365)..(365): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggctctacccgggaatccgggtcctgaccgattcagtgcagcgggtctgggacngattcactctcaccatcagcagcctgcgaggcngaanagtgtggctagtttattattgtctagctaatattatacttccctcttacacgtacgttccggaccgaagggtaacccgtaaggttacggaaaactacgaaaacgacttaggtggacctagaccctactacg

SEQ ID NO: 182380 - DNA, 585 bp, Homo sapiens
  misc_feature: GYAE6OF02JCE4A.22.14.B03.1.454.CMB.1.raw
  modified_base (377)..(377): a, c, t, g, unknown or other
  misc_feature (377)..(377): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (458)..(458): a, c, t, g, unknown or other
  misc_feature (458)..(458): n is a, c, g, or t
tcagacatacgcgtcacgaccggtgctcgatttagtgtgagtagttccgcgggggaggctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccgatcaactgcaagtccagccagagttatttttacagctccaaccaataagagttacttagacttcggtccagcaagaaaccaggacatccgtactgcactgctctatttactgggctacgtacccgggaagtcccggggtcctaggaccgattcgagtggccaggcgggtcngggacagtactttcgacttcncctaccattccagcagtccctgaccgnggctaggacgatggtacgctagttttatagttnccgtagtaccaaagtttctaattcgttaccctcgtacacgttacggttccgaacggtaacgggtaacctaaaggtcggtaaaactcgtaaaaccggtacttcggtacggtcctacgaccgaccctag

SEQ ID NO: 182381 - DNA, 299 bp, Homo sapiens
  misc_feature: GYAE6OF02HB1PZ.22.14.B03.1.454.CMB.1.raw
  modified_base (291)..(299): a, c, t, g, unknown or other
  misc_feature (291)..(299): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaaacgaactgtggctgcaccatctgtcttcatccttcccgccatctgaacgcgtatgtctgagcggctggcaaggcgcatagnnnnnnnnn

SEQ ID NO: 182382 - DNA, 557 bp, Homo sapiens
  misc_feature: GYAE6OF02H99FK.22.14.B03.1.454.CMB.1.raw
  modified_base (425)..(425): a, c, t, g, unknown or other
  misc_feature (425)..(425): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagttatttttacagcctccaccaataagattacttagcttggttccagcaagaaaccaggacatcgtcctgcactgctctatttacgtgggctccgtaacccgggactcccggggtccctgacccgattcaggtggcacggcgggtcgtgggacagtatttcactctcacactcagcacgccgtgcgaggctaggaagngtggtggacttagtttatattgtcagtactaattattattacttccctacctctagtaccgttaccgacgtaacgggaacgtaaggtacggaaactaacgaacgtaacgttggacggtctacggccactacg

SEQ ID NO: 182383 - DNA, 600 bp, Homo sapiens
  misc_feature: GYAE6OF02JDRBT.22.14.B03.1.454.CMB.1.raw
  modified_base (315)..(315): a, c, t, g, unknown or other
  misc_feature (315)..(315): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcgaactgcaagtccagccagacgtatttttacagctccaccaataagagttacctagcttggttccagctagaaaccaggacaatcgtcctagcactgactcatttacnggctcgtacccggaatcccggggtcctgaccgattcgagtcggcagcggtctacggacagtattcacgtactcaccagtcagacacgcctagcgacggctagaacagtacgtaggacttagtttaacttacgtacgtacgtaacgtataaaccttaattacttaacgtttccccttactaccgtagttaaccgttccgggaaccgtaacgggtaacccaagggttaacgtaaaacgtcgtaaaaccgtaacgtcggttaccggcgttaacggcctaaacgtaccg

SEQ ID NO: 182384 - DNA, 595 bp, Homo sapiens
  misc_feature: GYAE6OF02IOD4B.22.14.B03.1.454.CMB.1.raw
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
tcagacatacgcgtcacgaccggtgctcgatttagtgtgagtagttccgcgggggaggctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccgatcaactgcaagtccagccagagtatttttacagctccaccaataagagttacttagcttggttccagcaagaaaccaggactaatcgtccttgcactgctccattttacgcgggtacgtccgtacccgggaacgtccggggtccctgacccgattcngtcggcaggcggtntgggacagtattcactctcacctntcagcacggcctgcaggctaggaacgatggttgacttagttttanaagtttcgtacagtacctaaattagttacttactttccctaccgtaacagttaccggtttacgaccgtaaacggggtacctaaagggtacgttaaaaactccgaaaacgttaaccgttgggtaccgtaccgtacgaccctaccttacg

SEQ ID NO: 182385 - DNA, 588 bp, Homo sapiens
  misc_feature: GYAE6OF02GQH37.22.14.B03.1.454.CMB.1.raw
  modified_base (469)..(469): a, c, t, g, unknown or other
  misc_feature (469)..(469): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggacatcgtcctgctactgctctatttacgtgggctcgtaccgggaactccgggtcctgaccgtatcgagtcggcacggcggtctagggactagtactttcgactctcactatcgacgcacgctgcaggtctagaagtgtcgtggacctagtttactagttcgtactaagtctaaagttagttacgttntttaccccgtctacgtacgtaccggttcggaacctaacggggtaacctaagggttacgaaaccgtttaccgaaaaggttaccgttcggtacggtaccgttggacccgtacgttaaccgg

SEQ ID NO: 182386 - DNA, 323 bp, Homo sapiens
  misc_feature: GYAE6OF02HC0IQ.22.14.B03.1.454.CMB.1.raw
  modified_base (317)..(323): a, c, t, g, unknown or other
  misc_feature (317)..(323): n is a, c, g, or t
tcagacatacgcgtcacgaccggtgctcgatttagtgtgagtagttccgcggacaaatccacgaccacagtgtacatgtcgctgagcagcctgagatctgggggacacggccgtttattattgtgttatgggtgagcatccggcggcctggggccagggaaccctggtcaccgtctcctcagcctccaccaagggcccatcggtcttccccctggcgccctgctccaggagcacctccgagagcacagccggccctgggctgcctggtcaaggactacttccacgcgtatgtctgagcggctggcaaggcgcatagnnnnnnn

SEQ ID NO: 182387 - DNA, 540 bp, Homo sapiens
  misc_feature: GYAE6OF02HWCJS.22.14.B03.1.454.CMB.1.raw
  modified_base (418)..(418): a, c, t, g, unknown or other
  misc_feature (418)..(418): n is a, c, g, or t
  modified_base (440)..(440): a, c, t, g, unknown or other
  misc_feature (440)..(440): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccaagagttattttttacagctccacaataagagttacttagcttggttccagcagaaaccaggacatcgtcctgcactgctcatttactggcgtctacccgggaatccggggtccctggaccgattcagtggcaggcgggtctgggacagtattcactctcaccatcagtcacgcctgcaggctagaagtagttggnggctagttttactagttcgtanagactaaattattattactttcctctcagtaccgttcggacctaagggaacctaaggtacgaaactaccaaagacgtagtcggactacggcctaccgtac

SEQ ID NO: 182388 - DNA, 581 bp, Homo sapiens
  misc_feature: GYAE6OF02JXO7M.22.14.B03.1.454.CMB.1.raw
  modified_base (289)..(289): a, c, t, g, unknown or other
  misc_feature (289)..(289): n is a, c, g, or t
  modified_base (362)..(362): a, c, t, g, unknown or other
  misc_feature (362)..(362): n is a, c, g, or t
tcagacatacgcgtcacgaccggtgctcgatttagtgtgagtagttccgcgggggaggctacaacaggcaggccaggggcagcaagatggtgttgcagacccaggtcttcatttctctgttgctctggatctctggtgcctacggggacattgtgatgacccagtctccagactccctggctgtgtctctgggcgagagggccaccatcaactgcgaagtccagccagagtaagtttttaccaggctccacctaactaagtagttacttagctttggttccaagtcaanaaccaggacatcgctgcactcgctctatttactcgggcgtccgtaccgggaattccggggtccctggaaccgngttaccgtagtcggacacggcgggtctgggacacgatttcactctcaccatcagcacgccctgacgacggctaggaatagtgtggaacttaggtttaatagttcgtacagtacctaaattagttactacgtttcctactcgactaccggttcgacgtaacggaaccgtaaggtataaacgttaccgaaagtacgtggtaacgtctacggtaccactacg

SEQ ID NO: 182389 - DNA, 608 bp, Homo sapiens
  misc_feature: GYAE6OF02IP158.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctccgggcgagagggccaccatcaactgacaagtccagccagagttatttttacagctccaccaataagagttacttagcttggttccagacaagaaaccaggacatcgtcctgcactgctctatttacgtgggtcgtaccgtacccgggaacgtcccggggtcctgaccgattcaggtcggcgaggtcggtcgtcgggacagtacttcactctcacctatcagcgacgccgtgacgtaggtacctagaaagtgtacggtggtacttacgttttatacttggtacagtactaattactttataccgttacctccgtactacggttacgttaccgggacgtaacgggtaccgtaaaggttaacgtaaacgtaaccgaaacgtacgttggttacggaccttacggaacctaccgtagtttacccgg

SEQ ID NO: 182390 - DNA, 582 bp, Homo sapiens
  misc_feature: GYAE6OF02I9295.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagcctccaccaataagagttacttagcttggttccagcaagaaaccaggacatcgtcctgcactgctctactttacgtgggtccgttccgtacccgggtaacgtcccggggtccctcggaccgtattcgagtcggcacggcgggtctagggactagtactttcactccgtccacctatcagcacgtcctgccgaggctagaagtgtggtgacttagtttatagttgactacgactaagtttaacttattacttccctactacgtacgtaccgttcggaccgtaacgggaccgtaaggtacgaaacgtaccgaaacgtacgtggtaccgtactaccacgtattaccg

SEQ ID NO: 182391 - DNA, 649 bp, Homo sapiens
  misc_feature: GYAE6OF02J3E7W.22.14.B03.1.454.CMB.1.raw
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
tcagacatacgcgtcacgaccggtgctcgatttagtgtgagtagttccgcggggagctacaacaggcaggcaggggcagcaagatggtgttgcagacccaggtcttcattctctgttgctctggatctctggtgccgtacgggacagttgtgatcgacccagtctccagacctcctggctgtgtcgtcgtgggacgagacggcccaccatcaacgtgaccaacgtccacgccagtagtttacttttacacgtcctaccaacctaataacgtacgttacgttacgtcgttacggtccaagacaacgtaaaccaggtactacgtccgtcctgacctacgtcgtctacgtactttacggtcgggtaccgtaccgtaccgggtacggtcccggtacctacgaccgtactcggacgtacggccgacggtcgggtccagggtactagttaccttcacgttccgtaccacgttacnccgtacncgtaccgtctacgacgacgtcgtacgagtacgtcggtagtaccgttagttacttactagacctactactaagttcttaattccgttacctacgtaccgacgtccgtacggaccgtacggaacgtagaacgtaagtaaccgtaacgacggttcgacgtcgtacgctaccgtacg

SEQ ID NO: 182392 - DNA, 646 bp, Homo sapiens
  misc_feature: GYAE6OF02IJZT7.22.14.B03.1.454.CMB.1.raw
  modified_base (322)..(322): a, c, t, g, unknown or other
  misc_feature (322)..(322): n is a, c, g, or t
  modified_base (494)..(494): a, c, t, g, unknown or other
  misc_feature (494)..(494): n is a, c, g, or t
  modified_base (543)..(543): a, c, t, g, unknown or other
  misc_feature (543)..(543): n is a, c, g, or t
  modified_base (620)..(620): a, c, t, g, unknown or other
  misc_feature (620)..(620): n is a, c, g, or t
tcagacatacgcgtcacgaccggtgctcgatttagtgtgagtagttccgcgggggaggctacaacaggcaggcgaggggcagcaagatggtgttgcagacccaggtcttcatttctctgttgctctggatctctggtcgccgtacggggactattggtgatcgaacccagtcctccagacctccctgctgtgtctcgtggcgaggacgggccaccatacaactgacaacgtcacgcagagttatttttacagtcctaccactaataagtagttactagcttgtccagacagaacagacatcgtctgcatgactctaattcgnggcgtacgtaccggacgtccgggtcctcggaaccgtgttacgacggttcgaccggaggtccggggttactacggggaactaacgtctttaccgaaccttccttaccaaccgttagaccgtaacgtccgaaacgtcccttggacccgagtcggtacgaaagtcgtggtcggtnttaacgttttaagtgtttacacggtataccgtaaatttacttaacgttnttcccctactacgtaacgacccggtttcggaaaccggtaggaacccgtaaggttaccgaaaataccgaaaagtccgnggtacggttacaccttacgacttacg

SEQ ID NO: 182393 - DNA, 659 bp, Homo sapiens
  misc_feature: GYAE6OF02JXZVU.22.14.B03.1.454.CMB.1.raw
  modified_base (296)..(296): a, c, t, g, unknown or other
  misc_feature (296)..(296): n is a, c, g, or t
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (462)..(462): a, c, t, g, unknown or other
  misc_feature (462)..(462): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctgctgtgtctcgtgggcgaggacgggccaccatcaactgcaacgtccagccaggtattactttttacacgctaccaccaataagtagttacttacgtcgttggttaccagcaagaaaccnggacatccgtccngcactgctactattacgngggtcgtcggtaaccccggaacgtcccggggtccctcggacccgtacttcgacggtacgggcgtacgggccggggttccgtaggggacctaaggttactttaccgccgttctacccacgtacctcgagtaacccncggtccctaggtccggagtccgagtaacggtagtggttaacgccttaagttttataacgttcgagtaactagttaacttaaatttcgttaccctttcctaccgattacgggacgtttacccggaggtaaccggtaaccggtaaggttaaccaagttaaacggaacgttcgtacgtagggtctacggacctccgttag

SEQ ID NO: 182394 - DNA, 552 bp, Homo sapiens
  misc_feature: GYAE6OF02FYFZ2.22.14.B03.1.454.CMB.1.raw
  modified_base (427)..(427): a, c, t, g, unknown or other
  misc_feature (427)..(427): n is a, c, g, or t
  modified_base (459)..(459): a, c, t, g, unknown or other
  misc_feature (459)..(459): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacgtggcgtcgtacccgggaagtcccggggtccctgaccgattcagtggcaggcggtctgggacagtatttcactctcaccatcagcagcctgcaggcagagatgtgctagtttattagtntacagactaattagttattacttcctaccgtntacgtaccgttccggaccgtaacgggaccctaaagggttacggaaacttaccgaaaaccgtacgttaggtaccggcgttacgacctacgtacg

SEQ ID NO: 182395 - DNA, 678 bp, Homo sapiens
  misc_feature: GYAE6OF02HCQCE.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagagggccaccatcaactgcaagtccagccagagttatttttacagctaccaccaataagagttacttagctttggttccagcaagaaaccaggacatcgtcctgcactgctctactttacgtcgggtccgtaccgtaccccgggtaacgtccccggggtccctacggaccgtattcgaggtcggcgacggtcgggtcgtacggggactacgtacttccactccgtacaccgatcacgcacgtcctgcgacggtctagaacgtagtggtacgtacgttaagtttactttagttcgttacgagtacttaaagtttaactttaagtttacctttacccgttacccgttaacgtaccgggttacccggttacccgggaaccggtaaaccggggtaaaccgttaaagggttaaacgtaaaaccgttaaccggaaaacgttaacggttacgggttacggacgttaacccgtaccgtaacccttaccgg

SEQ ID NO: 182396 - DNA, 528 bp, Homo sapiens
  misc_feature: GYAE6OF02G7EWX.22.14.B03.1.454.CMB.1.raw
  modified_base (457)..(457): a, c, t, g, unknown or other
  misc_feature (457)..(457): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttactagcttggttccagcagaaaccaggaacatcgtcctgcactgctcatttactgggccgtctacccgggaatccggggtccctgaccgattcagtggcagcgggtctgggacagtatttcgactctacaccatcagcagcctgcaggctgaagatgtgctagtttatagttgtacagactaattatttatattccctctanagtaccgttcgacctaagggaccaaaggtacgaaacttcgaaaactacgttgtaggacttcgactacctac

SEQ ID NO: 182397 - DNA, 588 bp, Homo sapiens
  misc_feature: GYAE6OF02HZTFO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcctggctgtgtctctgggcgaggagggccaccatcaactgcaagtccagccagagttatttttacagtcctccaccaataagattacttagcttggtaccagtacaagaaccagactatcgtcctgacactgctctatttacgtgggcgtccgtacccgggtactccggggtccctggaccgtacttcgaggtcggcgacggtcgggtcgtgggaacacggtacttccactcctaccacctatccagcacgtctacggtaggcgtaggaagtagtggtggtacttacgtttattagttcgtagacgtactaagttattatactttcctcctacgtagtaccgttcgaccgtaacggtaccgaaggtacgaaactacgtaaacgtacgtagtacggtactaggacctaccgtattcg

SEQ ID NO: 182398 - DNA, 571 bp, Homo sapiens
  misc_feature: GYAE6OF02IY06U.22.14.B03.1.454.CMB.1.raw
  modified_base (309)..(309): a, c, t, g, unknown or other
  misc_feature (309)..(309): n is a, c, g, or t
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
tcagacatacgcgtcacgaccggtgctcgatttagtgtgagtagttccgcgggtgagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttacttagcttggttccagcagaaaccaggacatccgtcctgcactgctcatttacngggcgtcgtacccgggtaactcccggggtcctcgaccgagttccagtcggcaggcgggtcgtgggactgtatttcgactcnccaccatcaagcagcctgcacggctagaagtnttgacggtctaagttttattagttgtactagtactaattagttacttacttcctcctacgtacgtacgttacggacccgtaaagggacctaaagggtacgtaaactacgaaaccgtaacgttacggtacggtacttacggacctaaccg

SEQ ID NO: 182399 - DNA, 612 bp, Homo sapiens
  misc_feature: GYAE6OF02FH1KE.22.14.B03.1.454.CMB.1.raw
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctctatttacgngggcgtccgtacccgggaatccgggtccctgaccgattcagtggcaggcgggtctgggacagtatttcgactcncacctatcagcagcctgcaggctagaacgtntgtcggactagttttattagttggtaccaggtactaaatttaatttaacttactttacccttacctacgtaacgttaccggtttcgggaaccctaaaggggggaaccctaaagggggttacggtaaaaacttaccgaaaaaccgggttaaccgttacgggttaccgggtaccgtacggtaccctaacccgttaacg

SEQ ID NO: 182400 - DNA, 600 bp, Homo sapiens
  misc_feature: GYAE6OF02IE40M.22.14.B03.1.454.CMB.1.raw
  modified_base (457)..(457): a, c, t, g, unknown or other
  misc_feature (457)..(457): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggtccgtcgtaccccgggaagtcccggggtaccctggaccgtattcagtggcaggtcggtcgtgggacagtatttcactcctccactatccgagcacgccgtgcgagtcgtagaagtcgtggtacgacgttagttttatacggtttntacgagtattaatttattaacgtttacttccctaccgtacgtaaccgttacggttaccggaacccggtaacgggtaaccggttaagggtaacggtaaactaaccgtaaacgtcgtaagggtcgaccgtacgacccgattaccg

SEQ ID NO: 182401 - DNA, 343 bp, Homo sapiens
  misc_feature: GYAE6OF02ICE5N.22.14.B03.1.454.CMB.1.raw
  modified_base (301)..(302): a, c, t, g, unknown or other
  misc_feature (301)..(302): n is a, c, g, or t
  modified_base (304)..(343): a, c, t, g, unknown or other
  misc_feature (304)..(343): n is a, c, g, or t
tcagacatacgcgtcacgaccggtgctcgatttagtgtgagtagttcccgggaatccggggtccctgaccgattcagtggcagcgggtctgggacagatttcactctcaccatcagcagcctgcaggctgaagatgtggcagttttatattgtcagcaatattatattcctcctcagtaccgttcggccaaaggggaccaaggtggaaaatcaaaacgactgtggctgcaccatctgtcttcatccttccgctatctgaacgctatcgtctgagcgggctgggacaacgggcacagtaggnngnnnnnnnnnnnnnnnnnnnnnnnnnnnnnnnnnnnnnnnn

SEQ ID NO: 182402 - DNA, 555 bp, Homo sapiens
  misc_feature: GYAE6OF02GC3QS.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggcgtcgtacccgggagtcccgggtccctggaccgtattcgagtggcaggtcgggtctgggacagtactttcactctcacctatcagcagcctgcaggctagaagtatgtgcttagtttattagttgtactagctaaattattaattacttccctaccttacgacgtaccgttcgaccgtaacgggaacctaagggttacggaaactaccgaaacgtacgtggttacggactcgacctacctacg

SEQ ID NO: 182403 - DNA, 623 bp, Homo sapiens
  misc_feature: GYAE6OF02IWVGJ.22.14.B03.1.454.CMB.1.raw
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
  modified_base (439)..(439): a, c, t, g, unknown or other
  misc_feature (439)..(439): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagtatttttacagctccaccaataagagttactagcttaggtccagcanaaccaggacatacgtcctgcactgctctattacgnggtcgtctaccgggaacgtccggtcctacgccgtaatcaggtcgcacgcgggtctggactagacgtttcacgttcctacaccagtcagtcacgcctgccgtaagggcctaaggaacgtagtgtacggtnttaagtttagttatacggtctaagaccttaaagttatttaatacctttacccctacttaccgaacggttaccgtttacggaacccgtaaacggggtacccgtaaaagggttaccggtaaaacgttaacccaaaacggtaacccgttagggtaccgggtactaccgggtaacctcccgttaaccg

SEQ ID NO: 182404 - DNA, 689 bp, Homo sapiens
  misc_feature: GYAE6OF02G88D1.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggaccaccatcaactacaagtccagccagagtatttttacagctccaccaataagagttacttagacttggttccagcagaaaccaggacatcgtcctgcactgctcatttacgtggcgtccgtacccgggaagtcccggggtccctgaccgtattcgagtggcgaggcgggtcgtcgggacagtactttccgacttcctacacctatcgtagcctacgccttagcgagggtacctaggaaacgtagttagggttcggacgtttaaggttttacttaacgtttcggttaacgaacggtaaccttaaagttttaacttttaaacgttcctttttacccgttaaccgttacgtaaaccggtttacccgggttcccgggaacccgtaaacgggggtaacccgtaaaaggggttaacggaaaaaccttacccggtaaaaaccggttaccgttaggttaccgggtaccttacgggtaaccctaaccgtcgtttaccgg

SEQ ID NO: 182405 - DNA, 631 bp, Homo sapiens
  misc_feature: GYAE6OF02HRGEB.22.14.B03.1.454.CMB.1.raw
  modified_base (189)..(189): a, c, t, g, unknown or other
  misc_feature (189)..(189): n is a, c, g, or t
  modified_base (224)..(224): a, c, t, g, unknown or other
  misc_feature (224)..(224): n is a, c, g, or t
  modified_base (281)..(281): a, c, t, g, unknown or other
  misc_feature (281)..(281): n is a, c, g, or t
  modified_base (307)..(308): a, c, t, g, unknown or other
  misc_feature (307)..(308): n is a, c, g, or t
  modified_base (429)..(429): a, c, t, g, unknown or other
  misc_feature (429)..(429): n is a, c, g, or t
tcagacatacgcgtcacgaccggtgctcgatttagtgtgagtagttccgcgggggagctacaacaggcaggcaggggcagcaagatggtgttgcagacccaggtcttcattctctgttgctctggatctctggtgccgtacggggacattgtgatgacccagtctccagactccctggctgtgtctcgngggcgaggaggccaccatcaaactgacaacgtcanccgagagttatttttacagctccaaccaataacggattactagcttggttcagacanaaaccgaggacactcgtctcgctacnncctatacttacgtggacgttccgtaaccgggaatcccggggtcctacgaccgagttccaggtcgactacggtgggacctagggaccaggtactttcgaaccctcgtacaccactgaacccncgtacgtcgacgacgtacgtacggaagaagttcggtacggtacgttacgtttaaagttacgttagtacgtaacgaacgttaagtaactttaacttaacttcccgttacctacgtacgtacggttaccggtaccggacgggtaacgtaacggtaacggtaacaaacgtaaaccgaaggtacgacggtccgactcgaccagtac

SEQ ID NO: 182406 - DNA, 622 bp, Homo sapiens
  misc_feature: GYAE6OF02HWA4G.22.14.B03.1.454.CMB.1.raw
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (412)..(412): a, c, t, g, unknown or other
  misc_feature (412)..(412): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacaataagagttaacttagcttggttccagcagaaaccaggacaatcgtctgcactgcctctatttacgtgggtctcgtaccgggaactccggggtccctgaccgattcagtggcagcgggtctgggacagactttcactctcactntacngcagctgcaggntgaagngtgtcggacttagtttatagttgtactaagtactaaagtttactttaattactttccccgttactaccgtaacggttacccggttaccgggtaacccgtaacgggggtaaaccccgtaaaggggttaacgggtaaaacttaacccggtaaaacggttaacgttacggggtaaccggtacccgttaacggaccccgtaaccgttaacccgg

SEQ ID NO: 182407 - DNA, 632 bp, Homo sapiens
  misc_feature: GYAE6OF02F0NFH.22.14.B03.1.454.CMB.1.raw
  modified_base (413)..(413): a, c, t, g, unknown or other
  misc_feature (413)..(413): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaccaataagagttactagcttcggttccagcagaaaccaggacatcgtcctgcactgcctctatttacgtgggcgttccgtaacccgggaagtcccggggtccctggaccgtattccgaggtcggcaggtcgggtcgtgggactagtatttcactctaccaccatcacncgacgccgtcgcagggctaggaacgtagtggtacggtcgtaagttttacgttagtttcgtacacggtactaaatttaactttaattaactttcccgtaccttacgtacgttaccggttaccggacccggtaaacgggtaacccggtaaagggtaacggtaaacgttaaccgaaaacgtaacggttacgggtacggtacgtacgtacctacccggtaacg

SEQ ID NO: 182408 - DNA, 323 bp, Homo sapiens
  misc_feature: GYAE6OF02GHOPF.22.14.B03.1.454.CMB.1.raw
  modified_base (230)..(230): a, c, t, g, unknown or other
  misc_feature (230)..(230): n is a, c, g, or t
  modified_base (317)..(323): a, c, t, g, unknown or other
  misc_feature (317)..(323): n is a, c, g, or t
tcagacatacgcgtcacgaccggtgctcgatttagtgtgagtagttccgcgggcaaatccacgaccacagtgtacatgtcgctgagcagcctgagatctgaggacacggccgtttattattgtgttatgggtgagcatccggcggcctgggggccagggaaccctggtcaccgtctcctcagcctccaccaagggcccatcggtcttcccctggccgccctgctccaggngcacctccgagagcacagccggcctgggctgcctggtcaaggactacttccacgcgtatgtctgagcgggctggcaaggcgcatagnnnnnnn

SEQ ID NO: 182409 - DNA, 329 bp, Homo sapiens
  misc_feature: GYAE6OF02HUYDK.22.14.B03.1.454.CMB.1.raw
  modified_base (318)..(329): a, c, t, g, unknown or other
  misc_feature (318)..(329): n is a, c, g, or t
tcagacatacgcgtcacgaccggtgctcgatttagtgtgagtagttccgcggacaaatccacgaccacagtgtacatgtcgctgagcagcctgagatctgaggacacggccgtttattattgtgttatgggtgagcatccggcggcctggggccagggaaccctggtcaccgtctcctcagcctccaccaagggcccatcggtccttcccctggccgccctgctccgaggacgccacctccgagacgcacagcggccctggggctgcctggtcaaggctactccagcgtatgtctgagcggctggcaaggcgcatagnnnnnnnnnnnn

SEQ ID NO: 182410 - DNA, 541 bp, Homo sapiens
  misc_feature: GYAE6OF02HC6UT.22.14.B03.1.454.CMB.1.raw
  modified_base (309)..(309): a, c, t, g, unknown or other
  misc_feature (309)..(309): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggctctacccgggaatcccggggtccctgaccgattcaggtggcagcgggtctgggacagtattcgactctcaccatcagcagcctgcaggctgaagntgnggctaagttttatattgtacagtactaattattattactttcctctcaagtaccgttcggaccgtaagggaccctaagggtaggtaaaactacgaaaaccgtacgttacggtaggacctagaccactacg

SEQ ID NO: 182411 - DNA, 712 bp, Homo sapiens
  misc_feature: GYAE6OF02FN36L.22.14.B03.1.454.CMB.1.raw
tcagacatacgcgtcacgaccggtgctcgatttagtgtgagtagtcccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctctatttactgggcgtccgtacccgggaacgttcccgggggtacccttggacccgtagttccaggttcggaccgacggtccggggttcgtcgggggaactagggtacttttccaccgttcctaccaaccctataccacggaccacggtcccgttaggaccgtaacgggtccgtaggaaacggtaacgtgggttacgggtacctttaaggtttttaacttttaagtttcgtaccgtaaggtacttaaagtttaacgttttaattaccttcccttaccgttactaacggtaacccggtttaccgggacccgtaaacggggtaaccctaaaggggttaaccggtaaaacttaaccgtaaaaaccggtaacgttacgggtaccgggtaccgttacggacccgtaacccgtaaccg

SEQ ID NO: 182412 - DNA, 534 bp, Homo sapiens
  misc_feature: GYAE6OF02F1AEM.22.14.B03.1.454.CMB.1.raw
  modified_base (309)..(309): a, c, t, g, unknown or other
  misc_feature (309)..(309): n is a, c, g, or t
  modified_base (336)..(336): a, c, t, g, unknown or other
  misc_feature (336)..(336): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacngggctctacccgggaatccggggtccngaccgattcagtggcaggcgggtctggggacagatttcactctcaccatcagcagcctgcaggctagaagtatgtggctagtttatagttgtacagctaaattattatattcctacctcacgtacgttcggaccaaggggtaccaaggttacgtaaacttccgaaaacgtacttggtacggactcggacctactaacg

SEQ ID NO: 182413 - DNA, 669 bp, Homo sapiens
  misc_feature: GYAE6OF02IDAP2.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgacaagtccagccagtagttatttttacagcctccaaccaataagagtactacttagtcttggttccagacaagaaaccaggacactcctcctctactgtctactactttacgtcgggtcgtacggtaccccgggtaacggttcccggggtaccctcggacccgtattcgaggtcggcaggtcggtcgtgggactagtacttcacgttctaccactacgtcacgcacgtccctgacgacggctaggaaacgtgtcggtaggtacttagtttaacttacgtgtacccgagtaaccgtaaatttacgttaacgttaacctttcccgttacctaagtaacgttaccgggttacccggaacccggtaagggtaacccgtaaaggggttaaccgttaaaacgtaacccggttaaaacgtaccggtacgggttacggaccgtacggtaacccctaccgttaacg

SEQ ID NO: 182414 - DNA, 606 bp, Homo sapiens
  misc_feature: GYAE6OF02IY2MF.22.14.B03.1.454.CMB.1.raw
  modified_base (456)..(456): a, c, t, g, unknown or other
  misc_feature (456)..(456): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccaccatcaactgcaagtccagccagagttatttttacagcctccaccaataagagttacttagcttggttccagcagaaaccaggacatcgtcctgcactgctacatttacgtgggtcgtccgtaaccgggtaacgtcccggggtaccctcggaccgtattcgagtcggcaggtcgggtcgtgggacgagtactttaccgactcctccgaccctataccagccaagtcccttgcacggtcaggaagtattggtggntaagttttattattgtaccaggtactaaattattattactttccctacttacagttaccgttccggaccgtaaacgggaccggtaaaggttaacggaaacgttaccgtaaaacggtaccttgggtaacggtcctacgaccgtaccctaag

SEQ ID NO: 182415 - DNA, 817 bp, Homo sapiens
  misc_feature: GYAE6OF02JKFOV.22.14.B03.1.454.CMB.1.raw
tcagacatacgcgtcacgaccggtgctcgatttagtgtgagtagttccgcggggagctacaacaggcaggcagggcagcaagatggtgttgcagacccaggtcttcattctctgttgctctggatctctggtgcctacgggacattgtgatgacccagtctccagactccctggctgtgtctctggcgagaggcaccatcaactgcaagtccagccagagtatttttacagctcaccaataagagtacttagcttggtcctagcctaagaaccgacggacaactcgtaccctagccaccttagcctactaactttaaccgtgggccgttacgtaccccgggtaaagtcccgggggtcccctaggacccgtattacccgtaaggtaccggtccgaaggtccggggttaccgttggggaacccgtagggtaaacttttccggaaaccttcctacccgttaaccgacttacccgtaacgtcccggaacgtcccgttacgaccgtaaaggtccccgttaagggaaacgtacggtttccggttagggtaccgttaaaccggttttaagttttaaaccgttgggttaactaacgggtaccctaaaggtttaaacttttactttaaacgtttacccctttaccgtaaccgttacgttaaccccggtttacggggttaaaccccctaaaccgggggtaaaacccccgttaaggggttaaacccggggttaaaaacgttaaccgttaaaaacccgggttaacccgttacgggttaaaccgggttacccgggtttaacgtaaccccggtaaccccggttaaacccgg

SEQ ID NO: 182416 - DNA, 558 bp, Homo sapiens
  misc_feature: GYAE6OF02FRGAF.22.14.B03.1.454.CMB.1.raw
  modified_base (416)..(416): a, c, t, g, unknown or other
  misc_feature (416)..(416): n is a, c, g, or t
  modified_base (419)..(419): a, c, t, g, unknown or other
  misc_feature (419)..(419): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgttctacccgggtaatcccggggtcctgaccgattcagtggcaggcgggtctgggacagtactttcactctcacctatcagcagccctgcaggctagaacgntgngctagtttattattgtacagtactaaattattattaacttcctacctagtacgtacgttcggaccgtaagggtaaccaagggttacggaaaataccgaaaacggtacgttagggtacggtcctacggacctacctaacg

SEQ ID NO: 182417 - DNA, 589 bp, Homo sapiens
  misc_feature: GYAE6OF02G8HL6.22.14.B03.1.454.CMB.1.raw
  modified_base (315)..(315): a, c, t, g, unknown or other
  misc_feature (315)..(315): n is a, c, g, or t
  modified_base (369)..(369): a, c, t, g, unknown or other
  misc_feature (369)..(369): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaaagtccagccagagtattttttacagctccaccaataagacgttacttagcttagggtttccagcagaaaccaggacatcgtcctgcactgctcatttacngggcctcgtacccgggaatcccggggtcctgaccgattcgagtggcagcgggtntgggacagactttcactctcaccatcagcagcctgacaggctcgaaggtactggtcggctaagtttatttagttagtcacggtactaaagttactttattactttaccttccttacgaacgttaccggtttacgggacccgtaaaggggtaccctaaacgggttaggaaaacttcgaaaaccggtacttggtacggaccgtacggtaccaacccgttacg

SEQ ID NO: 182418 - DNA, 679 bp, Homo sapiens
  misc_feature: GYAE6OF02FOARP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaacgtccagcccagtagttatttttacagctccaccaataagagttacttagcttggttccagcagaaaccaggacactcgtcctagcactgctctatttactgggctaccgtacccgggaacgtccggggtcccctagaccgtattcgaggtcggcgtacggtcgggtcgtaggggactaggtactttaccacctctaccgacctatccaagtccgacgtcctcgaccgaaggcctaggaagtagtcggttacggtaccttaagttttactttaacttacggtactaacgtacctaaactttactttaactttaccctttcccgtaccgttacgaaccgttaccggtttacccggggaccgtaaaccggggtaaaccgtaaacgggttaaccggtaaaacctaaccgtaaaacccggttaacgttacgggttacggtaccctaccggtacctaacccgtttaccg

SEQ ID NO: 182419 - DNA, 553 bp, Homo sapiens
  misc_feature: GYAE6OF02ICINS.22.14.B03.1.454.CMB.1.raw
  modified_base (413)..(413): a, c, t, g, unknown or other
  misc_feature (413)..(413): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagctttggttccagcagaaaccaggacatcgtcctgcactgctcatttactgggcgtctacccgggaatcccggggtccctgaccgattcagtggcaggcgggtctgggacagtatttcactctcaccatcagcacgcctgcaggctagaagntggtgcgtagtttattattgtacagtctaaattattatactttcctccttactagtaccgttcggaccaacggggtaaccctaagggtacggaaactacgaaaaccgtacgttaggtaggacctaggtacccacgtaacg

SEQ ID NO: 182420 - DNA, 669 bp, Homo sapiens
  misc_feature: GYAE6OF02GFFYK.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctgctgtgtctctgggcgagagggccaccatcaactgcaagtccagccagagttatttttacagctccaccaataagattacttagcttggttccagcagaaaccaggacatcgtcctgcactgctctatttacgtgggtccgtccgtacccgggtaacgttcccggggtcccttacgacccgtattcaacggtggacgacggtcggggtccgtaggggacgtaggtaacttttccgaaccttccgtaccaaccctatccaaggcctaacggccctagccgtaaggcgtagaaggtagtgtacggccttaagttttatttagttgctaagcgttaaattacgttaacgttactttccctacgttaccgtaacgttacccggtttcggaacccggtaaaggggtaccccgttaaaggggttaacgtaaaacgttaaacccgtaaacggtaaccggttagttaccgggaaccgttcccggacctaacccggttaccg

SEQ ID NO: 182421 - DNA, 587 bp, Homo sapiens
  misc_feature: GYAE6OF02GAOSH.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtcgtacccgggaagtccggggtccctcgaccgattcagtggaagcgggtcgtgggacagtatttcactctcaccatcagcacgcctgcaggtctagaacgatggtcggacttagtttatacctgtacagactaaattattatacttcctcctacgtaacgtaccgtttaccggaccgaacggggtaacctaaagggtacggaaaaacttacccgaaaaaccggtaaccgttagggtaccgggtaccgtaccggacctaacccgtatttacccg

SEQ ID NO: 182422 - DNA, 610 bp, Homo sapiens
  misc_feature: GYAE6OF02FLU20.22.14.B03.1.454.CMB.1.raw
  modified_base (414)..(414): a, c, t, g, unknown or other
  misc_feature (414)..(414): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttatttttacagctccaaccaaataagagttacttagtcttggttccagcaagaaaccaggacatcgtcctgcactcgctctattacgtgggctccgtacccgggtacgtccggggtcctgaccgtattcgagtcggcaggtcggtcgtagggacagtattcactctcacctatccagcacgtccngcaggctaggaagtagtcggtgaccttagttttattattcgtacctagtactaaagttactttaagttacctttccgtaccttacgaacgttaccggtttaccggaccgtaaacgggtaaccgtaaacgggttaacgaaacgttaacgaaaccggttacgttacggtacgggtacctacgggtaccaccgttaacg

SEQ ID NO: 182423 - DNA, 554 bp, Homo sapiens
  misc_feature: GYAE6OF02F1MRG.22.14.B03.1.454.CMB.1.raw
  modified_base (470)..(470): a, c, t, g, unknown or other
  misc_feature (470)..(470): n is a, c, g, or t
  modified_base (544)..(544): a, c, t, g, unknown or other
  misc_feature (544)..(544): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccacgccagagttatttttacagctccaccaataagagttacttagcttcggttccagcaacgaaaccaggacatccgtcctgcactgctctatttactggacgtccgtaccgggactcccgggtcctcgaccgtattcagtcgcgacgcgggtcgtagggacagtatttacactcctacaccagtcacgcacgtcctgcctagtctaggtaatatttcgacttactttacttactgtcagactaatattaangtacgtgttctagtactccgtactcggaccgaagggaccacgtacgtggtaataacgttaaacgacgtggtcgntacgtacccg

SEQ ID NO: 182424 - DNA, 678 bp, Homo sapiens
  misc_feature: GYAE6OF02GQPIW.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctcagactccctggctgtgtctctgggcgagagggccaccatcaactgcaagtccagccagagttatttttacagtctccacctaataagagtctacttagcttggttccagcagaaccagacatcctctctactgctcatttacgtggcgtcgtaccgggtaactcccggggtcctggaccgtattcaggtcggcgaggtccgggtacgtcggggactaggtactttaccgtactcctccgaacctacttacgaacgccgtaacgtcccgttacggacctaggggtacccttaagggaaacggttacgttcgggttacggaccgtttaaacggtttttactttaccggttacggtaaccgtaacgttaacgtaattttaaacgtttaactttaccgttacccttaccgtacgttaaccggtaccggtttacccggacggtaaaccgggtaacgtaagggtaacgtaaacgtaaccgaaacgttacgtacggtacggacttacgacctacttacg

SEQ ID NO: 182425 - DNA, 786 bp, Homo sapiens
  misc_feature: GYAE6OF02J1589.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccatcaactgcaagtccagccagagttatttttacagcctccaccaataagattacttagtcttggttccagcaacgaaaccaggacactccgtcctgcactgctactattacgtcgggtcgtaccgtacccgggtaacgtcccggggtccctacggaccgtacgttcgaggtcggaccgtagggcgggttcgtacgggaaccgtagtacgtttacacgttcctaccaacctacgtccgaagtaccgtaaccggtccttccgggacggtaccgggtacgttaaacgggaaacgtacggtttacgggtacgggttaccttaaagggtttttaactttaccggtaggtaaccctaggtaaacccgtttaaagtttaacttttaaccgtttaaccctttacccttaaccccggtacggttaaacgggtaccccgggttttacccgggaacccggtttaaaaccgggggtaaacccgggttaaagggttaaccgggttaaaaccgttaaaccccgtaaaaccggggtaaccggtttaccgggttaacggggaccgttaacccggtaccctaacccgtttaaccgg

SEQ ID NO: 182426 - DNA, 766 bp, Homo sapiens
  misc_feature: GYAE6OF02I7M2I.22.14.B03.1.454.CMB.1.raw
tcagacatacgcgtcacgaccggtgctcgatttagtgtgagtagttacgcgggggagcggtacaaccaggccagggccacgggcagctaagatggtgttgcagacccaggtcttcatttactctgttgactctcggatcgtcttggtgccgtccggggactagttccgttgatcgtaccctaagtctccagactcccgtggctgtgctcgtgggcgaggagggtccacgtactcgaacgtcggccacgtccagccagtagttacgttttacagtcctccgacaatacgactactactagtcttggtccagcaacgaaccgacgacagtccctcgtaccgtacgtcgtcgtcgtagtttaccgtgggtccgtccgttaacccgggtaacgttcccgggggttacctacggtaacccggtattaccggtacggtacggtacgtaaccgggtccgggtaccggttacggggaaaccgtacgttaacgtttaccaacggtttcctaccgtacccgtaacgtaccgtaacggacccaaccgtaccgttacgaccggttacggaccgttaaggtaaccggtaagttggtacggttacttaacggtttaacttcggtacgtaccgaactcgtaaagttacgtttactaaccgttttccctccgtaaagtccgtttaaccgtacggtacccgtaacggggaacccttaagggtaacgttaacgttaacgtaaacgtacggttacggtcggtaacggaccttaccgaccttaacg

SEQ ID NO: 182427 - DNA, 590 bp, Homo sapiens
  misc_feature: GYAE6OF02F5QMZ.22.14.B03.1.454.CMB.1.raw
  modified_base (416)..(416): a, c, t, g, unknown or other
  misc_feature (416)..(416): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagtcagaaaccaggacatcgtctgcactgctctatttactgggcgtctaccgggaactcccggggtcctgaccgattcaaggtgcgagtcgggtcgtggggacagtacttcaccgtctccaaccgatccaagccaagccctgacnggctagaacgtatgtggactaaggttttattacgttgttacaaggactaaagttaacttacttaactttccctacttaccgaagtacccgtttccgggacctaaacggggtaaccctaaagggttacgaaaacgttccaaaacggttacttcggtagacctggacctacctacg

SEQ ID NO: 182428 - DNA, 696 bp, Homo sapiens
  misc_feature: GYAE6OF02HNV37.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgaggacgggccaccatcaactgacaagtccagccagtagtttatttttacagtcctaccacctaaataagtagtttacttagtcttcggttaccagacaacgaaaccgaggactatcgtcctgcactgctctattacgtggcgtcgtaccgggacgttccgggtcctagacctatcgacgtcggcacggtcggtcgtcggactagtacttacgaccttcgtaccaccgtatacgcgtaccgacgccgttagaccgtagggtcctaaggaacggtacgtttgggtaccggttacgttttaaacggttttaagtttaacggtttcgtaaccgtaaggtacttaaagtttaacgttttaacgttaacccgtttcccgttaaccgtaaccgtaaccggtttacccggttaacccgggaaccgtaaaacggggtacccggttaaaggtaacggtaaacctaaccgtaaaccggtacgttggtaccggtactaacggccctaaccgtcg

SEQ ID NO: 182429 - DNA, 915 bp, Homo sapiens
  misc_feature: GYAE6OF02IPMGE.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggagggccaccgatcaactgacaacgtaccgagaccgaaggtaacgtttacttttttacgacgtccttacccaacctaaagttaaacggtaacgtttaaccgtttaaggtaccgttttacgggtttacccgaacggtaccaaacggtaaaaacccgaacgggtaacctaacggttacccggttcccgttacggtaccctaaccgtcggtaccttaccgttaacgtttttaaccggtccgggggtacccgttaacccggttaaccccgggggtaaaccggtttaccccggggggttccccttacgggaaccccggttaacgttaccgtacgggttaccgggccgtaacgggtccgggttacgtacgggggtaacctacggttaacgtttacccgaccgtttacctaccgtacccgtaaattacccgaacggtaccgtacggtcccgttaggaccgtaacgggtaccgttacggtaaaacggtcgtttagggaaccggttaccgtttaagggtttttaaaccttagggtttacgtaacgtaagggttaaccctttaaagttttaactttaccgtttacgtttacccccgttaacttaacggtaacggtacccgggtttacggaacccggttaaacggggaaccgttaacgggtacgtaaaacgtaaccggtaaaaccgttacgtcgggttaggtaccctacggtacccgttaaccgtaccg

SEQ ID NO: 182430 - DNA, 535 bp, Homo sapiens
  misc_feature: GYAE6OF02I84Y1.22.14.B03.1.454.CMB.1.raw
  modified_base (310)..(310): a, c, t, g, unknown or other
  misc_feature (310)..(310): n is a, c, g, or t
  modified_base (460)..(460): a, c, t, g, unknown or other
  misc_feature (460)..(460): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttacngggcgtcgtacccgggaatccggggtcctgaccgtattcagtcggcagcgggtctgggacagtactttcactctcacctatccagcacgcctgcacggctagaagagtgtggctagtttatagttgcagctaatattatacttcctctanacgtcgttcggactaacgggtaccaagggtagaaactccgaaaacgtacgttaggtacgctacgacctacctacg

SEQ ID NO: 182431 - DNA, 599 bp, Homo sapiens
  misc_feature: GYAE6OF02I0MLE.22.14.B03.1.454.CMB.1.raw
  modified_base (475)..(475): a, c, t, g, unknown or other
  misc_feature (475)..(475): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctctgggcgaggaggccaccatcaactgcaagtccagccagagttatttttacagtcctccaaccaataaagagttaacttagtctttggttaccagactaagaaaccaggacatccgtctgcactcgctctatttcgtgggcgtacgtacccgggtaacgtccgggtccctacgaccgtatctagtcgcgaggccgggtcgtgggactaggtattccactctacacctatcgacgcgacgcctcggcaggtcctagggaatgtggttaggacttagtttactagttcgtanagtactaagttaatttaactacgtttccctacgtttacgacgtttaccgttaccggaccgtaacgggtaacctaagggtacgaaaacttcgaaaacgtcttaggaccgtctacgactacctacg

SEQ ID NO: 182432 - DNA, 590 bp, Homo sapiens
  misc_feature: GYAE6OF02I1K2X.22.14.B03.1.454.CMB.1.raw
  modified_base (345)..(345): a, c, t, g, unknown or other
  misc_feature (345)..(345): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagctacttagcttggttccagcaagaaaccaggacactcctcctctactgctcatttactggcctcgtacccgggatccggggtcctgaccgnttcgagtggcagcggtcgtaggacagtatttccacgtctacaccatcagcgacgcctgcgacggcctaggaacgtagtggtacgtacgtagttttattaccgttgtactagtactaaacgttatttaattacctttaccctccctagaacgttaccggttaccgaccggtaacgggaacccgtaaggtaacggtaaactaaccgaaaaccgttacgtcggttacgacgtaccgacgacccttacg

SEQ ID NO: 182433 - DNA, 524 bp, Homo sapiens
  misc_feature: GYAE6OF02HM7A4.22.14.B03.1.454.CMB.1.raw
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactgggctctacccgggaatcccggggtcctgaccgattcagtggcaggcgggtctgggacagtattcactctcaccatcagcagcctgcagctgaanatgngcagtttatattgcagctaattattatcttccctctacgtacgtacgttcggacctaacgggacctaagggtacgaaataccgaaaacgtacgtggtacgctacgacctacgtacg

SEQ ID NO: 182434 - DNA, 551 bp, Homo sapiens
  misc_feature: GYAE6OF02GRHMG.22.14.B03.1.454.CMB.1.raw
  modified_base (417)..(417): a, c, t, g, unknown or other
  misc_feature (417)..(417): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccacaataagagttacttagcttggttccagcagaaaccaggatatcgtcctgcactgctctatttactgggcgtcgtacccgggaatcccggggtcctggaccgattcagtggcaggcgggtcgtgggacagtactttcacctctcaccatcgagcagcctgacgaggctagaagntggtcgctagttttatattgtctagactaaattattaattacttcctccttacagttaccgttcggaccgtaacgggactaagggttacgaaacttacgaaacgtaacgttggtacggctacgaccgacgtacg

SEQ ID NO: 182435 - DNA, 534 bp, Homo sapiens
  misc_feature: GYAE6OF02FUEFU.22.14.B03.1.454.CMB.1.raw
  modified_base (307)..(307): a, c, t, g, unknown or other
  misc_feature (307)..(307): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcagtccagccagagtatttttacagctccacaataagagctacttagcttggttccagcagaaaccaggacatcctcctctactgctcatttacngggcgtctacccgggaatccggggtcctgaccgattcaggtgcagcggtcgtgggacagtatttcactctcaccactcacgcagccgtgcaggctgaagatgtgctaagtttattactgtacagtacagttattattatttcctcctacgacgttaccgttcgaccgaagggaccgtaaggtacggaaacttacgaaacgtacgtgtacggctaggaccaccgtacg

SEQ ID NO: 182436 - DNA, 514 bp, Homo sapiens
  misc_feature: GYAE6OF02F147O.22.14.B03.1.454.CMB.1.raw
  modified_base (309)..(309): a, c, t, g, unknown or other
  misc_feature (309)..(309): n is a, c, g, or t
  modified_base (404)..(404): a, c, t, g, unknown or other
  misc_feature (404)..(404): n is a, c, g, or t
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
tcagacatacgcgtcacgaccggtgctcgatttagtgtgagtagttccgcgggggagctacaacaggcaggcaggggcaacaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttacnggcgtctacccgggatccggggtcctgaccgatcagtggcaggcggtctgggacagactttcactctcaccatcagcagcctgcaggctagaagntgtgactagtttattntgtcagcatattatacttctcctnacgtcgttcgacctaagggaccaaggtagaaactaccgaaacgtaacgtggtagccaggccaccgtatcg

SEQ ID NO: 182437 - DNA, 675 bp, Homo sapiens
  misc_feature: GYAE6OF02G5LPW.22.14.B03.1.454.CMB.1.raw
  modified_base (196)..(196): a, c, t, g, unknown or other
  misc_feature (196)..(196): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagnggccaccatcaactgacaagtccagccagagttactttttacagtctccaccaataagtacgttaacttagtcgttggtccagtacaacgaaaccaggactactccgtcctgccactcgctactactttacgtggccgtaccgtacccgggtaacgttcccgggtccacgtaccgtattcgacggtggacgtaggtccggtcggtacgggactacggtacgtttccacttccgtacctaaccgtatccgaacgtccaaccgtcctggacgtaacggtcgtaggaaacggtgtttcgggactaccgtttaagttttaccgttgtcgtaactaacggtactttaaaccttaagtttacctttaccttcccgtaactacgttaaccgtaccggttaccggaaccggtaaccggggtaaccgtaagggtacttaaacgtaaccgaacgttacgtcggtggtaaccgtctaccgaccgttaacg

SEQ ID NO: 182438 - DNA, 516 bp, Homo sapiens
  misc_feature: GYAE6OF02GHBXF.22.14.B03.1.454.CMB.1.raw
  modified_base (311)..(311): a, c, t, g, unknown or other
  misc_feature (311)..(311): n is a, c, g, or t
  modified_base (385)..(385): a, c, t, g, unknown or other
  misc_feature (385)..(385): n is a, c, g, or t
  modified_base (430)..(430): a, c, t, g, unknown or other
  misc_feature (430)..(430): n is a, c, g, or t
  modified_base (506)..(506): a, c, t, g, unknown or other
  misc_feature (506)..(506): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagctacttagcttggttccagcagaaaccaggacatcctcctctactgctctatttacngggctctaccgggatccgggtcctgaccgattcagtggcagcggtctgggacagtatttcactctcaccatcancacgcctgcaggctagaagatggtggactagtttatactgtcagntaattattattacttcctctcacgtacgttccgactaacgggactaaggtagaaactacgaacgtactgtcggacncgacactacg

SEQ ID NO: 182439 - DNA, 731 bp, Homo sapiens
  misc_feature: GYAE6OF02G75E4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagactcctggctgtgtctcgtgggcgaggacgggccaccgatcaactgacaagtccacgccagtagttatttttacagtcctccaactaataagtagtttactagtctttggttaccagcgaagaaaccgaggacagtccgtcctgccactgctctagttcgtagggcgtaccgtacccgggaagttcccggggtcctcggtaccgtacttcgaggtcggacgtggcgggttcgtagggactaggttactttccaactcctaccgactcgtacgacgccacgtccgtagaccgtacggtactaggtaacgtagttcgggtaggtacgtttaaggttttactttaaggttcggttaaccaacggttaacctttaaacgtttaactttaacgttaacccgttttaccccgttacccgtaacgttaacccgggtaaccgggttttaccccggggaacccgttaaaaccgggggtaaacccgtaaggggtaaaccgtaaacgttaaaccccggtaaaacgtaccgggttacggtacggtacccgtaacggtacccttacgtaaccg

SEQ ID NO: 182440 - DNA, 754 bp, Homo sapiens
  misc_feature: GYAE6OF02GW36Y.22.14.B03.1.454.CMB.1.raw
  modified_base (195)..(195): a, c, t, g, unknown or other
  misc_feature (195)..(195): n is a, c, g, or t
  modified_base (733)..(733): a, c, t, g, unknown or other
  misc_feature (733)..(733): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcagnggccaccatcaactgcaagtccagccagtacgttatttttacagctaccaacctaataagtacgtttacttaacgtcgtttggttaccagtaccgtaaacgaaaccgacggtaacctaacgttccgtcctacggacctacgtcgtacctacttacgtttaaccgtcggggaccggttaccggtaaccccggggaaccgtttccccggggggtacccttacggggtaacccgtacgtttacccggtaaggtccgggtaccgtacgggtccggggttacggttacgggggtaacctacgggtacgttttaccgaacccgttaccttaccctaacccgtaacgtaccgtaacgcccgtaacggtccgtcgacgtacgggtacctacgggtaagtacgttcggtacggtacgttaattttacgtaggttccgtaacgtacgtaactaagttacttacgttaccttccgttacctgtaccgtaccggttacgaccgtaacgggtaaccgaagggtactaaacgtacgaaacctcggttacggngtaccgtacgactaccgtacg

SEQ ID NO: 182441 - DNA, 860 bp, Homo sapiens
  misc_feature: GYAE6OF02IJ1SL.22.14.B03.1.454.CMB.1.raw
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatcgacccagtctccagactccctggctgtgtctctgggcgagacgggccaccatcaactgcaacgtccagccagtagttatttttacagcctccaacctaataagtagtttaacttagtcgtttaggttccaagcaacgaaacccgaggactaacttccgtccttaggaccactggtccttacgtacttttacggtgggaccggttaccgtaaaccccgggggtacttccccgggggtacccctggtaacccgttagttccaacggttcgggaccgagggtccgggggttaccgttagggggaaccctaagttaccgttttaccgaacccgtttcctacccaaacccgtacgttaccgacggacccgtaacggcccttaacggccgtaaccggggtaccgttacgggaaacggttacggtttacggggttaccgggttacccgtttaaaggttttttaactttaacggtttacggttaccggttaaaggtaaccctttaaagtttaaacctttttaagttaaccccgtttttacccctttcccggttaaacgtaaccgggtttccgggtttaacccgggtacccggaaaaaccggggggttccctaaaaagggggttaacccgtaaaaacggttaacccgaaaaaccggtttaccgtacgggggtttaaccgaccgttaaccggaccccgtacccggtttaaccg

SEQ ID NO: 182442 - DNA, 672 bp, Homo sapiens
  misc_feature: GYAE6OF02IWL31.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactcgcagtccagccagtagttatttttacagctccaccaataagacgttacttagcttaggttccagcagaaaccaggacatcgtctgcactgctctattacgtgggtcctacgtaccggacgtcccgggtcctacgaccgtatcgaggtcgcgaggtcgggtcgtacgggaactacggtacgtttctaacctctaccaaccgactacgagtccgacgtccctaggacgacggtacgtaagggaagtgttacgggtacgggtacttaagggtttttaacttacggttagttaccgaggtaccttaagttaactttataccttttcccgtaccgttaccgtacgggttacccggttacccgggaaccggtaaacccgggggtaaccttaaacggggttaacgtaaaacgtaaccggtaaacggttaaccgtgggtaccggtagtacccggactaacccgtacg

SEQ ID NO: 182443 - DNA, 763 bp, Homo sapiens
  misc_feature: GYAE6OF02FF9WR.22.14.B03.1.454.CMB.1.raw
  modified_base (327)..(327): a, c, t, g, unknown or other
  misc_feature (327)..(327): n is a, c, g, or t
tcagacatacgcgtcacgaccggtgctcgatttagtgtgagtagtcccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagaggccaccgatcaactgcaacgtccagccagagttatttttacagctaccacaataagagttacttagtcgttgttccagacaagaaaccgaggtacacgtcgtcctgcactgtcctactagttttaccgngggtcgttaccgtacccgggtaacgtcccgggtacccgtacgaccgtattccgaaggtcggacgacggtcgggtcgtagggaactagtacgtttacgacctcgtacccaaccttacaccgtacgaccgaaccgtcccgtacggtaccgtacggtacgtaacggaacggttacgttacgggttcgggttaccgttaaaggtttttaactttaacggtttacgttaccgtaacggttaacgtaaaagtttaaacgtttttaactttaacccgtttacccgtttaacccgttaccgtttaaccgggtaacccgggttttacccgaaacccggtaaccggggtaaaccggtaacgggttaaaacggtaaacgttaacccgtaaaaccggttaacgttacgggttaaccggtaccgttacccgtaccgtacccgttaaccg

SEQ ID NO: 182444 - DNA, 760 bp, Homo sapiens
  misc_feature: GYAE6OF02F72PQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggccaccatcaactgacaacgtccagccagtagttaactttttacgagtcctacccacctaaataagtacgtttaacttagtcgtttcggttaccagacaagaaacccgaggactatccgtcctgcctacgtcgcctctacgtttacgtcgggtacccgttaccgtaacccgggtaacgtcccggggtacccgtacggaacccgttacgttccgacggtcggccgtacgggtaccggggtcgtacggggactaggtactttaccgaccttccgtacccaacctataccaacgcccgacgtcccgtagccgtacgggactagggaacttacgggttcgggtacggttaacgttaacgtttttactaccggttacggtacgtaacgttaacttaaagtttactttaacgttaccctttacccttaccggttaccgtaacgggtaccccggtttaccgggaacccggtaaaccggggtaaccgttaaagggtaaccgaaaacttaaccggtaaaaccggtacggttcgggtaacggccgtaaccgtaccgtaacccgtttacg

SEQ ID NO: 182445 - DNA, 619 bp, Homo sapiens
  misc_feature: GYAE6OF02I1TAO.22.14.B03.1.454.CMB.1.raw
  modified_base (301)..(301): a, c, t, g, unknown or other
  misc_feature (301)..(301): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagcagagtatttttacagctaccaccaaataagagttacttagcttgttccagcaagaaacaggacatcgtctgcactgcctnattacgtggcgtacgtacccggaacgtccgggtaccctgaccgattacgagtcggcgacggtcgggtcgtacgggacctagtacgttaccgtactccgtacaaccgtatccgaagccacgtccgtacgcgaagtcgtagaagtacgtcggtcggacctaaggttttaatacgttcgtacgtagtacctaaattagtttaacttacttacccgtcttaccgagtaccggttacgaaccggtaaggtaaccctaagggtacgtaaaaccgtacgttaaaacgtaaccgttggtaacggtaccgtacacccgtaactacgg

SEQ ID NO: 182446 - DNA, 775 bp, Homo sapiens
  misc_feature: GYAE6OF02ITKQD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgagagggccaccatcaactgacaagtccagaccagtagttatttttacagtcctaccaaccaataacgtagtttaaccttagtcttggttaccagtccaagaaaccaggacaatcgtcctgctactcgctactatttacgtcggtacgttaccgtaaccgggaacgttcccggggtccctcggaaccgtacttacgaacgtcgggtaccgacggtcgggttcgtacggggactaaggttacgtttacgaccgttccttaccgaaccctacgtaccgttaacggaccgtaacggtccgttgaccgtacgggtacctaaggtaacgtagttacgtgggaacctttaaggtttaactttacggttacttaccgaagttaccttaaaacgtttagtttaaccgtttacgtttaccccttacggtaaccgttaacgttaacccgggttacccgttaacccggggaaacggggttaaaccccgtaaacgggggtttacggtaaaaaaccggttacccggtaaaaaccggtttaaccgggttaccggtaacggttaccccgttaccgggtaaccttaacccttaacgg

SEQ ID NO: 182447 - DNA, 646 bp, Homo sapiens
  misc_feature: GYAE6OF02JE6CC.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagtagttaatttttacagtcctaccgaacctaataagtagttaacttagtcgttggttccagctaacgaaaccaggactatcgtcctgctactgcctactactttacgtcgggaccgttccgtacccgggtaacgttcccggggtacctacggaccgtattcgtagtcggactacggcggtgtacgggactagtacttctacgtcctacacctagtaccacgtcgacgcccgttagccgtaggcgtaataaggtagttgtacggtacttaagttttactagttcgtacagtacctaagttacttattaccgttcctacgttacaggttacccgttacggaaccgtaacgggaccgtaagggtaacggtaaacctaacgtaaaccggtaacttgggtaacgtccgtagtaccccaatttaccgg

SEQ ID NO: 182448 - DNA, 685 bp, Homo sapiens
  misc_feature: GYAE6OF02GTNYB.22.14.B03.1.454.CMB.1.raw
  modified_base (302)..(302): a, c, t, g, unknown or other
  misc_feature (302)..(302): n is a, c, g, or t
  modified_base (419)..(419): a, c, t, g, unknown or other
  misc_feature (419)..(419): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggacgggccaccatcaactgacaacgtccagccagtagttatttttacacgtcctaccaaccaataagtacgttacttagtcgttggttccagtacaagaaaccgngacatcgtcctgcactgtctacgtaactttacgtcgggtcgtacgtaccgaaggggtacgtcccggggtccctaggtaccgtattcgacggtcggcgaggtcgggtacgtgggaacngttacgttcactctacaacctactcgacgcacgtccgacgcgtaacgcgtaaggacgtagtcggtagtacgtagttttacttagttggtactacgtacttaactttcgtttaacttaccgtttacccgttaccgtaacgttacggttaaccgttacccgggaaccggtaaaccggggtaacccgtaaaggggttaaccggtaaaaccgttaaccggtaaaaccggtaccgttaggggtacgtaaccgttaccggacccttaaccgg

SEQ ID NO: 182449 - DNA, 759 bp, Homo sapiens
  misc_feature: GYAE6OF02IS08L.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacagttgtgatgacccagtcctccagactccctggctgtgtctcgtgggacgaggacgggccaaccgatcaactgacaagtccagccagagttatttttacgagcctaccaccaagtaagagttaccttagcgtttcggttaccagtaccaaacggaaaaccagggtaacctaacgttaccggtaccctcggactaacctcggtaccttactacgtttaacggtcgggtacgttcccgtaaacccggggtaacgtccgggtcccttaggaccgtagttcgaaggtccgaacgtacggcggttacgcgggaacgtagtactttaaccggacttcctccgaaacctctaccgaaggcctaaccgtccgttcgaccgtaaggacttagaaagtcgtaggttcggtaaccgttaggttttattaacgttcggttacaaccggtcttaaaacttaggtttaacttaccgttcccgttacgtaaccgaagggtttacccgttaccgggtaacccggtaaacggggtaacccgtaaacggggttacgtaaaaaaccgtccgtaaaaaaccggttcgtcggggtttaaccgaacccgtttcggacccgtaaccgttaaccgg

SEQ ID NO: 182450 - DNA, 587 bp, Homo sapiens
  misc_feature: GYAE6OF02F4YDM.22.14.B03.1.454.CMB.1.raw
  modified_base (311)..(311): a, c, t, g, unknown or other
  misc_feature (311)..(311): n is a, c, g, or t
  modified_base (412)..(412): a, c, t, g, unknown or other
  misc_feature (412)..(412): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatccctcctctactgctcatttacngggctctacccgggatccggggtccctgaccgattcagtggcagcgggtctgggacagtatttcactcctcaccatcagcacgcctgcaggcctaggaagngttgtggctaagtttatactgtcaagactaattactttattactttccctcctacgtaacgtaccgtttaccggacccgtaaaggggtaccctaaaggggttacggaaaaccttaccgaaaaacgttaaccgttagggtacggtaccgttacggaccctaccccgtagttacccg

SEQ ID NO: 182451 - DNA, 678 bp, Homo sapiens
  misc_feature: GYAE6OF02JK2I0.22.14.B03.1.454.CMB.1.raw
  modified_base (553)..(553): a, c, t, g, unknown or other
  misc_feature (553)..(553): n is a, c, g, or t
tcagacatacgcgtcacgaccggtgctcgatttagtgtgagtagttccgcgggggaggctacaacaggcaggcaggggcgagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccaaccaataacgagttacttagtcttaggttccagtcaagaaaccaggacatcgtcctggccactgtctactacgtttactcggggtccgttaccgtacccgggtaaacggtcccggggttaccccgtacggtaacccggtacgtttaccgaaggttcggggccagggtcccgggtcggtacggggaactaggttacgtttacccggtactttccgtacctaaccctacgtaccgtaacggaccgaacgtcccgtagcgtacgggccgtaagaaggtacgtcgtggtacttaagtttattacgttcgtanacgtacgtaattattacgttaacttccttacctacgacgttaccgtccggtaacgtaacgggtaacccggtaaaggtacgtaaactaaccgaaacggtagttaacgcgtagtaccgaccacgtac

SEQ ID NO: 182452 - DNA, 691 bp, Homo sapiens
  misc_feature: GYAE6OF02GQJH8.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaacgtccagccagagttatttttacagctaccaccaataagtagttacttagcttggttccagcagaaaccaggacatcgtcctgcacgtgctctatttacgtgggtcctaccgtacccgggtaacgtcccgggtcctcgaccgtattcgaggtcggcgaggtcgggtcgtacggggactaagtactttacgaccttccgtaccaaccgtatccgaacgccaacgtcccgtgaccgagggtccctagggaaacgtcgttaggtaccggtatttaagtttatttacggttcgtaccgtaaagtactaaatttaacgtttaactttaccgtttaacccctccgttaacgtaacgttacccggttaccggacccgtaaaacggggaccgttaaacggggttaacgaaaacgttaacccgtaaaaccggtaggtttacgggtaaccggtccgttaacggtacccctaaaccggtttaccg

SEQ ID NO: 182453 - DNA, 661 bp, Homo sapiens
  misc_feature: GYAE6OF02FIHOO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagactccctggctgtgtctctgggcgagacgggccaccatcaactgcaagtccagccagagttattttttacacgtcccccaccaataacgagttacttagcttggttccaggcagaaaccaggacatcgtctgcactgctcatttactggccgtcgtaacccgggattccccggggtccctggacccgtattccgaggtcggtaccgacggcgggtcgtcgggactacgtactttaccaccgttctaccgacccaattaccacgtccaacggtcccgttacgacgtaacgggtcctaaggaaccggtaagttggttacgggtaccttaaggttttactttaagtcgttaccgtaaggtacctaaagttaacttttattaacctttccctacccttacgaccggtaccgttaccggaccgtaaaccgggccgtaaagggtacgaaaacgttaccgaaaccgtacgtacggtacgaccgtcgaccgacctattccg

SEQ ID NO: 182454 - DNA, 699 bp, Homo sapiens
  misc_feature: GYAE6OF02F2OHI.22.14.B03.1.454.CMB.1.raw
tcagacatacgcgtcacgaccggtgctcgatttagtgtgagtagttccgcgggggagcgtacaacaggcaggcaggggtcagcaagatgggtgttggcagtacccaggtcttcatttctctgttgctctggaatctctggtgcctacggggacattgtgatggacccagtctccagactccctgggcctgtcgtctcgtggcgagacggccacatcaacgtgcaagtccagccagtaggttactttttacgacgctccacaataagtagtttacttagtcgttcggttaccagcaagaaaccaggtactagttcgtccgtcgcgtacctcgcctaccgtaagtttacggcgggtccgttaccgtacccgggtaagttcccggggtccgtgaccgtattcgaggtcggcacggcggtctagggactagtacttccactcgtcaccgtatccagtacagtcccagaccgaggtacctacggaagtacgttcggtacggttaccttagttttaattacgtttcgcgtaacgtacctaaacgtttacgttaagtttaacctttccccgttacccttacgtaaccggtttcccgggttttaccggaaccggtaaccggggttaaccgtaaacgggttaacggaaacgttaaccggaaaacggttacttacggtacggttactaccggtaccgtaaccttacggg

SEQ ID NO: 182455 - DNA, 700 bp, Homo sapiens
  misc_feature: GYAE6OF02HEWZ3.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctcagactccctggctgtgtctcgtgggcgaggacgggccaccatcaactgacaacgtccagccagtagttatttttacagcctccaacctaataagtattacttagtcgttggttccagcaacgaaaccgaggacatccgtacctgacctacgtcgcctctacgtttcgtacgggtctaccgtacccgggtaacgtccccggggtacctggtacccgtataccgaggtcggcgtacggtcgggtcgtagggaacctagttacgtttaccacttcctaccgtaaccctgtacccgaacgccgtaacggtccctaggaccgtaagggtcccgtaagaaacgttggtcggtacgttacttaaagggttttatacgttacggtacctaaggtaccttaaagtttactttactaccgttttcccaacgttaccgtaggttacccggtacggtaaccggtaaacgggtaacgttaaagggtacctaaattaccggaaaagttacggttacgtcggtacccgtacacccgggtaactacgg

SEQ ID NO: 182456 - DNA, 587 bp, Homo sapiens
  misc_feature: GYAE6OF02I2GFT.22.14.B03.1.454.CMB.1.raw
  modified_base (254)..(254): a, c, t, g, unknown or other
  misc_feature (254)..(254): n is a, c, g, or t
  modified_base (412)..(412): a, c, t, g, unknown or other
  misc_feature (412)..(412): n is a, c, g, or t
  modified_base (434)..(434): a, c, t, g, unknown or other
  misc_feature (434)..(434): n is a, c, g, or t
tcagacatacgcgtcacgaccggtgctcgatttagtgtgagtagttccgcgggggagctacaacaggcaggcaggggcagcaagatggttttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataaganctacttagcttcggttccagcagaaaccaggacatccctcctctactcgctctatttactgggtcgtcgtacccggaacgtcccggggtcctcgaccgattcagtcggcaggtcggtcgtgggacagtatttcgacttcacacagtcagcacgcctgnacggtctagaagacttggcgtnttaagtttatttagtgtactaggacttaattattatttaccgtttacctccctacgtaacgttcggttaccgaccggtaacggacgtaacgggtacgaaaacttaaccgaaaccgtagttacggtagtacctacggaccgtacctagttaccg

SEQ ID NO: 182457 - DNA, 647 bp, Homo sapiens
  misc_feature: GYAE6OF02HG2VR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcaagaaaccaggacatcgtcctgcactcgctctatttacgtgggtccgttaccgtaaccccggggtaagttccccggggttccctcggtaacccgtattccgaagttcggaccagggcgggtcgtaggggactagtactttaccacttctaccaaccctatccaacggcacggtccctgctagggcctaggaagtgttaggtcggtacgttaagttttattagtttagtactacgtactaaatttagttttaacttactttcccttaccgtacgtaaccgtaccggtttacccggaaccgtaacggggtaaccctaagggtacggtaaaactaccgtaaacgtacgtcggtaggacctacggacctaccgtacg

SEQ ID NO: 182458 - DNA, 845 bp, Homo sapiens
  misc_feature: GYAE6OF02GGVXI.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacagttgtgatcgacccagtctccagacctccctggccgtgtctcgtggcggacgacgggccaccactacaactacgacgacgtaccacgaccgacgtaagtttactttttaactacgtcctacccaacctaaacgttaaaggtaacgtttaacgttacgtccgtttcggttaccgtacgacgaaacgtaaaccgaacggtaacaacttccgttacccgtagtacctactacggtccttactaacgttttaccggtcggggtaccgttacccggtaaccccgggtaaccgggttccccgggggtcccggtacggtacccggtacgttccggaacgggtcggaccggtacgggtccgggtcggttagggaacgtacggttactttccgtaccgtccgtaccaacctctaccgtacggtccgacggttacccgtacggccggtaacggtcgtaacggtaaggtacggttcggtacgggtaacgtttaacggttttaaactttacggtttacggtactacgtaaacttaacgttttaactttacgtttacctttcccggtaccttaacggtaccgggtaaccggtttccggaaaccgggtaacgggtaaccgttaacggttaaacggttaacctaaacgtaaaccggttacggttacggttccgggaccttaaccggacctttaacccggtatttaacccgg

SEQ ID NO: 182459 - DNA, 820 bp, Homo sapiens
  misc_feature: GYAE6OF02JEJIK.22.14.B03.1.454.CMB.1.raw
  modified_base (288)..(288): a, c, t, g, unknown or other
  misc_feature (288)..(288): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttattttacagctaccaccaataagagttactagacttggttccagactagaaacccgnggacgatcgtacctacgcctaactcgtcctactaactttaccgtggggtccgttaccgttaacccggggaaccttcccgggggttaccccttacgggtaacccgtaacgttttccgaaacgggtttcggaccctaaagggggtccggggtttaccggtaccgggggtaaccgttaaacgggttaaaccgtttttccgtacccggtttacccttacccgggaaacccctaacttaacccgacgggtacctaacgtaacccgttcggaccgtaaacgggccctttaggaacgttaccgtagggtaccgggaacgttaagttttacgtttacgttttaacggccgtaaacggtaaccttaaagtttaaccttactttaacggttacccttaccgtaaccgtaacggttaccccgggtttacggacccggttaaaagggtacccgtaaaacggggttaccgtaaaaacggtttaaaccgaaaacccggttaccgttaacggttacgggttacctacggttaccctacgggttaacc

SEQ ID NO: 182460 - DNA, 626 bp, Homo sapiens
  misc_feature: GYAE6OF02HQJOQ.22.14.B03.1.454.CMB.1.raw
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (367)..(367): a, c, t, g, unknown or other
  misc_feature (367)..(367): n is a, c, g, or t
  modified_base (420)..(420): a, c, t, g, unknown or other
  misc_feature (420)..(420): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaacgtccagccagagttatttttacagctaccaccaataagagtttacttagcttggttccagcaagaaacaggacactcgtccttnactgctcatttacgnggtctaccgtaccggaacgtccggggtccctcgacgtactacgagtgacgnggtcgggtcgtgggacagtagtttacactcgtcaacccatacgagcacgtccncgacgaggcgtagaagagttggtggtaccgttagtttaagtttattcgtataacggtactaaatttaagttaactttatttaccccccccgtttattaccgtacgttaaccgttaccggtacccgaacggggtaaacccgtagggtaaacgtaacgtaaccgaaacgtacgttacggtcgtaaccgtcgaccgtacgtacttaccg

SEQ ID NO: 182461 - DNA, 627 bp, Homo sapiens
  misc_feature: GYAE6OF02IAB1O.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgaccagtctccagactccctggctgtgtctctggcgagaggccaccatcaaactgacaacgtccagccagagttatttttacagctccaccaataagagttacttagcgttggtccagctaagaaccaggacatcgtctagcactgctacatttacgtcggcgttaccgaaccgggtaacgtcccggggtacccgtacggaaccgtagttccgaggttcggctaaggtccgggtacgtcggggaactaggtactttcccgacttccgtaccaccgtatacgaacgctaacgccttcgacgtacggaccgtagaagtaacgtttcgacgtacgttagttttattacgttcgtacgaagtactaagttatttaacgttactttcctacctacgaggttaccgtcggtacgaacggtaacggaacggtagtaaaccgttaacaacggtaacttggacgtactcggacctacgtacg

SEQ ID NO: 182462 - DNA, 691 bp, Homo sapiens
  misc_feature: GYAE6OF02JWR3I.22.14.B03.1.454.CMB.1.raw
  modified_base (130)..(130): a, c, t, g, unknown or other
  misc_feature (130)..(130): n is a, c, g, or t
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
tcagacatacgcgtcacgaccggtgctcgatttagtgtgagtagttccgcggggaggcgtacaacaggcaggcagggcagcaagatggtgttgcagacccaggtcttcattctctgttgctctggatctntggtgcctacgggacattgtgatgacccagtctccagtactcccgtggcctgtgtctcgttggcgagacgggccaccgattccgaaactgacaacgtccagccacgagttatttttacnggaccttccacctaataagagctacttagcttgttaccngtccagaaacgacgtaccacgtcctaccgtctaactcgtctcctatttacgtggtccttacgaacccggtacgttcccgggtcccttaggaccccgttatccgtaaggttcggaccgtaggtccggggtacctgggggtacaaccgggttaactttccgaacgttcctaaccggtaccctaagttccccagtccgtaacgtcccgttcgccgttaaaggccctaggtaaacgtgttggtacggtacctttaagtttacgtagttcggtctacgtacctaattagttacctttactccgttctacctagttccgttaccgggacgttaaccgggaacctaagggtaacctaaacgttaacgaaacggaccttaggtaccggtagtaccggaccctacgtaacgg

SEQ ID NO: 182463 - DNA, 639 bp, Homo sapiens
  misc_feature: GYAE6OF02H140Z.22.14.B03.1.454.CMB.1.raw
  modified_base (316)..(316): a, c, t, g, unknown or other
  misc_feature (316)..(316): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtccagccagagttatttttacagcctccaccaaataagtagttacttagctttggtccagcaagaaccaggacatccgtcctgcactgcctctatttacgnggtccgtccgtaccgggtacgtcccggggtcctacgaccgattccgaggtcgcgacggcgggtacgtgggactagtacttcacctctacgaccatcagtcgacgcctggacacggtaactggaaacgtgttacggtaggtccttaagttttattacgtttcgtacaaggtactaaagttactttaacttaccgtttccctacccgtacgagggttacccgttaccgggaacccgaacggggtaaccttaaagggtacggtaaaaaccttaacccggaaagtaaccgttcgggtacggtacctacggtaccctacccttaacgg

SEQ ID NO: 182464 - DNA, 661 bp, Homo sapiens
  misc_feature: GYAE6OF02GR5DP.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatccaactgcaacgtccacgccagtagttactttttacagtctaccaaccaataagtagttacttacgtcgttcggttccacgacaacgaaaccgacggacactcgtcctcgcactcgctctactttacgtcggtcgtaccgtaccgggtaacgtcccggggtccgtcgaccgtacttcgaggtcggcgacggcgggtcgtgggacgtagtacttacgggggggggggggggtacctcctaccacctactacacgacgacgaccgtacgtacgacggacgtagtaaggtagtaggtcggtacgttagtttatttagttacgtcgtacgtacgtaattaattacttacttccttacctacgtacgtacggttacggacggtaacggtaacggtaacggtaacggtaaacgtaacgtaaacgtaacgtacgtacggtacgtcgtaccgtactacg

SEQ ID NO: 182465 - DNA, 611 bp, Homo sapiens
  misc_feature: GYAE6OF02FQ7KZ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccacaataagagttacttagtcttggttccagtacaacgaaaccaggacatcgtcctgcacgtgctctatttacgtggcgttaccgtaccgggaacgtccgggtcctcggaccgattcgagtcggcgaggcggtcgtagggaccagtactttcgactccgtacacctaatccaagctacgtcctgaccgaggctagaagtagtgtcggacttagtttacttagttgtacaagtctaaatttatttaacttctttcccgtaccttacaacggttaccggtttcggaaccggttaaggaaccgtaaagggttaacttaaacgtaaccgaaacggtaaccgtaggtaccggtaatcggtaccctaactacgg

SEQ ID NO: 182466 - DNA, 906 bp, Homo sapiens
  misc_feature: GYAE6OF02IFWGT.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgaccagtctccagacctccctgctgtgtctcgtgggcgaggacgggccaccatacaactgcgaacgtccacgccaagtagttactttttacagcctaccaacctaagtaagtagtttacttagtaccgtttggttccagtacaacggtaaaccgaggtacctaacgttcgtccctcggacctaccgttggccttcgtacgttttaccgtcggggtaccttacccggtaaccccggggtacggtttcccgggggtacccctacggaaccccgttagttaccggtaggttacggggacctaacgggggttccggggtaccggttacgggggggtaacctaacggggtttaacttttccccgtaaccggttttacccttacccggtaaaccccgttacgttacccggacgtaacccgaaccggttcccggttacggacccgtaccgggtaggttacggaaacggttacggtacgggttacgggttacccgtttaaaggttttttaacgttttacgtttacgggtttaaccgtaaacggtaccgttaaattttaacggttttaacctttaaaccgtttttccccgtaaacctttcccggggttaacgtttaccgggtttaccccgggaacccgttaaacccggggggtaaccgttaaaaacggggttaaccgggttaaaaccgtaaccccggtaaaaaccgttacgggtttcgggttaacggtacccgttacgggtacccttaaccgttacccg

SEQ ID NO: 182467 - DNA, 638 bp, Homo sapiens
  misc_feature: GYAE6OF02GINYA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctactatttacgtcgggtcgtaccgtacccgggtaacgtcccggggtccctcggaccgtattcgaggtcggcgaggtcgggtcgtggggaactacgtactttcgaccttccgtaccaccgtactccacgtccacggtcctacggaccgacgggtctaggaagtagtggtacggtcttaagtttatttagttgtaccgagtactaaattacttattactttccctactacgtacggtaccgttaccggaccggtaacggggtaaccgtaagggtacggtaaaacgttaccgaaaaccggttacgttacggtacggtacgtacgtacccgtaccgtaccg

SEQ ID NO: 182468 - DNA, 681 bp, Homo sapiens
  misc_feature: GYAE6OF02IYU53.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacgggccaccatcaactgacaagtccacgccagtagtttatttttacgacgtcctacccaaccaaataaggacgaccttaacttagtccgtttcggttaccagaccaaagaaaccaaggactactcccttcctactactcgcctactatttacgcgggtccgtaccggtaacccgggtaacgtcccggggtccctagacccgtattacgaggtcggcgaggcgggtcgtacggacgtagttactttacacctcctccaaccgtctacgtagaccgtacgtccgtacggcgaacggtcgtagaaacgtagttgggtaacggtacctttagttttactagtttcggactaagttactaaatttacgtttaacttacgtttccctaccttggtaacgttacccggtccggaacgggtaaccgtacggtaaacggtacggaaactttaccgaaacggtacgttggaccgttacgacgtcccgaccttaag

SEQ ID NO: 182469 - DNA, 589 bp, Homo sapiens
  misc_feature: GYAE6OF02G0UDW.22.14.B03.1.454.CMB.1.raw
  modified_base (311)..(311): a, c, t, g, unknown or other
  misc_feature (311)..(311): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccgggggacatcgtgatgacccagtctccagactccctggctgtgtctctgggcgagagggccaccatcaactgcaagtccagccagagttatttttacagctccaccaataagagctacttagcttggttccagcagaaaccaggacatcctcctctactgctcatttacngggctcgtacccgggaatcccggggtcctggacccgattcaggtcggcaggtccgggtcgtgggacagtatttccacttcctcacccatccaagcacgtcctgcctagggctaggaagtatggtcggactagttttactacgttgacagtcctaaattactttattacctttaccctccttacgtaacgtaccggttaccggtacccgaaaggggaacccgttaagggtacggtaaacttaccgaaacgtacgttggacggtctacgtccaacctacg

SEQ ID NO: 182470 - DNA, 593 bp, Homo sapiens
  misc_feature: GYAE6OF02IW2L2.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaaagtccagccagagtatttttacagctccaccaataagagttactagcttggttccagtcaagaaaccaggacatacgtcctggacactcgctacatttactggcgtctacccgggtaatccgggtcctgaccgtatcaaggtcgcagcgggtctagggaactagacttcacgtctaccgactatcaacgtcacggcctgcgaacggctagaagattcggagtactagtttacttagttagccaagacgtaaatagtttaactacttccctctacgagttaccgtcgggtaacccaaagggaccctaaaaggggttcgtaaaaacttccgaaaaaccggtaactttcggaaccgggtactaccggtaccaacttaccgg

SEQ ID NO: 182471 - DNA, 662 bp, Homo sapiens
  misc_feature: GYAE6OF02GU9UN.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagacggccacatcaactgcaacgtccacgaccagagttatttttacagctaccacctaataagagttaactagtcgttcgtaccagacaagaaacagacatcgtcctgacactgacctctatttacgtcggtcgtaccgtacccgggaagtcccggggtcctcgaccgtatcgaggtcggcgaggcggtcgtgggaactagtaactttccacgttacctccaaccgaatccgaagtccaacggtccctaggcctaagggcctaggaaggtagtcggtacggacttaacgttttaatttagttcgtacggtaacgacgttaaaatttatttaactttaccgtttacccttaccgttacgtaacgttaccggtttacgaacccggtaaaggtaacccggtaaaggtacgtaaaacgttaaccaaaccgggttaacttacgggtacgtacccgtacgaaccgtacctaacgg

SEQ ID NO: 182472 - DNA, 660 bp, Homo sapiens
  misc_feature: GYAE6OF02I9M8Z.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtcgtctcgtgggcgaggacgggccaccatcaactgacaagtccagccagacgttatttttacacgctccaacctaaataagtaacgttaacttagcgtttcggttccacgacaagaaaccgaaggaccaatccgtcctgcacctgtcctctactttacgtacggggtacgttccggtaacccgggtaacgtcccgggggtccctacggtaccgtacttccgaacgttcgggacgacggtcggggtaccggtcggggaacgtagtacgtttacaccgtccgtacctaccgtatacgacgaccacgtccgtcgcgacggcgtacgaagacgtagtcgtcttagtttattagttgtcaagtactaattattattacttcctacctatacgtacgttacggacgtaacgggtaacggtaacggacggtaaacgtaacgtaaaaccgtacggttaggtacggtaccgtcgtaccgtaccctacg

SEQ ID NO: 182473 - DNA, 654 bp, Homo sapiens
  misc_feature: GYAE6OF02H4LBT.22.14.B03.1.454.CMB.1.raw
  modified_base (449)..(449): a, c, t, g, unknown or other
  misc_feature (449)..(449): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtggcgaggacgggccaccatcaactgacaacgtccagccaagagtttatttttacacgtcctaccaacctaataagtagtttaacttagctttggttccagcaagaaaccaggaccatccgtacctgacctactcgctactacgttttacgcgggtccgtcccgtaaccgggacgttccccggggtcctacgaccgtaagttaaggtcggacgtagggtccggtgtacgggaactagtactttccatccgtaccacctanccgagcacgcctgaccgagtcgtaggatagttggtacgtacgttaagttttatagtttcgacaggtactaattactttaactactttccctacctacgtaacgttacccggttaccggaccgtaaccgggaacgtaacgggttaaccggtaaataaccggtaaactaacggttggtaccggtgtaccgaccgtacctagttaccg

SEQ ID NO: 182474 - DNA, 619 bp, Homo sapiens
  misc_feature: GYAE6OF02GLZ55.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctaccaccaataagagttactagcttggttccagcaagaaacccaggacatcgtcctgcactgctctatttacgtgggctccgtacccgggtacgtcccggggtccctaggacccgtattcgaggtcggcgaggtcgggtcgtgggacagtacttccactctcactatcagcacgcctgcgagctagaagtgtggtagacttaagttttagttagttcgtacgagtactaaattagttaacttacgtttcccttaccgttacgacgttacccggttaccgggaaccgtaacgggggtaaccctaaaggggttaaccgtaaaacgttaacggaaaaccggttaacgtcgggttacggaccgtacgtacccgtactaaccgg

SEQ ID NO: 182475 - DNA, 573 bp, Homo sapiens
  misc_feature: GYAE6OF02GA0F0.22.14.B03.1.454.CMB.1.raw
  modified_base (431)..(431): a, c, t, g, unknown or other
  misc_feature (431)..(431): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagcagaaaccaggacatcgtcctgcactgctcatttacgtgggtccgtcgtaaccccggggaactcccggggtccctcgacccgtattcgagtggcaggcgggtcgtgggacagactttcactctccaccatccagcagcctgccgagggctagaacgtntcggtggaccttagtttattacctgtacaagactaattattatacttcctcctacgtacgtaccggttaccgaccgtaaggggaccctaagggtacgaaacttacgaaaacggtacttggtaggcctacggaccaacctacg

SEQ ID NO: 182476 - DNA, 612 bp, Homo sapiens
  misc_feature: GYAE6OF02I1UC0.22.14.B03.1.454.CMB.1.raw
  modified_base (339)..(339): a, c, t, g, unknown or other
  misc_feature (339)..(339): n is a, c, g, or t
  modified_base (463)..(463): a, c, t, g, unknown or other
  misc_feature (463)..(463): n is a, c, g, or t
  modified_base (500)..(500): a, c, t, g, unknown or other
  misc_feature (500)..(500): n is a, c, g, or t
tcagacatacgcgtcacgaccggtgctcgatttagtgtgagtagttccgcggggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccataccaactgacaacgtccagccagagttactttttacagctaccaaccaataagtagttacttagtcgtttggttaccagacaacgaaaccaggactaatccgtcctgcctactcgctctactttacgngggtcgtaccgtaccgggtacgtccggggtaccctacgaccgtattacgagtcggacgaggcgggtacgtagggactagtctttacactccgtcaccgtatccgagaccagccgtgacgacggntaggaactgtgggtagcttaagttattatcgtacganacttaatctttaattccttactaccgtacacggtcgttaccggaccgtaagggtacctaaggttacgtaaactaacgtaaacgtcgtaggtcggtactacgtccacgttacg

SEQ ID NO: 182477 - DNA, 611 bp, Homo sapiens
  misc_feature: GYAE6OF02JAI52.22.14.B03.1.454.CMB.1.raw
  modified_base (382)..(382): a, c, t, g, unknown or other
  misc_feature (382)..(382): n is a, c, g, or t
  modified_base (596)..(596): a, c, t, g, unknown or other
  misc_feature (596)..(596): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctccggggacatcgtgatgacccagtctccagactccctggctgtgtctcgtgggcgagagggccaccatcaactgcaagtccacgccagtagttatttttacagctaccaccaaataagacgctacttagtcttggttccagctaagaaaccaggacactccctcctctactgctctactttactcgggctaccgtacccgggaacgttcccggggtaccctggtaccgtattccaggtggacncggtcgggtcgtagggactagtactttcaccttcgtaccaccctatacgagccgtagccctacggacgaggcctagtaagtagtggtacggtacttaacgtttacttacgtgtacctagacctaaattacttattacttcctctacgtactaccggtttccgaccgtaacggtaaccgaaggtacggtaaactacgaaacggtactgggtacgngtacgaccgtactcg

SEQ ID NO: 182478 - DNA, 553 bp, Homo sapiens
  misc_feature: GYAE6OF02G9T9C.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagttacttagcttggttccagcagaaaccaggacatcgtcctgcactgctcatttactggctctacccgggaatcccggggtcctgaccgattcagtggcagcgggtctgggacagtattcactctcaccatcagcagcctgcaggctagaagtagtggtcgtctagtttattattgtacagactaattattatactttcctcctacgtagtaccgttacggaccgtaaacggggacctaaagggtacggaaacgttaaccgaaacgtaacgtggtacggaccgtacgacctaaccgttacg

SEQ ID NO: 182479 - DNA, 727 bp, Homo sapiens
  misc_feature: GYAE6OF02GRANQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctggcgagagggccaccatcaactgcaagtccagccagagttatttttacagctccacaataagagttacttagcttggttccagcaagaaaccaggacatcgtcctgcactgctctatttacgtgggctcgtaacccgggtaacgtcccggggtccctcggaccgtattccgaggttcggacgacggtccgggttcgtcggggaactaggtactttccgaccttccgtaccaacccgtatcccgaagtccgaagtccccgttgaccgaacggtcgtaacggtaaagtacgttcggttacggtacgtttaacgtttttagtttacgtttcggttaccgaacggttaacctaaaagttttacgtttaacgtttaaccttttccccgttacccttaaacgtaaccggttaacccggggttttaccggaaccccggaaaacggggttaacccggtaaaaggggtttaaccggaaaaacgtttacccggaaaaaaccggtaacgttacggtaccgggtccttaaccggaccctaacgtttaaccg

SEQ ID NO: 182480 - DNA, 674 bp, Homo sapiens
  misc_feature: GYAE6OF02HPHVU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgaggagggccaccatcaactgcaagtccagccagagttatttttacagctaccaccaataagagttactagcttggtccagcaagaaaccagacactcgtcctgccacgtcgctctatttacgtgggcgtccgtacccgggtaagtcccggggtccctgaccgtattcgagtcggcaggcggtcgtgggactagtactttcactctacaccgtatccagacacgtccctaggaccgtaggcctaggaaaggtactgggtacggtccgttaagttttactttacgttacgttacgtaacgtacctaaagttagtttaacttttaccgttacccgttaccttaccgtaacggttacccggggtttacccgggaacccggtaaaacgggggtaacccaaagggggttaaccgtaaaaacgttaacccggtaaaaccggttaaccgttacgggtagggacccctttacggaccgtacccgttaacg

SEQ ID NO: 182481 - DNA, 582 bp, Homo sapiens
  misc_feature: GYAE6OF02I3ES8.22.14.B03.1.454.CMB.1.raw
  modified_base (333)..(333): a, c, t, g, unknown or other
  misc_feature (333)..(333): n is a, c, g, or t
  modified_base (470)..(470): a, c, t, g, unknown or other
  misc_feature (470)..(470): n is a, c, g, or t
  modified_base (488)..(489): a, c, t, g, unknown or other
  misc_feature (488)..(489): n is a, c, g, or t
  modified_base (512)..(512): a, c, t, g, unknown or other
  misc_feature (512)..(512): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagacgggccaccatcaactgcaagtccacgccagtacgttattttttacagtcctccaccaaataagagttaacttagcttggttccaagcaacgaaaccaggaacatcgtcctgctacctgcctctaacttttaccgnggggtccgtaccgtacccgggaacgttcccgggggtacccctcggaacccgtattcgaggtcggcgacggtcggggtctagggactaggtactttacaccttcacaccgatcgacgcacgcctggcaggctagaagngtgtgcttagttatattnnagtataattacttatacttctcncgtacgtcgtacgccgaaggtaccgtaaggtgtaaacacgtaaaccgacttgggacgctacgcctactcg

SEQ ID NO: 182482 - DNA, 643 bp, Homo sapiens
  misc_feature: GYAE6OF02GUHIU.22.14.B03.1.454.CMB.1.raw
  modified_base (171)..(171): a, c, t, g, unknown or other
  misc_feature (171)..(171): n is a, c, g, or t
  modified_base (349)..(349): a, c, t, g, unknown or other
  misc_feature (349)..(349): n is a, c, g, or t
  modified_base (379)..(379): a, c, t, g, unknown or other
  misc_feature (379)..(379): n is a, c, g, or t
  modified_base (504)..(504): a, c, t, g, unknown or other
  misc_feature (504)..(504): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtcctccanacctccctggctgtgtctcgtgggcgaggacggccaccatcaactgacaacgtccacgacctagtagtttatttttacacgtcctaccaaccaaataagacgtacttacttagtcctttcggttaccagacaacgaaaccgaggaaccactccctcctactactcgctctatttacgnggtcctacgtaccggtacgtcccgggtccngaccgtagttaccgaggtcgacgacggtcgggtcgtagggactagttacttaccacttcgtaccactactacgacgctacgcctaggcgtaaggcgtagaagttgtggtcgtacttagtttattntacgtagactaatacgtttattacgttaccttccgtctaacgtacgttaccggtacgaacggtaacgggtactaaacgggtaagttaaacctaacgtaaaccgtacgttcggcgttaaccgacgtaccctaacgttacg

SEQ ID NO: 182483 - DNA, 636 bp, Homo sapiens
  misc_feature: GYAE6OF02JGOPL.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccaccaataagagttacttagcttggttccagctagaaaaccaggacatcgtcctgcactgctctatttacgtggcgtcgtacccgggaagtcccgggtccctgaccgtattcgagtcggacgacggcgggtcgtgggacagtacttcacgtctcaccgatcgagtcacgtcctgccgaggcctagggaacgtatggtcggacttaagtttttactagtttacgcgaacggtcttaaaagtttactttaattaccgtttcccttaccgtaacgtacgggttaaccgttacccgggtaaccggaaacggggtaacccaaggggtttaacgaaaaccgttaccgaaaaccggtaccgttacgggtcggttaaccctacgggtacccaacccgttacg

SEQ ID NO: 182484 - DNA, 705 bp, Homo sapiens
  misc_feature: GYAE6OF02G8IPI.22.14.B03.1.454.CMB.1.raw
  modified_base (476)..(476): a, c, t, g, unknown or other
  misc_feature (476)..(476): n is a, c, g, or t
  modified_base (545)..(545): a, c, t, g, unknown or other
  misc_feature (545)..(545): n is a, c, g, or t
  modified_base (686)..(686): a, c, t, g, unknown or other
  misc_feature (686)..(686): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctcggggacatcgtgatgaccagtctccagactcctggctgtgtctcgtgggcgagacggccaccatcaactgcaacgtccagccagtagttatttttacgacgcctaccaacctaataacggacgtaccttaacgttacgtccgtttacggttccaggaccaaacggaaaaacccacggtaactaccttccctacccgtaccttaacgtcgaccttacgtaacttttaccgcgggtccgttaccgtacccggggtaacgtcccggggtcctagacccgtattcgtaggcgacgtacggcggtcgtacgggacagttacttccaactcgtacaccctanactcgctacgcctgacgacggtctaaggaagttacgtggtacgtacgttaacgttttactacgttcgtntaaaccgagtttaaattacgtttaacgtttaccttacccgtttccgacgtttaaccgcccgggttacggtaaccggaacgggtaaaccggtaagggtaaacgtaaaccgtaacgtaaaccgtaacgggttcgacggttacnccggttaccgaacgttacc

SEQ ID NO: 182485 - DNA, 647 bp, Homo sapiens
  misc_feature: GYAE6OF02IM0KA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactcctgctgtgtctcgtggcgagagggccacatcaactgacaagtccagccagtagttattttacagcctaccaaccaataagagttacttagtcttaggttccagcaacgaaaccaggacagtcgtcctgacactgctctacgtttacgtgggccgtccgtaacccgggtaacgtcccggggtcctacggaccgtattcgaggtacggcgacggtcgggttcggtacgggactagtaacgtttccaaccgtttcgtacctaaccgtactacgacgccgtaacgccgtagaccgtaggaccgtaggaagtacgtcggtacggtacgttaagttttaattagttcgtacaaggtactaagttaacttagttaccttccgtacttcgacgttaccggttccggacgtaaccgggtaacgtaacgggtacgaaactaccgtaaaacgtacgttaggcggtacgtacaccgtactaaccg

SEQ ID NO: 182486 - DNA, 577 bp, Homo sapiens
  misc_feature: GYAE6OF02IMUEL.22.14.B03.1.454.CMB.1.raw
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
  modified_base (448)..(448): a, c, t, g, unknown or other
  misc_feature (448)..(448): n is a, c, g, or t
  modified_base (529)..(529): a, c, t, g, unknown or other
  misc_feature (529)..(529): n is a, c, g, or t
  modified_base (566)..(566): a, c, t, g, unknown or other
  misc_feature (566)..(566): n is a, c, g, or t
tcagacatacgcgtcacgaccggtgctcgatttagtgtgagtagttccgcggggggagctacaacaggcaggcagggggcagcaagatggtgttgcagacccaggtcttcatttctctgttgctctggatctctggtgcctacggggacattgtgatgacccagtctccagactccctggctgtgtctctgggcgagagggccaccatcaactgcagtccagccagtagttatttttacagctccaaccaataagagttacttagtcttcggttccagcaagaaaccgaggacactcgtcctcgcactgctctatttacgtggtccgtcgtacccgggtaacgtcccggggtccgtacgaccgtacttcgaggtcggcgacggtcgggtcgtgggacagtattcactcgtcacctatcagcncgcctgcaggctaggaagtntgtcgnttagtttattattcgctagtactaattacttatcctttctcttacacgttaaccgtcggaaccgtaagggaccgtaaaggnggtaaaactacgtaaaacgtacgtggtcggacgtacnccgtacctacg

SEQ ID NO: 182487 - DNA, 742 bp, Homo sapiens
  misc_feature: GYAE6OF02F4QRD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatcaactgacaacgtccagccagtagttatttttacgagtcctaccaacctaataagtagttaacttagtacttacggttccagacaacgaaccaggactatcgtcctgacacgtgctctatttacgcggtcgtaccgtaccgggtacgtccgggtcctacgaccgtagtcgaggtcggacgtacggtcgggtcgacgggtacgtagttacgttactactaccgtacctaccgtaacgtacccaaggtcccgtaacggtcccgttaggaccggacggttaacgaacggtaaagtcggtacggtacgggttaacttaacgtttttaagtacgtttacggaccgttaaggtaactttaaaagtttacgttttaaactttcccgttaccctttaccgttaaccgtaacggggttaccccgtttacgggaacccggttaaacggggtaaccgtaacggggttaaacgaaaccgtttaaccggaaaaccggttaccggtttggtaacccgggtctaccggtacccgttaaccttaacgg

SEQ ID NO: 182488 - DNA, 898 bp, Homo sapiens
  misc_feature: GYAE6OF02JLY2U.22.14.B03.1.454.CMB.1.raw
  modified_base (225)..(225): a, c, t, g, unknown or other
  misc_feature (225)..(225): n is a, c, g, or t
tcagacatacgcgtcacgaccggtgctcgatttagtgtgagtagttccgcgggggagctacaacaggcaggcagggcgagcaagatggtgttgcagaccaggtcttcatttcttctgttgctctggatctctggtgcctacggggacagttgtgatgacccagtctccagactcctgctgtgtctctgggcgagagggccacatcaactgcaacgtccagccagngttaatttttacacgctaccacaataacgtagttaacttagtcttaggttccagactaacgaaaccaggactacgtaccgtcctgccactgcctactacttttacgtcgggtcttaccggtaacccgggtaacgttcccgggggttacccctacgtacccggtactttcgtacgggtacgggtacctaacggggtccggggttaccgtagggggtaaccgtaaggtaaccgtttttacggaaccctttcccgttaaccgtaacccgttacgtaacccgttaacggtacccggtaacccggttcccgttacggtacccgttaaacgggggtccttaaggggtaaaccggtaacggtttccggggttaacgggtaccgttttaaacggtttttagttttaaaccgggtttttacggtaaccccggttaacggttaaaccgtttaaaagttttaaaccggtttttaaacgttttaaaccccttttcccggttttacccccgttaacgtaacccggggtttaacccggttttacccgggggtaacccgttaaaccggggggggtaaaccccttttaaaccgggggaaacggtttaaaacccggtaaaccgtaaaaacccggtttaacggttaccggttagggtaaaccccgtcggtacccgttaaacccgttaaccg

SEQ ID NO: 182489 - DNA, 538 bp, Homo sapiens
  misc_feature: GYAE6OF02JHI65.22.14.B03.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (525)..(525): a, c, t, g, unknown or other
  misc_feature (525)..(525): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagtctccaccaataagagttactaagcttggttccagtcagaaaccaggacatcgtactgcactgctcatttacngggcgtctaccggaatccgggtcctgaccgtattcagtcgacaggcggtcgtggacagactttcactcncacatcagcagcctgcaggctgaagtatggaggtcctagtttatacgttgtacagcctaaatatttactactttcctactactagaccgtttcggacaagggtaccaagggtcgaaaacttcgaaaacgtaacgtcgtaggtacncggtacacctaag

SEQ ID NO: 182490 - DNA, 854 bp, Homo sapiens
  misc_feature: GYAE6OF02J1ZC0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgcctacgggacattgtgatcgacccagtctccagacctccctggtctgtcgtctcgtgggcgacgacgggccaccatcaactcgcaacgtccagaccagtagtttactttttacacgtactaccaacgaataacggtacgttacgttaggtccgttcggttaccagtacgaaacggtaaaccacgggtactacgttccgtccgtacgacctacgttcgtaccttacgtacgtttaccggtcgggtaccgttaacccggttaaccccggggtaaccggtttccccggggttaccccgtacggtacccggtacttaccggtacgggtacggtaccggtacgggtaccggggtaccggttacggggtaaccttaggttaccgtttaccgtaccgttaccgttaacccgaaccgtacgtaaccgtcggtaaaccggtcccgtacccggttaaggacccggtaacgggtaccgtaacggtaacggttaccggtacggggtttacggtaactttttacggttttaactttacggttacgggtaacctacgggttaaactttaaacgtttacgttttaaccttaacccgggttcccttaaacggtacgttacgggtaacccggttaccgggaccgtaacgggtaacccgtaagggttaaccgtaaccgttaaaccggaaccgttacggtacggtaccggtaccgtacgtaacccgtagttaccgg

SEQ ID NO: 182491 - DNA, 775 bp, Homo sapiens
  misc_feature: GYAE6OF02JSYDQ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagaggccaccatcaactgcaagtaccagccagagttattttttacagcctccaaccaaataagtagttacttacgtcttcggttacctagactaacgaaaccgtagggtaactagttacccggtccgttacgaccgtaactcggtaccttacttaacgttttaaccggtcgggtacccgttaccggtaaccccggggtaacggttcccggggttaccccgtacggtaacccgttacgttaccgtacgggtacggtaccggtacggtccgggggttacgtcggggtaaccgtaagtaacgtttacctaccgtacccgttacctaaccgtactaccgacgtacccgaacgtccgtaacggctaacgggcgtagaaggttactcgggtcggtaccgtttagtttactttacgttcgacgtacgtaaaccttagttaagttttaacttacgtttaccctaaacggttcctaaggggtttacccggttacccggtaaccggtaaacgggaaccggttagggttaaaccgaaagttacccgaaaacggttactacgggtccgtaacgtacgtaccgtaaccgttaccg

SEQ ID NO: 182492 - DNA, 764 bp, Homo sapiens
  misc_feature: GYAE6OF02FS9GA.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccacatcaactgcaagtccagccagtagttatttttacacgtctaccaaccaaataagtacgttaaattagctttggttaccaggcaagaaaccaggacatcgtcctgcactcgtctactattttacgtgggtccgttaccgtaccccggggtaaaggttcccgggggtaccccgtcggtaacccgtacgtttaccgaggtcgggacctacggggtccgggttccgtagggggtaccgtaaggtacgttttaccgtacctaccgttccaacccgtacttacgaacgtaccacggtccctaggcccgaggtaccgtaggaaacggtacgtagggttacgggtccgttaaaggtttttactttaacgtttcgttaaccgtacggtaaaccttaaatttaacgttttaacgtttaaccttttacccttacccgttaaccgttacggtacccggttttaccggaacccggtaacggggtaaccgtaaacgggggttacgaaaacggttaaccgtaaaacccggtaaggttacggtaccggtacgtaaccggaccgtaaccgttaacgg

SEQ ID NO: 182493 - DNA, 607 bp, Homo sapiens
  misc_feature: GYAE6OF02IANUC.22.14.B03.1.454.CMB.1.raw
  modified_base (442)..(442): a, c, t, g, unknown or other
  misc_feature (442)..(442): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagagtatttttacagctaccaccaataagtagttacttagcttggttccagcaacgaaaccagacatcggtcctcgctacgtgcctctatttacgtcgggtcgtccgtaaccgggtacgtcccggggtcctcggaccgtattcaggtcgcacggtcgggtcgtgggacgatactttcactctacacctagtcagcacgcctgcacggcgtagaacgtntggcggacttaagttttctagttcgtactacgactaaagtttattattaaccttcctccgtaactacgggtaccgttaccgggaccggtaagggaaccggtaaagggtacggaaaactaacccgtaaacgtaacgttcggtaaccggtcgtacgacctacctacg

SEQ ID NO: 182494 - DNA, 699 bp, Homo sapiens
  misc_feature: GYAE6OF02HR6WJ.22.14.B03.1.454.CMB.1.raw
  modified_base (604)..(604): a, c, t, g, unknown or other
  misc_feature (604)..(604): n is a, c, g, or t
tcagacatacgcgtcacgaccggtgctcgatttagtgtgagtagttccgcgggggagctacaacaggcaggcgaggggcagcaagatggtgttgcagaccaggtcttcatttctctgttgctctgatctctggtgccgtacgggactattgtgatcgacctagtctcacgactccgtggctgtcgtctcgtcggcgacgacggaccaccactacaacgtcgaccgtaacgtccgacgaccgtaaggtacgtttacgtttttacgacgtcctaccgtaactaaagtaaacgtacgtacgttaacttacgtccgtttacggttaccgacgaccgtaaacgaaaccgacggaactacgttaccttccttacgttacgtcgtactactacgtttacgtcggtcgtaccggtaaccgggtacgtccgggtcctacggtaccgtagtcgtagtcgacgtcggtcggtacgtacggaacgtgtacttcgactacgtacgacgtacgtcgacggcaccgtctcgcgtagtacgtagacgtcgtcggtagtcttaagtttacttacgtacgtacgtaactacgttaaagtttacgttaacttccgtttaaccncgttaacgtacggtaccgtacgaacggaacggtaacggaagtaacgtaaaccgtaacgtaacgtacggtcggtaccgtacgtacgacgtactacg

SEQ ID NO: 182495 - DNA, 711 bp, Homo sapiens
  misc_feature: GYAE6OF02GBK5F.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaagtccagccagtagttatttttacacgtctaccaaccaataagtagttacttagtcttcggttaccagctaagaaaccgaggacactccgtacctgcctactcgcctctaacttttaccgtgggtcccgttaccgtaaccccggggtaacggttccccgggggttcccctacggacccgtattccgaggtcggacgacggtcggggtcgtacggggactaagttactttaccgacgttacctaccaaccgtatccgaacggcctaacgtcccgtaggacctacgggtacctaggaaaggttacgttcgggttacggtaccgtttaagtttttaactttagttcggtaacctaggtacttaacgtttaactttactttaaccttcccttaccgtacgtacgggttaccgttccgggaaccggtaacggggtaaccgtaagggttaacgaaacctacggtaaaccgtacgttggtacgggactcggtaccacgttacg

SEQ ID NO: 182496 - DNA, 613 bp, Homo sapiens
  misc_feature: GYAE6OF02GLVBQ.22.14.B03.1.454.CMB.1.raw
  modified_base (331)..(331): a, c, t, g, unknown or other
  misc_feature (331)..(331): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgattgacccagtctccagactccctggctgtgtctcgtgggcgaggacgggccaccagtcaactgcaacgtccagccgagtagttatttttacagtcctccacaataagtagttacttagctttggttccagacaacgaaaccaggacactcgtcctgcacgtcgctctaatttacgngggtacgtcgtacccgggaagtcccggggtcctacggaccgtattcgaggtcgacgacggcgggtctacggggaacagtactttcactctacacatcgacgccacgtcctcgcgacggtacgtagaaagtcgttcggtacggctttaagtttatttattggtacaggtaactaaagtttactttaacttactttcctacctacgacgtaccgttaccggaccgtaacgggactaaggtacgtaaactaccggaaactcgtacggtacgacgtgaccacgtac

SEQ ID NO: 182497 - DNA, 710 bp, Homo sapiens
  misc_feature: GYAE6OF02GI1W2.22.14.B03.1.454.CMB.1.raw
  modified_base (469)..(469): a, c, t, g, unknown or other
  misc_feature (469)..(469): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactattgtgatcgacccagtctccagacctccctggctgtgtctctgggcgaggacggccaccatacaactgacaagtccacgccagtagtttaatttttacgactcctaccaacctaaataaaggtactttaacgtttagtaccgtttcggttaccagaccgtaaacgaaaacccgagggaacctacgttccgtacccgtcgaccacgtcgtactactattacgtcggtccgtaccggtacccgggtacgtcccgggtcctacgtaccgtatacgagtacgagacggtcggtcgtagggacagtacttctactcacaacctnaccgagcctacgcctagacgacggtactaggaacgtcgttacggtaggtacctttaaggttttacttaggttccgtaatacgttagtaaactttactttaacgttaccctttccgtaaccttcgtaacccgggttacggttacccgggaccggtaaaccgggttaaccggaaagggttaacgaaaaccgttaaccggtaaaccgttaggtacggtaccggtactcggtaccctacgttacg

SEQ ID NO: 182498 - DNA, 650 bp, Homo sapiens
  misc_feature: GYAE6OF02IOF1C.22.14.B03.1.454.CMB.1.raw
  modified_base (418)..(418): a, c, t, g, unknown or other
  misc_feature (418)..(418): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgaggagggccaccatcaactgcaacgtccacgccagtagttactttttacagtctaccaaccaaataaagtagttaccttacgtcgtttcgttccaggcaagaaaccagacactcgtcctgcactgcctctatttacgtggtcgtactacccgggaagtcccgggtcctacggtaccatcgagtcggcagtcggtcggtcgacgtacgtatcttacctactccncctacgtactacgacgtaccacgtcctgacggtacgtcgtagaacgcgttagtacgttacgtttagtttaacgttgtttcgacgttacgtaacttagtttaactttagtttaccgttacccttctaccgttaaccgggttcgttaacccggacgggtaaccggtaacgggtaacggtaacgtaacgtaaacccgtaaacggtcgtacggtcggtactaccggaccctaacgg

SEQ ID NO: 182499 - DNA, 792 bp, Homo sapiens
  misc_feature: GYAE6OF02H2HL7.22.14.B03.1.454.CMB.1.raw
  modified_base (395)..(395): a, c, t, g, unknown or other
  misc_feature (395)..(395): n is a, c, g, or t
  modified_base (560)..(560): a, c, t, g, unknown or other
  misc_feature (560)..(560): n is a, c, g, or t
tcagacatacgcgtcacgaccggtgctcgatttagtgtgagtagttccgtcgggggtaggctacaacaggcaggcacggggcaggaccaagagtaggtcgttgcagacccaggtcttctatttctctgttgctctggactcttcgtggtgtccgtaacggggactagttgtgatgacccagtctccagactcctgctgtgtctcgtagggagagacggcccaccgtatcaactcgacaacgtccagccaggtacgttactttttacgagtacctcaacctaaataaacgtacgttaacttacggcgtttacggtccaacgtacgaaacggaaaccgtacggtaacctaattccgttaccgtacggacctacgtacgccgtactacgttttaccgnggtccgtaccggtaaccgggaacttcccgggggtacctacggtaccgtgttacgtaggttcggacgacggtccgggtacgtacggacgtactacgtttccaacttccgtacctaacgtactaccgacgacgtacgacgtcggacgtggtaacctgtaaacggttnttacgggtacggttaactttaacggtttaactaccggtttaggtaaccgtacgggtaaaccgttaaacgtttaacgttaaccgttttaaccgttacccgtttacccgtaacggtaaacgggttaccggttaaccgggtaaccgtaaacgggtaacgttaaacgggtaacggtaaaacgtacccgtaaacggtaccgtacggttacggtaacctcgtacccgtacgttaaccg

SEQ ID NO: 182500 - DNA, 939 bp, Homo sapiens
  misc_feature: GYAE6OF02GAPFO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggactagttgtgatcgacccagtcctccagacctccgtggctgtgtctcgtgggcgaggacgggtccaccgactaccaacgtcgacacgtccgacgaccagtagtttaactttttacgacgtcctaccaactaaagttaacgtaacgtttacgttacggtcgtttaccggttaccaacggtaccgtaaacggaaaaccgtacggtaaaccgttacgttacccggttaccgtacgaccgtaccgttaccgtacctttacctttaacggttttaccggtaccggggttacccgttaaccccgggttaaaccccggggttaacccggtttccccggggtaccccgttacggttaacccggttacgttccgtacgggttccgggaaccggtacgggtccggggtacgtacggggtaacctaaggttaccgtttaccgtaccgtttacctaacctacccgtacttaacccgacgtaccgtacggtacccgtacggaccggtacggtaacccggtaaggtaaacggttacggttccgggttaacggtttacgtttaacggttttaacttttacggggttacgtaaacgttaccgttaaactttaaacggttttaaaccgttttaacctttccccggtttaacccttaccggtaaccggtttaaccggggttacccggttacccggtaaacgggtaaacccgggtaaccgggttaacggtaaaccggttaaaacctaaccggtaaaacccgggttggttacggtccccgggtaaccgtaccgttaacccgaaccgtttaccg

SEQ ID NO: 182501 - DNA, 637 bp, Homo sapiens
  misc_feature: GYAE6OF02FLRCU.22.14.B03.1.454.CMB.1.raw
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (281)..(281): a, c, t, g, unknown or other
  misc_feature (281)..(281): n is a, c, g, or t
  modified_base (464)..(464): a, c, t, g, unknown or other
  misc_feature (464)..(464): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
  modified_base (530)..(530): a, c, t, g, unknown or other
  misc_feature (530)..(530): n is a, c, g, or t
  modified_base (559)..(559): a, c, t, g, unknown or other
  misc_feature (559)..(559): n is a, c, g, or t
  modified_base (621)..(621): a, c, t, g, unknown or other
  misc_feature (621)..(621): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctgtgcctacgggacattgtgatgacccagtcctccagacctccctgctgtgtctcgtggcgagagggccacatcaactgcaagtccagccagngtatttttacagctccaccaatanagttacttagtctggttaccagcaacgaaaaccnggtacacttaccgtccttcgacaaccttgcctataacttttaaccgtcggggtaccgttccgtaacccccggggtaacgtcccgggggtccccttacgacccggtattccgtaggtacggtcacgggtccgggttcgaggggaacctaggtaacctttcctaacctctaccaacccagtaccngacctacgtaccctgcgaacgtctaggaacgtancggtacggtactagtttattaccgttntacgngtacctaatagttattactacctccgtanacgtaccgttcgacctaagggtaaccgagtaaggaacctacaaaacggactacggtcggtcncgtacctaaccgtacg

SEQ ID NO: 182502 - DNA, 573 bp, Homo sapiens
  misc_feature: GYAE6OF02HISRF.22.14.B03.1.454.CMB.1.raw
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtatttttacagctccaccaataagagctactagcttggttccagcagaaaccaggacatcctcctctacngctcatttacngggcgtcctaccgggaatcccggggtccctgaccgattcagtggcagcgggtctgggacagatttcactctcaccatcaagcagcctgacaggcctagaagtagtgtgactagtttactactgtacagtacaaattattaattacttcccgtacctacgacgtaaccggttccggaaccggtaaacggggtaccctaaagggtacgggtaaaactaaccgaaaacggtacgttacggtagggtacctacggaccaaccgttaacg

SEQ ID NO: 182503 - DNA, 642 bp, Homo sapiens
  misc_feature: GYAE6OF02IM0FR.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactcctggctgtgtctcgtggcgagagggccaccatcaactgacaacgtccagccagtagttaatttttacagtcctaccaacaaataaagtagtttaacttacgcgtttcgtccagtacaacgaaacaggacactccgtctcgacactcgcctactacttacgtcgggtacgtaccgtacccgggtaacgtcccggggtaccccaggtaccgtacttacgaggtcggacgtaggcgggtacgtggggacgtagttactttacacttcctaccacctactacacgacgccgcctgaccgaggtactaggaagtagtggtacggtattaagtttagttagttacgtacgaagtacttaaagttaatttacttactttccctacgtacgtacgttacgttaccggaacggaacgggtaaccgtaaggtacgtaaactaaccgaaaggtacgtaggtacgacgtacgtaccactacg

SEQ ID NO: 182504 - DNA, 588 bp, Homo sapiens
  misc_feature: GYAE6OF02IFRLB.22.14.B03.1.454.CMB.1.raw
  modified_base (249)..(249): a, c, t, g, unknown or other
  misc_feature (249)..(249): n is a, c, g, or t
  modified_base (332)..(332): a, c, t, g, unknown or other
  misc_feature (332)..(332): n is a, c, g, or t
  modified_base (382)..(382): a, c, t, g, unknown or other
  misc_feature (382)..(382): n is a, c, g, or t
  modified_base (403)..(403): a, c, t, g, unknown or other
  misc_feature (403)..(403): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
  modified_base (451)..(451): a, c, t, g, unknown or other
  misc_feature (451)..(451): n is a, c, g, or t
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (588)..(588): a, c, t, g, unknown or other
  misc_feature (588)..(588): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctggtcgccgtacgggactattggtgatcgacccagtctccagacctccctggctgtgtctcgtggcgaggacgggccaccatcaactgctaacgccagccagtagtttactttttacancctccgaaccaagtaagaggtttacttagtccgtttcggttccagcgaacgtaaaccgaggacagttccggtacctgactacngtctcttaacttcgcgggtctccggttaaccgggacgtcccggggtaccnggtacctagttcagtcgacgnggtcggtagtcggganaggttacttccacgtccttacncctatccggnaccgtcncgtcgntccggangaaccngtagccggtcttaagttttgaatttcgaaacgttgacttaatacttttaacctttccatacgtgcttcgacgtaccggntaggaatacngaacgntcggtacgctgacctn

SEQ ID NO: 182505 - DNA, 951 bp, Homo sapiens
  misc_feature: GYAE6OF02HSK63.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagtactccctggctgtgtctcgtgggcgaggacgggccaccatacaacgtgacaacgtccgagcctaagtaagttattttttacagtacctaccaaccaaataaacgtacgtttaacgttacgtccgtttacgggttaccaagtacaaacggaaaacccgaaggtaacctaacgttacccggtcccgtacggacctaacgtcgtaccttacttaacgttttacggtcggggtacccgttacccggtaaccggggtaaccggttcccggggtaccccgtacggtaaccggtattaccggtaacggtcgggaccgtaacgggtccggggttacggtacggggaaccgttaacggttaaccgttttaccgtaaccgttacccgttaacccggtaaaccctacggtttacccggaaaacgggtccctaaacccgggcccgtttacgggaacccgttaaacgggggttaccctaaacgggggtaaacgttaacggggttccgggtttaacggggtaacccggtttaacgttttttaaacggtttaaccccggtttagggttaaaccccaaagggttaaccctttaaaacggtttttaaacttttaaccggtttaacccttttaacccccgttaaccgttaaaccggggtaaccgggtttaaacccggtttacccggggaaacccgtttaaacgggggaaacccgtttaaaggggttaaccgtaaacgtaaaccggtaaacgttaaccggttagggtaccggtaccgtaacggtacctaaccgtaaccgg

SEQ ID NO: 182506 - DNA, 862 bp, Homo sapiens
  misc_feature: GYAE6OF02GHGYJ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactcctgctgtgtctctggcgagacggccacatcaactgacaagtccacgccaagtagttaatttttacagtctaccaaccaaactaaagagactaacttaagcgtttaggttaccagactaacgaaacccgaagggacctacgtaccctaccctaccgttaaccttcggtacctactaacttttacgtacggggtaccgtaccgtaaaccccggggtaaacggttcccgggggttaccccttaccggaacccggtaacgttaccgaaggtcggtaccgacggtccgggggtttaccgtacggggaactaaggttaacgttttaccgtaacccgttaccgtaccgtaaaccctaacgtttacccggaaacgacccgtaacggtcccgtacggaccgtaaccgggtcccgtaaaggtaaacggttaacggttacgttaccggggtaccgttaagggtttttaaacttttaaccgttacggttaaccgtaaggttacctaaaaggttttaacttttaacgtttaacctttaccccttacccgttaacgttaaaccgggttaacccggttttccgggaaacccggtaaaacgggggtaaacccgtaaaacgggttaaccgggtaaaaaccgttaacgtaaaaaccggttaccggttaacggttaccggacgtttaccggaacctaaccggttaaccc

SEQ ID NO: 182507 - DNA, 659 bp, Homo sapiens
  misc_feature: GYAE6OF02FYP1X.22.14.B03.1.454.CMB.1.raw
  modified_base (339)..(339): a, c, t, g, unknown or other
  misc_feature (339)..(339): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgcaacgtccagccagtagttatttttacacgtctaccaaccaataagtagtttacttagtcttacggttccagacaacgaaaccgaggacctacgttaccgtcctagcacgtcgctctaatttacgnggtcgtaccgtacccggacgtcccgggtcctacggaccgtattcgaggtcggacgacggtcgggtcgagggtacagttacttacgacctctaccacgtactcgagaccgtcgtaccctggaccgaggtacgtaggaagttcgtagggttaggtaacttttagttacttcgaccagtactaacgtttatttacttacctttaccctccgtaacgtaacggttaccggttacccgaacggttaaacgggaccgttaaagggtacggtaaactaccggaaaacgtcgtagggtacctacggtacgaccctacgttagttcccg

SEQ ID NO: 182508 - DNA, 789 bp, Homo sapiens
  misc_feature: GYAE6OF02JCAY4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccagacctccctggctgtgtctcgtgggcgaggacgggccaccatacaactgacaacgtccagaccagtagtttactttttaacagtcctaccaacctaaagtaacgtaacgtttacttagtcgtttacggttccgaacgtacaaacgaaaaccgaggaactacgtacccggttcctacggacctactcggaccttactacgtttaccgtcggggtaccgttacccggtaaccccggggtaacgttccccgggggtaccctacggtaacccgttaacgttaccggtaacggtcgggacgtacgggtcggggtacggtacggggaacgtacggtacgtttacctacttccgttaccgacctaacgacctacggaccacggtccgtagacgacggtacgtaggaacgttagtcggtacggtacgtttaagtttttacgtacgttagacctaacggttaacttaaagttttactttaccgtttaaccttttacccaaaccgtttacggtaccgttaccggttacccgggaaacggttaaccgggtaaacggtaaacggttaacgaaaaccgtaacgaaaccgttacggttacgggtaacgtaccggtacgtaaccgttataccgg

SEQ ID NO: 182509 - DNA, 779 bp, Homo sapiens
  misc_feature: GYAE6OF02JIDOB.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatccaactgcaagtccagccagtagttatttttacacgtcctaccaccaataagtagttaacttagtctttacggttccaagtccaacggaaaaccctagggacctactccggttacctaggaccgtaccttggtcctacttaacgtttaacgtcggggtccgttaaccggtaccccggggaacggttccccgggggttaccctacggtaccggttaccttaccggtaacggttcgggaccgtacgggtaccgggggttcgtaacgggggtaaccgttagttaacgtttcccgtacgttaccttccgaaccctacgttaacaccgtaaccacggtaccgtcggtaccgtacgggtaccgtagggtaaacgtacggttcgggtaggtaacgttaactttttaggtacgttttgaaccgaagtaacctttaattaaagtttaccgtttaacctttccccgtacttaccggtacgttaccgggttccgaaccggtaacgggtaacccggtaaaggttacggtaaacgtaccgtaaaccgttacggttacggtacggttctacgggtacaccgttacg

SEQ ID NO: 182510 - DNA, 683 bp, Homo sapiens
  misc_feature: GYAE6OF02GKP3G.22.14.B03.1.454.CMB.1.raw
tcagacatacgcgtcacgaccggtgctcgatttagtgtgagtagttccgcgggggagctacaacaggcaggcaggggcagccaagatggtgttgcagacccaggtcttcatttctctgttgctctggatctctggtgcctacggggacattgtgatgacccagtctccagacctccctggctgtgtctcgtgggcgaggacgggcccaccactcaactgaccaagtccagccagtagttaattttttacacgtctaccaacctaataacgtagttacttagtcttcggttaccaggacaacgtaaaccgagacactcgtaccgtaggacctacgtcgctacttactttacgtgggtcgtaccgtacccgggtaacgtcccgggtcctacgaccgtattcgtaggtcggcgaggtcgggtcgtacgggactacggtactttaacgtactacgaacctacttacgaacgtcgagtccgtcacggtagggctaagaggtattcgggacgtacgttaagtttacttacgttacgtactaacggtacttaagtttaatttaacgttactttaccgtccgtacgtaaccgttaaccggtaccggaccgaaacgggtaaccgtaaagggtaacgaaaccgtacgaaaccgttagtacggcggtaactcgggaacctaccgaacgtttccg

SEQ ID NO: 182511 - DNA, 820 bp, Homo sapiens
  misc_feature: GYAE6OF02FF2DV.22.14.B03.1.454.CMB.1.raw
tcagacatacgcgtcacgaccggtgctcgatttagtgtgagtagttccgcgggggagctacgaacaggcaggcaggggcagcaagatggtgttgcagacccaggtcttcactttctctgttgctctggatctctggtgcctacggggacattgtgatgacccagtactccagactccctggctgtgtctcgtcgggcgaggacgggccaccatcaacgtagcaacgtcccacgaccaggagtttaatttttacgacgtcctaccgaacctaaagtaacgacgttacttacgtacgttcggtttacccagtacaacggaaaaccgtacggaactaacgtccgtcctcgaccgtacctcgtcctactacgttttaccgcgggtccgtaccggtaacccgggaacgttcccggggtacccgttacggaacccggtacttacggacggttcgggacgagggtccgggttacgtacggggaacctaagggtactttacgaccgttcctaccgtaaccgtataaccgtacggacccaacggttaccctacgggtaaccgtacggggtcccgtaagggtaaaacggtccgttagggttaccggggttaaccgttaagttttttaacgtttaacgtttacgttaccggtaaggttaccctttaaaagttttaccgtttaactttaacccggttccccttaacggttaacgtaacgggttaacccgggtttcggaaacccgtacggggttaaacgtaacgggttaaccgtaaaccgtacggaaaacggttacggtcggttaaacggcgttaaccgaccgtaaccgttcg

SEQ ID NO: 182512 - DNA, 699 bp, Homo sapiens
  misc_feature: GYAE6OF02JBK0Z.22.14.B03.1.454.CMB.1.raw
  modified_base (300)..(300): a, c, t, g, unknown or other
  misc_feature (300)..(300): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagattatttttacagctccaaccaataagagttacttagctttggtccagacaacgaaaccaaggacatcgtacctncactcgtctctacttttacgtgggtccgttaccgtaaccccgggaacggttcccggggtccccgtcggacccgtacttaccgtagtcggcgacggtcggggtcgtacgggacgagtactttcactcctcacctactcaagcctacgcccttggacacgggtctacggaagtagttggtaggtcgttaagtttttattatttacggtcaaacgtcttaaagtttaacttaactttaacctttacccttacccgtaacgtacggtaacccgtttaccggggaaccccgttaaaggggaaccccgttaaaggggttaacggttaaaaaccgtaacccggtaaaaaccggttaccggttagggttacggtaacccgtaaccgtaacccggtaaacccttacgg

SEQ ID NO: 182513 - DNA, 661 bp, Homo sapiens
  misc_feature: GYAE6OF02F9UXW.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgaggacgggccaccatccaactgcaagtccagccagacgttatttttacagcctccaaccaaataagagttacttagcttcggttccagctaagaaaccgaggacactcggtcctgacctactgcctactactttacgcgggtccgtccgtaacccgggtaagttccccggggtccctcggaccgtacttacgaggtcggaccgtaggccggggttcgtacggggtaacagtacgtttaccgaaccttccgtacctaccctaacgtacgtacgaccgtacgtcccgttgaccgtacgggtaccgtaaggaaaggttagttcgggtacggtacgttaagttttattacgtttgtacacggtactaatttacgttattacctttcctcttacgacgttaccgtcgaaccggtaagggaaccctaagggacgtaaactacgtaaacgactggtacgcgtcgactactacg

SEQ ID NO: 182514 - DNA, 697 bp, Homo sapiens
  misc_feature: GYAE6OF02FRBXO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctccctggctgtgtctcgtgggcgagacgggccacatcaactgcaagtccagccagagttatttttacagtctaccaaccaataagtacgtttactagtcttcggttaccagacaagaaacctaggaccatccgtcctgccactcgctctacgtttacgtcgggaccgttaccggtaacccggggtaacgttcccggggtccctacggacccgtattcgaggtcggacgaggtcgggtacgtacgggaccgtacgtaactttcgaccttcgtaccacccgtatacccgaaggtcctacggtaccctggtaccgaagggtccctaaggaaacgttaggtcggttacggttcgttaacgtttttagttacgtttcgactaacggtacgttaattaacgtttacttacccgtttacctaccgtaccttaaggttcccggttaccgaccggtaaaccgggtaacgtaacgggtaagtaaaaccgttaacgaaaaccggttacggtcgtacggtacgacgtaccctagtcc

SEQ ID NO: 182515 - DNA, 638 bp, Homo sapiens
  misc_feature: GYAE6OF02HOWVD.22.14.B03.1.454.CMB.1.raw
  modified_base (228)..(228): a, c, t, g, unknown or other
  misc_feature (228)..(228): n is a, c, g, or t
  modified_base (347)..(347): a, c, t, g, unknown or other
  misc_feature (347)..(347): n is a, c, g, or t
  modified_base (454)..(454): a, c, t, g, unknown or other
  misc_feature (454)..(454): n is a, c, g, or t
  modified_base (460)..(460): a, c, t, g, unknown or other
  misc_feature (460)..(460): n is a, c, g, or t
  modified_base (519)..(519): a, c, t, g, unknown or other
  misc_feature (519)..(519): n is a, c, g, or t
tcagacatacgcgtcacgaccggtgctcgatttagtgtgagtagttccgcgggggaggctacaacaggcaggcaggggcagcaagatggtgttgcagacccaggtcttcatttctcttgttgctctggatctctggtcgccgtacggggactattgtgatgacccagtcctccacgcctccctggctgtgtctgtgggcgagacggccaccatcaactgacagtccanccagacgttatttttacagtcctaccaaccaagtaaagtacgtttaacttagtcgtttacgttaccaagtaccaaacgaaaccgaacggaactactccgtcctcgaacacgtgtacctnttactttacgtgggcttaccgggtaaccccggaacggttcccggggccttacggaccgtagttcaggtcggagtagttggcgtcggaatggtactcactctccacancaacgntcgcgcgctagtacgtgaaagtttcttagactttacgttactactggtacgactactanaacgttaactaacgtacttcccgtaatacccggtttgttccggaccgggtacggtacgaacgttaggacggtagtaactaaacggaacttacgaggttaccggacttcccgagtacccg

SEQ ID NO: 182516 - DNA, 615 bp, Homo sapiens
  misc_feature: GYAE6OF02GATCP.22.14.B03.1.454.CMB.1.raw
  modified_base (331)..(331): a, c, t, g, unknown or other
  misc_feature (331)..(331): n is a, c, g, or t
  modified_base (462)..(462): a, c, t, g, unknown or other
  misc_feature (462)..(462): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctccctggctgtgtctcgtgggcgaggacgggccaccatacaactcgacaagtccagccagtagttatttttacacgtctccaaccaataagtacgttacttagtcttcggttccagacagaaaccgagatacgtccgtctgcactcgctctacttcgngggtccgtaccgtaaccgggtacgtcccgggtccgtcgtaccgtacgttcgagtggcgaggtcgggtcgcggacagttacgttacactcgtacaccgatccgacacgcgtcctggacgacggtacagaagngttaggcgttacttacgtttatttacgtcgagtactacgtaatttattacttcctttccactaggtactaccgggttccgaacggaacggacccgtaaaggacgtaaacctaggaaccgttacgtcgggtacgactaaccgtactaacttacg

SEQ ID NO: 182517 - DNA, 732 bp, Homo sapiens
  misc_feature: GYAE6OF02G29EO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtctccacgacctccctggctgtgtctcgtggcgagacggccaccatacaactcgacaacgtccacgccagtagttactttttacacgcctaccacctaaataagtaacgttaacttagtcgtttacggttaccagaccaacggaaaaccgacgaacacgttccgtccgtacgcactcgtaccttactactttacgtcgggtccgttaccgtacccgggtaaccgtcccggggtccctacggtaccgtagttaccgaggtcggacgtacgggtcgggtacggtacgggaactacggttactttaccgtacctacctacctaacctacgttaccgacgacctacggtaccctagaccgtacggtacgttaggaaaggttcgtggtaccggttatttaaggttttatacgttacgtacgtaacgttaacttaaagttactttactttaccgttacccttacgttaaccgtacgttaccggttaccgggtaaccggaaacgggtaccggttaaaggtaacgtaaacgtaaccgtaacgacgttaggtaccgtacgtacaccgtcccttaacg

SEQ ID NO: 182518 - DNA, 704 bp, Homo sapiens
  misc_feature: GYAE6OF02JXV0D.22.14.B03.1.454.CMB.1.raw
  modified_base (228)..(228): a, c, t, g, unknown or other
  misc_feature (228)..(228): n is a, c, g, or t
  modified_base (493)..(493): a, c, t, g, unknown or other
  misc_feature (493)..(493): n is a, c, g, or t
  modified_base (699)..(699): a, c, t, g, unknown or other
  misc_feature (699)..(699): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgcctacggggacattgtgatgacccagtctcagacctcctgctgtgtctcgtgggacgaggacgggccaccactcgaactgacaagtccganccgagtagtttaactttttacagcttaccaacctaataacgtaagttaccttaagtcgtttacggttaccaagacaacggtaaaaccgaggactaacgtccgtacctggactacgtgtcctactacgtttacgtcgggccgtaccgttaaccccgggaacgttcccggggtaccctacggtaacccgtattaccgtaggttcggacgtcggtacggggtcgtacggggaactacgttaacgttccgacgttccgttacaaccgtntaccgaggtcctacgtcccgtaggaccgaagggtcctaaaggagtaggttcggtacgggtacttaaggtttactttaacggttacgtacaaggtacttaaagttacttaacgttacctttccgtacgtatacggtaccggttcggtacggaacggtccgtaaagtcgtaaagtacctaaggtacgtacggtgtaccgtcgtaaccncgtag

SEQ ID NO: 182519 - DNA, 792 bp, Homo sapiens
  misc_feature: GYAE6OF02IBJU4.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctcagactcctggctgtgtctcgtgggcgaggacgggccaccatacaactcgacaacgtccagaccgagtacgtttactttttacagtcctaccaacaagtaagtacgtttaacgttagtcgtttacggttccaacggactaacggaaaaccgagggaacctacgtccggttacccgtaggacctaaccgtcggtacctacgttaacgttttacggtcgggtaccgtaccggtaaacccggggtaacggttcccggggtacccgtacggtacccgtacgttaccgtaggtcggacgaacgggtcgggtacgtcgggaacgtacgtatttccgactcgttaccaactcgtaaccgacgtacgtaccgtccgtacggaccgtaagggaccttaagggaagttcggttaacgggccgttaaagtttaacgtttttaagttacgttggaccgttaaacggtacttaaaacgttttcttaaacgttaccgttttacccctacggtaaacccgttacgggttaacccggttaccgggaaccgggtaaaccgggtaacccggtaaagggtaaaccggtaaaacttaacccggtaaaacggtcgttacggtacgtaccgaacgtacctaccgttacg

SEQ ID NO: 182520 - DNA, 714 bp, Homo sapiens
  misc_feature: GYAE6OF02I6QHD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggactattggtgatcgacccagtctccagtacctccctggctgtcgtctcgtgggcgaggacggccaccatacaactgacaacgtccacgaccagtagtttaatttttaccagtcctaccaaccaaataagtacgtttacctaagtccgtttacgttaccagactaaacggaaacctaggaactacgtaccgttccgtagcctaacgtcgtcttacgtactttaccggtcggtaccgttaccgtaacccggggtaacgttccccgggtacccgtacggtaaccgtagtaccgtaggtcggaccgtacggtccgggttacgtacgggaacgtacgtacttaccgtacttccgtacaaccgtatacgaacgtccgacgtccgtacgaccgtaggaccgtaggaacgtgttacggtggtaccttaggttttaaatgttacgtacgacgttaacgttattaacgttacttaccgtaccttcctaacggtaacgttaccggtacgtaccgtaaggtaccgtaaaggtacgaaaacgtacgaaacgtacgtcggtactacgcttaaccgccttaacg

SEQ ID NO: 182521 - DNA, 687 bp, Homo sapiens
  misc_feature: GYAE6OF02H7OG9.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctgtgcctacggggacattgtgatgacccagtctccagactccctggctgtgtctctgggcgagacggccaccatcaactgcaagtccagaccagagttatttttacagtctccacaataagagttacttagcttggtccagcaagaaccaggacatcgtcctgcactgcctctagttactgggccgttacgtaacccggtagtcccgggtcccctacgaccgtactccaggtacggcgtacggcgggtacgtgggacaggtacttacgtacctacgttccaacccagttacgaacgtaccgtacgacccttaggccgtaagggcccgttaggaaaagtcgtaggggttacggtaacgttaagttttaacgttttaactccggttacgtaaacggaccttaaatttaaactttaccttaagttttaccctacccgttaacgtaacgttaccgttttacccgggaacgtaaaccggggtaaccgtaaaccgggttaagtaaactaaccgtaaaacgaacggttacggtaccggactttacggtaacccgaacttaccg

SEQ ID NO: 182522 - DNA, 671 bp, Homo sapiens
  misc_feature: GYAE6OF02IFHVT.22.14.B03.1.454.CMB.1.raw
  modified_base (225)..(225): a, c, t, g, unknown or other
  misc_feature (225)..(225): n is a, c, g, or t
  modified_base (532)..(532): a, c, t, g, unknown or other
  misc_feature (532)..(532): n is a, c, g, or t
tcagacatacgcgtcacgaccggtgctcgatttagtgtgagtagttccgcggggggagctacaacaggcaggcaggggcagcaagatggtgttgcagaaccaggtcttcatttctctgttgctctggatctctggtgccgtacggggacattgtgatcgacccagtctaccgagacctcccgtggctgtgtctcggtgggcgaggacgggacccacatacgaacngacaacgtccagaccagttatttacttttacgagtcctaccaacctaatagtacttactagtcttggtccagacgaaacgaaccgagacgtactaccgtcctcgactacttggccttactacggtttcgtcgggtaacccgttccggtaaacccggtccggtcccgggtccctagggtaccttacgtcgtaaggtcggacgtaccgggtggtaccggtaggaaccgtaattccgttcaccttcgaccctaaccgtctacgacgcgtacgccgtagaccgacggtacagtacgttgtggttaccggtntttacgtttatacgttgacgtagttaacttaaatacttttattacccttctactacgttacggaccgttacggaacggtaacggaaggttaacggagtaaaaccgtacgtaaagtcgtggtacgcgtacggactatacg

SEQ ID NO: 182523 - DNA, 538 bp, Homo sapiens
  misc_feature: GYAE6OF02FWREW.22.14.B03.1.454.CMB.1.raw
  modified_base (387)..(387): a, c, t, g, unknown or other
  misc_feature (387)..(387): n is a, c, g, or t
  modified_base (405)..(405): a, c, t, g, unknown or other
  misc_feature (405)..(405): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccgatcaactgcaagtccagccagagtatttttacagctccaccaataagagctacttagctttggttccagcagaaaccaggacatcctcctctactgctcatttactggctcgtaccggaatccgggtcctgacgattcagtgcagcggtcgtggacagtatttcgactcgtcactatcagcngcctgcaggctagaacgntggtgctagtttatctgtcagctaagttattctaacgttcctcttacgacgtacgttccggacctaacggggtacctaagggttaggaaacctacgtaaacgacgttcggtacggcttaggccaaccgttacg

SEQ ID NO: 182524 - DNA, 645 bp, Homo sapiens
  misc_feature: GYAE6OF02IF441.22.14.B03.1.454.CMB.1.raw
  modified_base (513)..(513): a, c, t, g, unknown or other
  misc_feature (513)..(513): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccctacggggacattgtgatgacccagtctccagactccctggctgtgtctcgtgggcgagagggccaccatcaactgcaagtccagccagagttatttttacagctccgaaccaataagagttacttagcttgttccagacacgtaaaccaggaacatcgtcctgctactcgctactatttacgtggtccgtccgtaacccgggtaacgttcccggggtaccctcggaccgtacttcacggtcggaccgtaggtccgggtcgtcgggactagtactttccacttcctcgacctactcacggccacggtccttcgacgacgcttaggaacgtagtcgtagtcttaagttttagtacttgtacgtagacctaaagttntttaacttacctttacccgttactaccgtacggttaaccgttccggacccgtaaagggaacccgtaaggtaacggtaaacgtaccgtaaaccggtacgttagggtacggtcctaacggtacctaaccttacg

SEQ ID NO: 182525 - DNA, 819 bp, Homo sapiens
  misc_feature: GYAE6OF02IERV3.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggacattgtgatcgacccagtcctccacgtacctcccgtggctgtgtctcgtgggcgaggacgggcccaccatacaactgactaacgtccacgaccagtagttatttttacgagtcctaccaactaagtaagtagtttaacttagtacgtttcggtaccacgacgaacgaaaccgaggtacctagtcccgtaccgtacgacctacgtcgtccttacgttaacgtttaccggtcgggtccggttacccggttaacccggggtaaccggttcccggggttaccctacggtaacccgtacgttcgacgggtacggacgtacgggtaccgggtacggtacgggtaacgtaacgttacgtttccaccgttcctacctaaccgtataccgacgaccgtaccgtccgtacggcgaacggtcgtaaacggtaacgttaggttacggtacggttacgtttaaagttttacgttaacgtttacgtaaccggtaacgtaacctttaagtttaactttaaccgttacccttttaacccgtaccgttaccgtaaccgggtttaccggttaccgggtaacccgggtaaacggggtaaccggtaaacgggttaacggttaaaccgtaacccgtaaacggtaaccggttacggtaccggtacccgttacgtaaccccgtatttaacccgg

SEQ ID NO: 182526 - DNA, 793 bp, Homo sapiens
  misc_feature: GYAE6OF02IQUSI.22.14.B03.1.454.CMB.1.raw
  modified_base (778)..(778): a, c, t, g, unknown or other
  misc_feature (778)..(778): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtcgccgtacggggactattgtgatcgaccctagtcctccagacctcccgtggctgtgtctcgtggacgaggacggaccactactaccaactgacaacgtccagccagtactttaactttttacacgcctaccaactaaataacgtagtttaacttacggtcgtttcggttaccacgtacgaaacggaaaccgtacggaacctaccgttccggtacctacgtaccgtacgttcgtacctttacttacggttttaaccggtcgggtacccggttaccccggttaacccggggtaacccggttccccgggggttacccttaccgggtaacccggttacttaccggtacgggttcgggtaccggtacgggttccggggttcggtaacgggtaacgttacgggttacctttaccgtaccttccgttaacctaccgttaacgtaccgtaacggacccgtcgttcccgtaagccggtaacggtacgtagaaacgggtctttaggggttacttaacggttttattagtttaccggttgtaacgttacgtaaattaacgtttactttacgttcccttaccgttcgacttaacggtaccggttacgaacggtaacggtaaccgtaggtactaacgtaacgtacgtaggtcggtnactacgccgacttcg

SEQ ID NO: 182527 - DNA, 664 bp, Homo sapiens
  misc_feature: GYAE6OF02GBMJ3.22.14.B03.1.454.CMB.1.raw
  modified_base (197)..(197): a, c, t, g, unknown or other
  misc_feature (197)..(197): n is a, c, g, or t
  modified_base (322)..(322): a, c, t, g, unknown or other
  misc_feature (322)..(322): n is a, c, g, or t
tcagacatacgcgtcacgaccggtgctcgatttagtgtgagtagttccgcgggggagctacaacaggcaggcaagggcagcaagatggtgttgcagacccaggtcttcatttctctgttgctctggatctctggtgcctacggggacattgtgatgacccagtctccagactccctggctgtgtctcgtgggcgagnggccaccatcaactgacaagtccagccagtagttattttttacagctaccaccaaataagacgctacttagtctttggtccagacagaaaccaggacatccgtcctctactgctctattttacgngggtcctacgtacccgggaacgtccggggtccctaggacccgtagttccgagttcgggacagggtcgggtacgtggggacctagtatttaccaccttcctacgacccgtatccgaacgcacggtcctggacccgaggtctaggaagtgtacggtgtaccgttaggttttactacgttcgtacgagtataaacttatttacgttaactttccctacgtacgtaaccggttaccggttacccgccggtaaaacggggtaccccgtaaagggtaccgggtaaactaacccgtaaacgggttaaccgtgggttaaccggtcgtacggtacccaaccgtttaaccgg

SEQ ID NO: 182528 - DNA, 736 bp, Homo sapiens
  misc_feature: GYAE6OF02GCSSB.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcattctctgttgctctggatctctggtgcctacggggacattgtgatcgaccagtctccagctccctggctgtgtctcgtggcgaggacggccacatacactgacgaactccacgccaagtacgtttatttttacacgcttaccacctaaataagtagttaacttacgtcttacggttaccagactaacggaaaacctagggaactactcgtaccgtacgctactacgactaccttaagttaccggtcgggtaccgtaccgtacccggggtaacgttcccgggtaccctcggacccgtagttaccgaggtccggacgtagggtcgggtccgtagggtaccgtacggtactttacccgtactacctacccgtactactaccgaccggtacccacggtcgtaccggtaacgccggtaacgtacggaacgttgtaacgttcggtacgttacgttttaaagttcgtaacggtacctacggtaccttaaagttaacgtttacttaacccgtttccttaaaccgcggttaacgttaccggttacccgaaccggttaacgggaaccgtaagttaacgtaaacctaacggtaacccggtagtaccggtaccggtaatttcggacccaaccctttagg

SEQ ID NO: 182529 - DNA, 734 bp, Homo sapiens
  misc_feature: GYAE6OF02HOY94.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgaccagtctcagactccctggctgtgtctcgtgggcgaggaggccaccagtacaactgacgtaacgtccacgaccaagtagttatttttacgagtcctaccaactaataagtacgttaacgttagcgttgtaccagacaagaaaccgaggtacactcgtctgtacactgcttactagtttacgtacgggtacgttccggtaacccgggtaacggttcccggggtccctacggtaaccgtaccgttacgaacgggttggacgtacgggttccggggtacggttacggggaacctaagggttaactttacccggtaactttaccccgtaacgtacccgtaacgttacccgaaaccgggcctaaaccggtcccttaggacccgtagggaccggtaaagacgttacggtgtaccgttaacggttgttttaacggtttacttacgtacgacgttaactagtttaacttctttaccttctaccgttacgtaacgggttaccgtacggtaaccggtaaacgggtaacggtaaaggttaacgaaacttaaccggtaacacggtgtacgtactaccgcgacttaaccgg

SEQ ID NO: 182530 - DNA, 773 bp, Homo sapiens
  misc_feature: GYAE6OF02JZFWD.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatcgacccagtcctccagacctccctggctgtcgtctcgtgggcgaggacggcccacatcaactgactaacgtccacgccagtagtttactttttaacacgcctaccaacctaataagtacgtttaacttacgtcttacggtacctacgacgaacgtaaaccgagtacactcgtaccgtgcctacgtcgccttacttagtttaccgtcgggtccgtacccggtacccgggtaacggtcccggggtaccctcggtacctcgttcgacggttcggaccgtaggtaccgggtcggtacggcttaacggtacttcaccttcgtaccgaacctctaccgacgcctacgtcctacggaccgtacggtacgtacggaaagtcggtttcgggacgttaagtttacgtttacgtttacgtttagtacgtaacttaaacgtttaacttaaggtttaaacctttaccgtttcccgtaacccttagggtaaccggtttaccggttaacccgggaacccggttaaaccgggaaaccggttaacgggtaaacggtaaaaccgttaaaccccggttaacggtaaccggttacgggttaccgggtaacccttacggtaccttaacccgttaaccg

SEQ ID NO: 182531 - DNA, 663 bp, Homo sapiens
  misc_feature: GYAE6OF02G6IGZ.22.14.B03.1.454.CMB.1.raw
  modified_base (452)..(452): a, c, t, g, unknown or other
  misc_feature (452)..(452): n is a, c, g, or t
  modified_base (469)..(469): a, c, t, g, unknown or other
  misc_feature (469)..(469): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctccctggctgtcgtctccgtgggcgaggacgggccaccatacaactgaccaagtccacgccagtagttactttttacagtccaccaacctaataagtacttaacgttagtcctttcgtccagtacaacgaacgagacacgtcgtcctcgcactcgcctctaactttcgacgggtccgttaccgtacccgggtacgtcccgggtccgtacgaccgtagtccgtaggtcgacgagggtccggtcggtacggactacggtcttaccgccgtctaccgaaccncgttaccagaccgtccnccggtcgacggtacgtcgtacggtagtacgtgggtacgtagttacttttagttagtcgtacgtaacgtacttaagttaatttaccttaccgttccccgttactaccggtacgtacgttcccggaaccggacggtaaaccgacgggttaagaaacttaaccggaaccgtaggtcgtacggactcgacctacgtcg

SEQ ID NO: 182532 - DNA, 593 bp, Homo sapiens
  misc_feature: GYAE6OF02FFJS1.22.14.B03.1.454.CMB.1.raw
  modified_base (315)..(315): a, c, t, g, unknown or other
  misc_feature (315)..(315): n is a, c, g, or t
  modified_base (407)..(407): a, c, t, g, unknown or other
  misc_feature (407)..(407): n is a, c, g, or t
  modified_base (418)..(419): a, c, t, g, unknown or other
  misc_feature (418)..(419): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttatttttacagctccacctaataagattacttagcttggttccagctaagaaacctaggacagtcgtcctgcactgctctatttacgnggtcgtactacccgggaatccggggtcctgaccgtattcgagtggcaggtcggtctgggacagtattacgactctcacctatacagcagccngacagctgagnngtgacttagttattatgtcagtactaaattagttacttacgttccttaccgtcgtaagtaccggtttaccggaccggtaacggggtaacccgaaggggttaaccggtaaaacttaccggaaaacggttaccgttaggttaccgggacctttaccgggacctaacccgttaaccg

SEQ ID NO: 182533 - DNA, 760 bp, Homo sapiens
  misc_feature: GYAE6OF02HDXEE.22.14.B03.1.454.CMB.1.raw
  modified_base (175)..(175): a, c, t, g, unknown or other
  misc_feature (175)..(175): n is a, c, g, or t
tcagacatacgcgtcacgaccggtgctcgatttagtgtgagtagttccgcgggggagctacaaaaggcaggcaggggcagcaagatggtgttgcagacccaggtcttcatttctctgttgctctggatctctggtgcctacggggacattgtgatgaccagtctccagactcccngctgtcgtctctgggcgtagacgggccaccgatccaactgctaacgtccagaccagtacgttatttttaccagtctccaaccaataagagttactagtcgttaggttccagtacaacgtaaaccgacggtacacgttccggtcctacgctaacgtcgtaccttactaccgttttaacggcggggtacccgttacccggttaaccccgggggtaacgttcccccgggggtcctaccggtaccggtaatttccggacggttcggactacgggtccgggtcgtagggactacgtactttcacttacctcgacctactctacgcacgtcgtacgacgacgtcgacggacgtagtcggtaggtacttaggtttaacgttcgtagttacgtacgtagtaaactttaactttaaggtttacccttacccgttaacctaccgttaaccgggtacccgggtttacccggtaacccgggtaaacccgggtaacggttaaaccggggtaaccggtaaacggtaacccgttaaaaccggtaccgggttacggtttacgggtaccgtacgtaacccggtacccgttaacgtttcccgg

SEQ ID NO: 182534 - DNA, 771 bp, Homo sapiens
  misc_feature: GYAE6OF02G5X9N.22.14.B03.1.454.CMB.1.raw
  modified_base (147)..(147): a, c, t, g, unknown or other
  misc_feature (147)..(147): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctgatctcgtggtgccgtacggganattgtgatcgacccgtagtctccgacgacctccgtggctgtgtcctcgtgggcgtaggacggcctaccgatacacgtacgctaacgtcagccgtaagtacgtttacgtttttacacggtaccctacgtaaacctaacgttaacggtaactttacggttaaccggttacgttcgtaccggttaacgaccgaacgtaaaacgtacggactaacgttcccgtacgtcggtacacgtacgtaccgttctaacgttcgggtcgaaccgttacccggtaccggtaacccggttcccgggtaccttacgtaaccgtcgtttacggacggttcggacgtaaccgggtcggttaccggtagtaccgacgttcgtttaaccgactcggtcccaaacgtccgttaaccgacggtactaaccgtccgtcggtaacccgtagtaccgtaccgggtaatcgtaagggttccgtaacgtttacgtttaaattcccgtttagaacgttacggttacaaacgttttacctttagtaccttccgttacaccgtaaccgggttcttacggacgttaacgacggttacgtaacgtaacgtcgttaaacggcgtttacgacgtcgtacggtccgtacttacccgg

SEQ ID NO: 182535 - DNA, 748 bp, Homo sapiens
  misc_feature: GYAE6OF02HFUXH.22.14.B03.1.454.CMB.1.raw
  modified_base (732)..(732): a, c, t, g, unknown or other
  misc_feature (732)..(732): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacagttgtgatcgacccagtcctacagacctccgtggctgtgtcgtcgtgggcgagacggccacatacaactgactacgtaccacgccgagtagtttaactttttacacgtccttaccaacctaaagtaacgtagtttaaccgttaacgtcgttacggttaccgaagtaccaaacggaaaccgaggaacctacttaccggtaccctacgaccctaccgttacgacctttactaacgtttacggtaccgggtcccgttaaacccggtaccccgggaaccggttcccccgggggttaccgtccgtaaaccgttcgtaccggtaacggttcggtaaacgccgggtaacgggttcgggtccggtaaacctaagggttaacctttcgtaaccttacgttaccaaccctaacgtacacgtccgaacgtaccgtagtaccgaggtaccagggaacgtacgttcggtagtaccgttagtttattcgttagtacgacgtaacaagttaattaccgttattcctaacgtactacgtacctacggtaacggtacgtaacggtaacgtacggaactaacgacgttaacgtaggtacgngtacgtacacgttacg

SEQ ID NO: 182536 - DNA, 705 bp, Homo sapiens
  misc_feature: GYAE6OF02HSWRS.22.14.B03.1.454.CMB.1.raw
  modified_base (385)..(385): a, c, t, g, unknown or other
  misc_feature (385)..(385): n is a, c, g, or t
tcagacatacgcgtcacgaccggtgctcgatttagtgtgagtagttccgcgggggagctacaacaggcaggcaggggcagcaagatggtgttgcagaccaggtcttcatttctctgttgctctggatctctggtgcctacggggacattgtgatgacccagtctccagacctccctggctgtgtctcgtgggcgaggacgggccaccatcaaactcgctaagtccagccagtagttatttttacacgtctaccaacctaaataacgtagttacttagcgtttggtacctagcaacgaaaccgacggacattccgtcctgcactgctctactttacgtgggaccgtccgtaccgggaacgttcccggggtaccctcggtacccgtnttcgacgtggccgtaggcggggtcgtcgggaactacggtacttttaccgacttccgtacctaaccgtactacgacgccacgtcccgtgacgacgggtctaaggaacggtacgttcgggtacgttacgttaagttttacttttacgttaggtacgtaagtaccctaaagtttaactttacttaaccgttttccgtaccttaacgtacgttaccgggttaccggtaacccggtaaacgggtaaccgtaacgggtaacgtaaaaccgtaacgaaaccggtaacggttaccggtacgggtactaacggtaccctacgttaaccg

SEQ ID NO: 182537 - DNA, 731 bp, Homo sapiens
  misc_feature: GYAE6OF02GLK76.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagactccctggctgtgtctcgtgggcgagacgggccaccatcaactgcaacgtccagccagagttatttttacagctaccaccaaatagagtttactagtcttcggttccagacaacgaaaccaggacaacgtccgtcctggccactcgcttactacgtttacgtcgggtccgtaccgtacccgggtaacggtccgggtcccctacggacccgtattaccgaggtcgggacctacgggtcggggtcgtacggggtaacgtacgttacgtttccacctccgttaccaacccgtattaccgacgcgtaaccgtcccgttggaccgtaggggtacctagggaaagtacgtttggggtaacggtaacctttaaggttttttattacgttcgtaccgaagtaacttaaaatttcgtttaactttaccgtttcccctaccgttaagggtaaccggttaccgtttacccggggaacgaaacggggtaacccttaaggggaaccgttaaaacgttaacccgaaacgggtacttcggggtaactaccgtttcgggacccctaacgttaccgg

SEQ ID NO: 182538 - DNA, 812 bp, Homo sapiens
  misc_feature: GYAE6OF02JAFKH.22.14.B03.1.454.CMB.1.raw
  modified_base (610)..(610): a, c, t, g, unknown or other
  misc_feature (610)..(610): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctggtgcctacggggacattgtgatgacccagtctccagactccgtggctgtgtctcgtgggcggagacgggccaccatacaactgacgacgtaccacgaccagtagttatttttacagtcctaccaactaataagtacgttacttagtcgtttacggtaccacgtacgaacgtaaaccgaggacacgttaccgtccgtcgactactcgtactacgtacgtttacgtcggggtccgtaccggtaacccgggtaaccggttcccggggtaccccgtacggtaacccgtacgttaccggtacgggttacgggaccgtacgggtccggggtacggtccggggtaacgtaacggttaccgtttacccgtacctttcccgtaccaacccgttacgtccgaactacccgggtaaccgtcccgtggacggtaccggtagtaaccggaaggttaccggtgggttacccgtaatttaaaccgggtttttnttacgggtttccgtaacggtaagtacccggttttaaatttaaccgtttaacttccctttaccggttaccctaccgggttaaccgggtaccgtttacccggggaaacgtaacccggggttaaacggtacgggttaaacgaaaccgttaaccgaaaccggttcgggttagtaccggtcggtaccctaacccggaactttaccgg

SEQ ID NO: 182539 - DNA, 903 bp, Homo sapiens
  misc_feature: GYAE6OF02GM3QK.22.14.B03.1.454.CMB.1.raw
  modified_base (199)..(199): a, c, t, g, unknown or other
  misc_feature (199)..(199): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacagttgtgagtgacccagtctccagactccctggctgtgtctcgtggcgagnggccacatcaactgcaacgtccagccagagttatttttacagtcctaccacaaactaagtagtttaacttacgtacgtttacggttccaacgactaaccggaaaaccaacggaactacgttaccgtccgtacgcgtacctcgccgtaccttagtttaacgtcggggtaccgttcccggtaaccccggggtaacggtccccggggttaccccgtacgggtaacccggtaacgttccgaagggttaccggacggtaccggtccggggttaccgtcggggtaaccgtagggttactttaccgtaccggtttacccttaccgacccgttaccgtaaccgtaacgtaccggaactacccgtacggaccgttaacgggtacccgtaaggtaaaaccggttaacggttacggtttaacggtaccggtttaaacgttttaacgttttaacgtttagttaacccgtaaacggtacgtaaaaccgttttaactttaaccggtttaccttttaaccccgtttacccggtaacgttaacccggttaaacccgggtttaccccggggtaacgtaaaacccggggggttaaaacccgggtaaaccgggttaaaacgggtaaaaacccgttaaacccgggtaaaaacccgggttaacccggtttaagggttaacccgggttaaccggttaccggggtaaccttaaccccggttaaccgg

SEQ ID NO: 182540 - DNA, 863 bp, Homo sapiens
  misc_feature: GYAE6OF02IJLY7.22.14.B03.1.454.CMB.1.raw
  modified_base (194)..(194): a, c, t, g, unknown or other
  misc_feature (194)..(194): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtgtcgtacggggactattgtgatcgacccagtctccagacctccgtggctgtgtctcgngggtcgaggacggccaccagtcaagtcggactaacgtccacgaccgacgtagtttactttttacacgtcctaccgaacctaagttaaacggtaacggtttaacttaacgttccggttttacggttacctaacggtaccgaaacggtaaaaccgtacggtaacctaacgttaccggttaccccggttacggacccttacgttcccggtaccttacgtttaacgttttaccgggtcgggttacccggtaccggttaaaccccggggtaccggttccccggggttaccgtaccggtacccggttacgttaccggaacgggtcggtaccggtacgggttcggggtacggttacggggacgttaaacgttaccgtttacctaaccgtttcccgtaaccaaccggtttacttacccgacggtacccgacggttccccgttaagaccggagggtaacccgttaggaaagttcggttcgggtaacgtacgttttaaagtttgttaaattccggaagttaagtaccctttaaggttacctttaagttacccgtttccctaaccggttagtaaccgtttaacccgggtccggaacggttaaaccggggactttaacggggaactaaaccgtaaccggtaacgttaggtaccgtggtaccctaaaggcccttaataccgg

SEQ ID NO: 182541 - DNA, 710 bp, Homo sapiens
  misc_feature: GYAE6OF02JENMZ.22.14.B03.1.454.CMB.1.raw
  modified_base (518)..(518): a, c, t, g, unknown or other
  misc_feature (518)..(518): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtgggcgagagggccaccatcaactgacaagtccagccagtagttattttttacagcctacctaccaataagtacgttacttagtcttcggttccagtacaacgaaaccaggactagtccgtcctaggctaacgtcgtcctactaacgttttacgtacggggccgttaccgtaacccggggtaacgttacccggggttacccgtcggtaaccgtacgttacgaggtggaccgacggtcgggttcgtcgggtacagtactttaccgacgtctaccgactaactcaacgtccgacgtaccgtggacctaggcctaagaaggttctacgggttntccgttaagttttactacggtttcggtctaaggtaaccttaaagtttacttttaacgttaccgtttaccctacccgttacggaccgtttaccggttacccgaaaccggtaaccggggtaaacttaaagggttaacgtaaacggttaaccgaaaccgttacgttgggtaacctcggtacgaccctaacgttcg

SEQ ID NO: 182542 - DNA, 789 bp, Homo sapiens
  misc_feature: GYAE6OF02HZMB0.22.14.B03.1.454.CMB.1.raw
  modified_base (130)..(130): a, c, t, g, unknown or other
  misc_feature (130)..(130): n is a, c, g, or t
  modified_base (187)..(187): a, c, t, g, unknown or other
  misc_feature (187)..(187): n is a, c, g, or t
  modified_base (291)..(291): a, c, t, g, unknown or other
  misc_feature (291)..(291): n is a, c, g, or t
  modified_base (448)..(448): a, c, t, g, unknown or other
  misc_feature (448)..(448): n is a, c, g, or t
  modified_base (467)..(467): a, c, t, g, unknown or other
  misc_feature (467)..(467): n is a, c, g, or t
tcagacatacgcgtcacgaccggtgctcgatttagtgtgagtagttccgcggggagctacaacaggcaggcaggggcagcaagatggtgttgcagacccaggtcttcatttctctgttgctcgtgatctntggtcgccgtacgggacattgtcgatcgaccagtctccagctcctggctgtctctgnggtacagcggccacctatcaagtgcaacgttcagtcaagtagttattttaccagcctacaacaataagtgttaacctatcgttgtccaagcgtaaacgaaaccngggaacttactccggttctacgacaacgtcgtcttaacgatttaaccgtgggactcttaaaccggcggttaacggtcccgggcccttaggacccgtaatttccggaacgttggtccccaaggtaccggttccgaaggacctaggtaattccggtacnctaacgtcccaattcgganccggattccgagtcacggatagggaaactttgaaggtcccggtaattaaccgttttaaggtactttttaccccggggtaaagtaccgtaagttaaacgtttaacgtttaaaccgtttaacccgttacccgttacccgggtttaaccgttaacgggtttaacccggttaccccgggggtttaaacccgaaaaccgggggttaaaccggtaaacggggttaaaacccggggtttaaaaacctaaaaccgggttaaaaccccggtttaaaacggtttaccgggtaacccggtttaccgggtttaacccgggaaccttaaccccgg

SEQ ID NO: 182543 - DNA, 741 bp, Homo sapiens
  misc_feature: GYAE6OF02JYB0C.22.14.B03.1.454.CMB.1.raw
  modified_base (131)..(131): a, c, t, g, unknown or other
  misc_feature (131)..(131): n is a, c, g, or t
  modified_base (152)..(152): a, c, t, g, unknown or other
  misc_feature (152)..(152): n is a, c, g, or t
  modified_base (176)..(176): a, c, t, g, unknown or other
  misc_feature (176)..(176): n is a, c, g, or t
  modified_base (186)..(186): a, c, t, g, unknown or other
  misc_feature (186)..(186): n is a, c, g, or t
  modified_base (712)..(712): a, c, t, g, unknown or other
  misc_feature (712)..(712): n is a, c, g, or t
  modified_base (728)..(728): a, c, t, g, unknown or other
  misc_feature (728)..(728): n is a, c, g, or t
  modified_base (732)..(732): a, c, t, g, unknown or other
  misc_feature (732)..(732): n is a, c, g, or t
tcagacatacgcgtcacgaccggtgctcgatttagtgtgagtagttccgcggggggagctacaacaggcaggcaggggcagcaagatggtgttgcagacccaggtcttctatttctctgttgctctggatntctggtgccgtacggggactnttgtgatgaccctacgtcctaccncgacctcccnggtctgtgtctcgaggcgagacggccacactcgaactcgacaccgtaccgcgtaccgaagttaacgttacttttacgactcctacctaaaccaagtaagttaacggttacttacgtcgttacgggttacacgaacgtaaacgtaaacccgacggtacaacgtttccaaccgtcgacctacctggactacctacggtttaagtccgggtacccgtaccggtaaccccgggtaacgttcccgggggtactaccggtacgttaccggtaaccgttggggtcgaaccggtggggtaacccggtcgttacgggaacttacggtactttaccgtacggtcccttaaccgaccgtacttacgacgtaacggtctccggtcggaacgtaccgggaccgttagaagtacggtagtaccggagttatttaacggttattaggtacacgtaagtactaacttcgttaccctaagtacttcggaaccgtacggttaccgaactaggaacgtacggtagtaacgtaaccgtagtaacgngggtacctggtaaccnccgngttaacccg

SEQ ID NO: 182544 - DNA, 763 bp, Homo sapiens
  misc_feature: GYAE6OF02G9KEQ.22.14.B03.1.454.CMB.1.raw
  modified_base (437)..(437): a, c, t, g, unknown or other
  misc_feature (437)..(437): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgtttgctctggatctctggtgccgtacggggacattgtgatgacccagtctcagacctcctggctgtcgtctcgtgggcgaggacgggcccaccgactcaacgtgacaacgtccacgccgaagtagtttaacttttttacgacgtacctacctaaccgtaaaacgttaacgtacgtttaacgttaagtccgttttacggttaccacgtaccgaaacgaaaaccgaggaactacttccggtacctgcgtactcgtacctacgtactttacgtggtccgttaccgtacccgggtaacgtcccgggtccgtacgaccgtagtcnggtcgacgcggtcggtcgtacggacgtagtactttacgacttcctaccgacctatcgaactccgacgtccgtgaccggtacggtactaggaacggtacgttcgggttacgtacgtttaacgttttaaggtttcacggtttaaccgaagtaacccgtttaaatttaacctttaaacgttttcccttaccgttcgtaacgttaccgggttaaccggttaccggaaccggttaacgggaacccggttaaacggttaacggaaaaccgttaccggtaaaaacgttacgttacgggttaaccgtccggtaacggtaccctaacggttaccg

SEQ ID NO: 182545 - DNA, 862 bp, Homo sapiens
  misc_feature: GYAE6OF02IQTTO.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacgggactattgtgatcgacccagtctccagacctcccgtggctgtgtctcgtggacgagacgggccaccataccaactcgacaacgtacccagtccgaagtagtttactttttacgcgactacccaaccaaagttaacggtaacgtttaaccgtttacgtaccgtttacggttaccgaacgtaaccgtaaacggaaaacccgaaggtaaccgtaacgttacccggtacccttaccggtacctaaccggttaccgtaccgttaacctaaacgttttaccgggttaccggggtacccgtttaacccgggtaaaccccggggtaaaccggtttccccggggtaccccttagggtaaccccgtacgttacgtaacgggttacggaccgtaacgggtcgggttaccgaacggggtaaactacggttaacctttacccgaccgtaccttaccgaacccgtaattacccggaaggtacctaacggtcccgtacgtaccgtaacgggaccgtaaggtaaaagtcggttaaccgggtctaaaccggttagtttaacctaaccggttagttaaccgagttaactaattaaccttaacgtaaccgtttacccgtaccgtaaccggtaagttaccggtacggaacccggtaacggaaacgtaacggttaaacgtaaaaccgtaaccggtaaagtaccgttcggtaacgaccgtacgacccgtaaccgttacgg

SEQ ID NO: 182546 - DNA, 651 bp, Homo sapiens
  misc_feature: GYAE6OF02FJW77.22.14.B03.1.454.CMB.1.raw
  modified_base (469)..(469): a, c, t, g, unknown or other
  misc_feature (469)..(469): n is a, c, g, or t
  modified_base (483)..(483): a, c, t, g, unknown or other
  misc_feature (483)..(483): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagacctcctggctgtgtctcgtgggcgagagggccaccatcaactgcaagtccagccagtagttatttttacagtcctccaacctaataacgtagtttacttagtcgtttggttaccagcaagaaaccgaggactaacgtcgtcctgacctactgtcctactagtttccgtacggtccgtaccggtaccggtaacgtcccggggtaccctggtaccgtacttcgaggtacggtccgaggtccgggtcgtacgggactagttcgttacctacttcctacaccctataccgagtccacggtccncggacgtaccgggntacggaaagtgtaccggtgtaccgttagttttactagttagtcgagtacttaattactttattacccgttcctacttacgacggttacgttaccggaacgtacggtaacgtaaggtaccgtaaagttaaccgtaacggtagtcgtaggacctccggtactacctacgg

SEQ ID NO: 182547 - DNA, 774 bp, Homo sapiens
  misc_feature: GYAE6OF02GBZM0.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctcgtggcgagagggccacatcaactgcaagtccagccagtagttaattttttacgacgtctaccaacctaaagtaagtacgtttaacttacgtcgtttcggttccagacgaacgaaaccgaaggactactacgtcctgacctacgtcgtacctctaactttaccggtcggggtaccgttaccggtaaccccggggtaacggttccccggggttacccgtacggtaacccgtacttaccggtaggtcgggtaccgacgggtcgggttacggtagggtaactacggttacgtttacgaccgttacgtaccaaccgttagtacgaacgccgtaaccggtccgtacgtaccggacgggtacgtaaggtaaacgtagttcgggtacggttaccgttaagttttttaactaacgttttggaacctaagtaaccgttaaacgttttaattacgtttaacctttccctaggttaccgttacgggttacccgttacgggtaaccggtaaacggtaccggttaaacggggtactaaaaccgtaaccggaaaaccggtttacggtgggtacccggtacgtaaccgaccctttacgtaacg

SEQ ID NO: 182548 - DNA, 911 bp, Homo sapiens
  misc_feature: GYAE6OF02HE3OR.22.14.B03.1.454.CMB.1.raw
  modified_base (189)..(189): a, c, t, g, unknown or other
  misc_feature (189)..(189): n is a, c, g, or t
tcagacatacgcgtcacgaccggtgctcgatttagtgtgagtagttccgcgggggagctacaacaggcaggcagggcagcaagatggtgttgcagacccaggtcttcatttctctgttgctctggatctctggtcgaccgtacgggactattgtgactcgacccagtctccacgtacctcctgtctgtntctcgtggacgagacggccaccgactactaactcgctaacgtccgacgaccgtagttacgtttaatttttacgacgtcctacccgtaacctaaagttaagtacggtttaccttacggtacctttcggttaccacgtacgaaacgtaaacccggaacgggtactaaccgttcccggttacccgtacgacccgtacgtccggtacctttaccttaacggttttaaccgggttcggggtacccggtttaacccggtaacccccggggtaacccggttaccccgggggttccccgtaaccggtaacccggttaacgtttaccgggttacgggtacccgggtacggtacccgggttccgggggtttaccggtttaccgggggaaaaccgttacggttttactttaaccccttaacccggtttccttaaccccggtaacccttaccggtaccgtaccggtaccccgtacggtacccggtttacggaaccgggtcggtaaccggtaggtaaacgttacgggtttggtaacgggttacgtttaaacgttttgtttaaacgttcgttagttaaccgtactttaacgttaactttacgttacccttaccgttccgttaacgtaccggttacccgttacgtaaccgggtaaccggtaacgtaacgggtaacctaaggttaaaccgaacggttaacgtacggtacggtaccgtaccgtaccgtaaccgtttccg

SEQ ID NO: 182549 - DNA, 751 bp, Homo sapiens
  misc_feature: GYAE6OF02H801P.22.14.B03.1.454.CMB.1.raw
  modified_base (159)..(159): a, c, t, g, unknown or other
  misc_feature (159)..(159): n is a, c, g, or t
  modified_base (449)..(449): a, c, t, g, unknown or other
  misc_feature (449)..(449): n is a, c, g, or t
  modified_base (604)..(604): a, c, t, g, unknown or other
  misc_feature (604)..(604): n is a, c, g, or t
tcagacatacgcgtcacgaccggtgctcgatttagtgtgagtagttccgcgggggagctacaacaggcaggcaggggcagcaagatggtgttgcagacccaggtctcatttctctgttgctctagtatctcgtggtgccgtacggggacagttgtagancgaccctagtcctccagtacctcctggctggtcgtccgtcggtcgggacgaggacggacccacgataccaacgtgactaacgtccagaccgtaagtaatttacttttacgacgtacctacaaccgtaataaagtacgttacgttaagtcgttacggtaccagacctaaacggaaccaaggacctaatcccggttacctacgtaccacgtgaccttacgttaacgtttccggtagggtaccgtacccgtaaccggtacggtacccggttcgcgtaacctacgtaagtcggngtacacgggtcgtcgtaggactacgttcgttacacgttaaccgtccaaactcgtaacgaaccgtactacggtaccttagggtaacccgtaaaggttacggttacggaaaacggtggtttaccggtattaacgtttaaagtttacgttaaccggtnttaaccggaaacgttaactttaacgtttaactaacgttaaccgtttccgaaactttaacgtaccgttaaccgacggtaacccgtaggaaaccgtaagttaaggaaccctaacgaagtacggtactccgtaacgtcgacctattaccg

SEQ ID NO: 182550 - DNA, 650 bp, Homo sapiens
  misc_feature: GYAE6OF02GB4DB.22.14.B03.1.454.CMB.1.raw
  modified_base (231)..(231): a, c, t, g, unknown or other
  misc_feature (231)..(231): n is a, c, g, or t
  modified_base (473)..(473): a, c, t, g, unknown or other
  misc_feature (473)..(473): n is a, c, g, or t
  modified_base (496)..(496): a, c, t, g, unknown or other
  misc_feature (496)..(496): n is a, c, g, or t
  modified_base (504)..(504): a, c, t, g, unknown or other
  misc_feature (504)..(504): n is a, c, g, or t
  modified_base (634)..(634): a, c, t, g, unknown or other
  misc_feature (634)..(634): n is a, c, g, or t
tcagacatacgcgtcacgaccggtgctcgatttagtgtgagtagttccgcggggggagctacaacaggcaggcaggggcagcaagatggtgttgcagacccaggtcttcattctctgttgctctggatctcgtggtgccgtacggggactattaatgatcgaccctagtcctaccacgacctcctggctgtgtctcgtgggcgaggacggccaccatcaatgcaagtccanccgtagagtttattttacacgtcctaccaacctaaagtaagtacgttattagtcttggttaccagtacaaagaaaccgtaggaactactcggtacctagacctaacgtcacttactagtttacgtcgggtaccgtaccgttacccgggtaacgttcccgggtccctacgtaaccgtatcgagtcgacgcggcggtcgtggacacgtgtacctctctcaacacgtcaaggtcctacggtaccnggacgtacggactaggaaagttnacgggttnaacctttgttaaacttgtagactaggtaactaatttactaacttccttaccggtctacgtaacgtccgtagtaaccggagggtaactaaacgggtataaaaccgtacgtaacgttacgtaggtcggaacncgtaaccacttaacgg

SEQ ID NO: 182551 - DNA, 795 bp, Homo sapiens
  misc_feature: GYAE6OF02HT8ME.22.14.B03.1.454.CMB.1.raw
  modified_base (637)..(637): a, c, t, g, unknown or other
  misc_feature (637)..(637): n is a, c, g, or t
  modified_base (645)..(645): a, c, t, g, unknown or other
  misc_feature (645)..(645): n is a, c, g, or t
  modified_base (686)..(686): a, c, t, g, unknown or other
  misc_feature (686)..(686): n is a, c, g, or t
tcagacatacgcgtcacgaccggtgctcgatttagtgtgagtagttccgcggggagctacaacaggcaggcagggcagcaagatggtgttgcagaccacggtcttcactttctcgtaagttcgctcgtcggatctctggtcgaccgtacgggtactagttgtagacgtcgaccacgtctccagacctccgtggtctgtcgtcctcgtggacggtaggacggtccaactacgtacgtaacgtcgacgtaacgtaccgacgacgtaacgtacgttttaactttttacgacgtcctaccgaactaagtaaacgtacgtttacttaacgtcgtttacgtaccgtagaacgaaacgtaaaccgaacggtaacgtacgtccgttaccgtacgtaaccgtaccgtacgtccttaacgttaaaccgttttacgtacggggtaccttacccggtaaacccgggttaacgttcccggggtaccttaccgtaaccgtacgttaccgacggttacgacggacggtaccgggttcgtacggtaactaacgttacgttaccaccgttccttacgaaccgtacgtacgaacgtcgccgtcgtacgacgtcgggtaacttacgagttaaggttcgtacgttacgttaagtttntaacgttntaccggaacagttaaattacgttaacgtttacctccgttanaccgtaacgttaccgggtacaccggttaaaacggacgttaaacggaacgtaacctaacggaaaacggtccgttagggtacccgtaagtacccgttcgaacccttaacgg

SEQ ID NO: 182552 - DNA, 786 bp, Homo sapiens
  misc_feature: GYAE6OF02FH0BK.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgacccagtctccagacctcctggctgtgtctcgtggcgaggacggccaccatcactcgacacgtccacgccgagtagttactttttacgacgtcctaccaacctaaagtaacgtaacgttaacgttaacgtcgtttacggttaccgacgtacgaaccgtaaacgacggaactacgttaccgtccttcggacctacggtctcctacgttaacgttttacgcgggtaccgtaccgtaacccggggttaaccgtcccggggttacccgtaggtacccgtacgttacgtacggtcggacggtacggtcggggtcgtagggacgtacgtacgtttccaacctccgtacaccgtctacaggcctacggtcctcgacgtaacggccgtaggtaagttcgtcggttacggtaccgttaagttttaacgttacggtttggtaaccgtaacgttaacctttaagttttaaacgttacgtttacccttaaccgttaccctttaaccggtacgttaccgggttacccgggaacccggttaaccggggtaaaccggttaaacgggtaaaccggttaaacccgtaacgtaaaacgtcggttaacgggttcggtacccgtttacggaccccgttaacttacccgg

SEQ ID NO: 182553 - DNA, 607 bp, Homo sapiens
  misc_feature: GYAE6OF02FS53D.22.14.B03.1.454.CMB.1.raw
  modified_base (368)..(368): a, c, t, g, unknown or other
  misc_feature (368)..(368): n is a, c, g, or t
tcagacatacgcgtcacgaccggtgctcgatttagtgtgagtagtcccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcagtccagccagagtatttttacagctccaccaataagagttacttagcttggttccagcagaaaccaggacatcgtcctgcactgactcatttactgggctcctaccgggaatcccggggtcctgaccgtattcagtgcgagcgggtctgggacngtattcgactctacacctagtcagcagtcctggactagccgtagaacggaattggtaggtacctagttttattatttggtacctaggtaactaagttaattaacttcgtttacccctcttacgtacggttaccggttcggaacccgtaacggggtaaccctaaggggttaaccggtaaaacttacccgtaaaacggttaccgttgggtaccggtacgttaccgacccgaccgttaaccg

SEQ ID NO: 182554 - DNA, 772 bp, Homo sapiens
  misc_feature: GYAE6OF02JNRHZ.22.14.B03.1.454.CMB.1.raw
  modified_base (413)..(413): a, c, t, g, unknown or other
  misc_feature (413)..(413): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctcgtggtcgccgtacggggactagttgtgactcgacccagttcctccgacgtacctccgtcggtcttgttcgtcctcgtcgggacggaggacggcccactagtaccgaacgtcgacgtaacgtccagtaccgtaggttacgttttacttttacgaacgtacctaccgaaactaagttaagttacgtttaacgtcggttacgttacggtaccgacgaccgtaaacgaaaccgtacggtactacggtccgtacgtacgactacgtctacctacgttacgttacggngggtacctaaccgggtacccggtacggtcccgggtacctacggccgttatcgtacggtcggccggaggtcgggtcacgggtactagtcgtctctacgtacgactgtccgactcgtcgtacgcgcgtacgactaggacttacgtcgttacgttaacgttagttttacgtacggttacgtaaacgttactaaattaacgtttacttacccgttacctttacccgttaccggttaaccgtaaccggtttacccgggtaccgtcgggtaaaccgggtttaacgggacgttaaacggttaaaccgtaacggttaacccggtaacgttaccggtctaaccgggtccttaccccggaatttcccgg

SEQ ID NO: 182555 - DNA, 848 bp, Homo sapiens
  misc_feature: GYAE6OF02F6TWA.22.14.B03.1.454.CMB.1.raw
  modified_base (227)..(227): a, c, t, g, unknown or other
  misc_feature (227)..(227): n is a, c, g, or t
tcagacatacgcgtcacgaccggtgctcgatttagtgtgagtagttccgcgggggagctacaacaggcaggcaggggcagcaagatggtgttgcagacccgacggtcttcatttctctgttgctctggatctctggtgccgtacggggacattgtgatcgacccagtcctccagtacctccctcggcgtgtcgtctcgtgggacgaggacgggccaccgactacacngtcaacgtccacgacctagtattacttttacgacgtcctccaactaataagtacgttacttacgtcgttcgttaccgtagtacgaacgtaaaccgacggacctactccgttccgtacgtactacgtacgtccgttacctagtttaccggtcggggtaccttacccggttaacccggggtaaccggtttccccggggtacccgttaccggtaaccccgttagttacccgggtaacggttcggggtaccgacggggttcccgggttaaccggttacgggggtacccgtaagtttaccggtttaccgtacccgttaaccgttcccgtaaccgttaccgtaccgtaccgtaccggtacgtcccgggtaccgtaccggaccggttaacgtaacggtaacggttagtaccggttacggtaccgtttagttttaacgtttcgttacgtacgttaacgtactttaaacgtttaactttaacgttaccgtttcccgttaaccttacgtaaccggttaccggtttacggaaccggtaacgggtaaacggtaacggtttaacggtaaacccgtttaacgaaacggttacccgttacgggtaaccgttggtacccggaaccttccgtaaccgg

SEQ ID NO: 182556 - DNA, 645 bp, Homo sapiens
  misc_feature: GYAE6OF02FU8CJ.22.14.B03.1.454.CMB.1.raw
  modified_base (433)..(433): a, c, t, g, unknown or other
  misc_feature (433)..(433): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctccctggctgtgtctcgtgggcgaggcgggccaccgactacaactgacacgtccagccagtagttattttacacgtctaccacaaataagacttacttagcgttgttaccagacaacgaaaccagggtaccataccgtcctgacctactgtctctactttacgcgggtactaccggtaaccgggacgtccgggtccctagaccgtatccgagtggcagggcggtcgtacgggacagttcttaccacctcgtacctacctntaccacgccacggtcctacggccgaaggtcgtaacggtaacgtagtggtcggtaacgttaagtttactacgttgtacctaacgtacctaaattacgtttacttaaccttccctacgtaacacggtaccggttacgaccggtaagggaaccgtaacggttaggaaacctacggtaaactcgggtagtacggtcctaggtaccctacgttaccg

SEQ ID NO: 182557 - DNA, 724 bp, Homo sapiens
  misc_feature: GYAE6OF02I0C2A.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggacattgtgatgacccagtctccagacctccctggctgtcgtctcgtggcgagacggccaccatacaactcgacaagtccacgaccacgtagttatttttaacgcgtacctaccaaccaaagtaacgtaagtttaaccttaaggtctttacggttaccgaagaccgtaaacgaaaaccgaggtaacctaacgttccgtaccgtacgaccgtacgtcgtaccttacgttaagttttaccggtacgggtaccgtaccggtaacccgggtaacggttccccggggtacccctacggaccgtacttcgaacggtcgcgtacggtcggggttcgtagggaactagtacctttaccacgttcctaccacgtatcgaacgctaacggccgttgacgaggtactaacggaagttacgttgacggtactttacgtttaactacttacgacctaagtacgtaaactttattaacttaccgtttcctaccgttacgaaggtttacccggttacgacggtaaacgggaactaagggtaacgtaaaccgttagaacggttaacgtggtaaccgtcggtactaccgaccttacgg

SEQ ID NO: 182558 - DNA, 673 bp, Homo sapiens
  misc_feature: GYAE6OF02GVRCU.22.14.B03.1.454.CMB.1.raw
  modified_base (223)..(223): a, c, t, g, unknown or other
  misc_feature (223)..(223): n is a, c, g, or t
  modified_base (655)..(655): a, c, t, g, unknown or other
  misc_feature (655)..(655): n is a, c, g, or t
  modified_base (665)..(665): a, c, t, g, unknown or other
  misc_feature (665)..(665): n is a, c, g, or t
tcagacatacgcgtcacgaccggtgctcgatttagtgtgagtagttccgcgggggagctacaacaggcaggcaggggcagcaagatggtgttgcagaccaggtcttcatttctctgttgctctggatctctggtcgccgtacggggacattcgtgagtcgaccctagtctccagacctccctggctgtcgtctcgtgggcgagacgggccaccatccaacgtncgaactccacgtaccagtattactttttacacgtcctaccgaactaagtaagtaacgttacttacgtcttacggttccagacaacgtaaaccgaggaccactccgtctacgctacgtacgcttacttaacgttacgtcgggtcttacccggtaaccgggtacgttcccgggtccgtacgtaccgtattccgagtcggcgacggtcggtcgtacgggactacgtacttacgactctaccgacgtactacgacgtaccacggtccaggtacgacggtagaggtaacggtatcggtacgtacgttagtttacttacctacgtaccgtaacacgtaatttacgttacttacgttcctacttacgcgttaaccggtcgtaaccggacgtaccggtaaagttacggaaaccttaacgaacgtacgtacggtaccgacnccggtaaccncgttaccg

SEQ ID NO: 182559 - DNA, 804 bp, Homo sapiens
  misc_feature: GYAE6OF02I5HZZ.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggactattgtgatgacccagtcctccagactccctgctgtgtctcgtcgggacgaggacgggccaccactcaactcgcaacgtccagccagtagtttactttttaacagtcctacctaacctaacgtaaaggtactttaacgttacgtcgtttacgggttaccaacggtacaaacgtaaaccgaggaactacgtccgtacctcggtactacgtcgactactagtttacgtcggtccgttaccgacccgggtacgtcccgggtcctacggaccgtacttacgacggtcggaccgtacgggtccgggtcggtacgggaacgttacggttaacgtttacccggacctttaccgtaccgtaaacccgttacgtaccgaaacggtccccggtaacgtccccggttaagccggtaaccgggtccgtaaaggacggttacggttacgggtcgttaaccggttagttttaaaccggttagttcggttaaccgtaagttaacccgttaaatttacgtttaaccttacgtttaccccgtacctaccgggtaaaccggttacccgggttacccggtaaaccggtaaacggggtacccggtaaacggtaaacgttaaaccgttaaccgtaaacggtaacgttcggtaacggtcgtaactcccgtaacgtaccg

SEQ ID NO: 182560 - DNA, 661 bp, Homo sapiens
  misc_feature: GYAE6OF02IJYNN.22.14.B03.1.454.CMB.1.raw
  modified_base (130)..(130): a, c, t, g, unknown or other
  misc_feature (130)..(130): n is a, c, g, or t
  modified_base (276)..(276): a, c, t, g, unknown or other
  misc_feature (276)..(276): n is a, c, g, or t
tcagacatacgcgtcacgaccggtgctcgatttagtgtgagtagttccgcgggggagctacaacaggcaggcaggggcagcaagactggtgttgcagacccaggtcttcatttctctgttgctctggatntctggtgcctacggggacattgtcgatgaccagtctcagactccctggctgtgtctcgtgggcgagagggccaccagtcaactgcaagtcagtcagagttatttttacagctccaccaataacgagttactagacttggtcagcanaacagacataccgacctgacactagcgtcagtttacacggtacgtcgttaaccgggatccggggtcctggaccgacttacgagtggcgaacggtcggtacgtcggggaacacgttacgtttcaaccgttctaacgaaccggtacttaccgacgtccgtaacgccgttacggacgtaacggaccgttacggaaggtacgtcggttaggtaccgttagttttactagtttacgtactaacgtaccttaattaaggtttacttacgttttacctaccgttaccgtaccgtaacgtttcccgggaacgtaacgggaaccgtaaacgggtacgtaaacgttacccgaaaacgtacgtacggtacggtaccggtacgtaccgacgtaaccg

SEQ ID NO: 182561 - DNA, 793 bp, Homo sapiens
  misc_feature: GYAE6OF02GM373.22.14.B03.1.454.CMB.1.raw
  modified_base (68)..(68): a, c, t, g, unknown or other
  misc_feature (68)..(68): n is a, c, g, or t
  modified_base (159)..(159): a, c, t, g, unknown or other
  misc_feature (159)..(159): n is a, c, g, or t
  modified_base (529)..(529): a, c, t, g, unknown or other
  misc_feature (529)..(529): n is a, c, g, or t
tcagacatacgcgtcacgaccggtgctcgatttagtgtgagtagttccgcgggggagctacaacaggnaggcaggggcagcaagatggtgttagcacgacccgaggtcttctatttctctgttgctcgtggatctctggtcgccgtacgggactattgngatcgaccgagtcctccacgacctccctggctcgttgtctcgtcgggacggaggacggccacactacactgacaacgtccagaccgtaagtagtttaacttttacacgcctaccaaacgtaaattaacggtaacgtttaacgttagtaccgtttcgttaacccgagtaaccgaaacggtaaaacccggaacggaaccgtacttacccggtaccgcgtaacctaccgttcgtaccttacgtttaacgttttacggtacggggttacctttacccgggtaacccggggtacccggtcccgggttacccgtacgggaaccttagttacggacgttcggacgtacggggtacccggttcgaaggggtaaccgtntttaccgtttccctacgttcccggttaaccaaccgtacgtacgtacggtaccgtaccgtaccgtcggaccggtaaggtaccggtaagtaggttacggtaggttcggttatttaagtttacgttagtacgtacgaagttaataatttaacttcttacttacccttacgacgtacggttacggtaccggaaccggtaacggtaacggtaacggtaacggaactaacggtaacctgggtacggtaccgttcacgttaccgacttacg

SEQ ID NO: 182562 - DNA, 952 bp, Homo sapiens
  misc_feature: GYAE6OF02HOT6H.22.14.B03.1.454.CMB.1.raw
  modified_base (123)..(123): a, c, t, g, unknown or other
  misc_feature (123)..(123): n is a, c, g, or t
  modified_base (443)..(443): a, c, t, g, unknown or other
  misc_feature (443)..(443): n is a, c, g, or t
tcagacatacgcgtcacgaccggtgctcgatttagtgtgagtagttccgcgggggagctacaacaggcaggcaggggcagcaagatggtgttgcagaccaggtcttcatttctctgttgctcnggtatctcgtggtcgccgtacggggactagttggttagacgtcggacccctaaggtccttcccgacggtaacccttcccccgttgggtccgttggttcggttcctcgggttacggggcggtaacggggaccgggtacccaaccctacgttaccaaacgttgtaccggaaaacggttcccgaagacccgtaagtacgtttttacgttttttaaccgacgttacctcctaaacgttaaacgttaaggtacgtttaacgttaacgtcgttttacggtaccgttagaccaacgtaaccgaacggtactacggttcctaccggtnaccgttacgtctacccgttcgttaacttttacgggttaccgggcggttacccgttaacccgggtaaccggttcccgggggttaacccctacgggttaccccggaacgtttccggtaacgggtcggtaccgggtaacgggttccggggtacggttacgggtaaccgtaacgtttacgtttacccgtaaccgtttccgtaaccgttaaccgtacgttaacgaaccgtaccgtacggtaccgttcgaacggtacggtactaccgggtagtacgtcggttacgggtacttttacgtttacgttaacggttcggttaccgtacgttaacccgttaaggttttaaccttacgttaccgttaacccgttttacggtacccgttaaccggtaacccggttttaccgggaccgggtaaaaccgggtacggtaacgggttaaacccgtaagttaaaccggttaaacgtacggttaaccgggtaacgtacccggttaaccgtccgttaaccggtttaccg

SEQ ID NO: 182563 - DNA, 783 bp, Homo sapiens
  misc_feature: GYAE6OF02IELUI.22.14.B03.1.454.CMB.1.raw
  modified_base (162)..(162): a, c, t, g, unknown or other
  misc_feature (162)..(162): n is a, c, g, or t
tcagacatacgcgtcacgaccggtgctcgatttagtgtgagtagttccgcgggggagctacaacaggcaggcagggcagcaagatggtgttgcacgaccaggtcttctatttctctgttgctcgtaggactctcgtggtcgaccggtacgggatagttggtnactcggacctacgtccgtccacgtcctccgtgcgttggtcgtcgtcggtaggcggaacgggccggacctacctacgtacgaacgtcgacgtaacctcgtaacaccgtaaggttaacttttacttttacgacgtaccctaccgtaaaacctaaagtaacgttacgttttaacgttacgttcgttaccggtactaacgaacggaaacgaaacggtacggtaccttaacgtcccgtactcgtactagtccgtataccttacggttcggtcggtaccgtaccgtaaccggtaccggtccggtcccgtactacggttctgtacgtacgcgcgggtcgtcgggtagtacctaggttcctactacctaccgtactaccacgtactaccggacggtacggttccgaaggtaccggtaacgtcggttaaacgaagggttaacgtaggttcgttacggtttaagtttactaggttactacgttacgtaactaaagttcctttaacttccgttaacctcgtaccgtaacggttcgaacccggggtacggtaaccggtacgttaaagggtaacggttaaaccgtaacgtaaccggtacgttacggtacggaaccgtacgtaccgtaccgttcg

SEQ ID NO: 182564 - DNA, 881 bp, Homo sapiens
  misc_feature: GYAE6OF02H3ZRB.22.14.B03.1.454.CMB.1.raw
  modified_base (866)..(866): a, c, t, g, unknown or other
  misc_feature (866)..(866): n is a, c, g, or t
tcagacatacgcgtcacgaccggtgctcgatttagtgtgagtagttccgcgggggagctacaacaggcaggcagggcagcaagatggtgttgcagacccaggtcttcactttctctgttgctctggatctctggtcgccgtacggggactattgtgatcgacccagtcctccagactcctggtctgtgtcgtgtcggcgagacgggacccacactacctaacgtcgaccgtaacgtccacggtaccgtacggtaacgttttaacttttttaaccgagtacccttaccaaacctaaacgtaagtacgtttaacttaacggttactttcggttacccgacgtaaccgtaaacggaaaccgaacgggtaacctaacgtacccggttccgttacggtacccgtaaccgtcggtacctttaaccttacggtttttaaccggtcggggttaccccgttaccggttaaacccccggggttacggtacccccgggggttaccctaaccggttaacccgttacggttttacccgaagggttccggtaccgtacggggtacccgggttacgggtacggggtaaccttagggttaccttttacccggtacctttacccgtcctaaccgtaaccgttaccgaacggtacctaccggtacccgtacgacccgtaagggtaccctaaggtaacgtacggtttcgtaacggtactttaaacgtttaatttcccgttggtaacgtaacgtacgttaacttttaacgttaccgttaccttcccgtacgttaccgtacgggttaccgtacccggacggtaaacgggtccgaaagggttaacttaaccgaaccgtaaaccggcgttacggactaccgggttaacnccggttaacgtaccg

SEQ ID NO: 182565 - DNA, 669 bp, Homo sapiens
  misc_feature: GYAE6OF02FTANE.22.14.B03.1.454.CMB.1.raw
  modified_base (317)..(317): a, c, t, g, unknown or other
  misc_feature (317)..(317): n is a, c, g, or t
  modified_base (336)..(336): a, c, t, g, unknown or other
  misc_feature (336)..(336): n is a, c, g, or t
  modified_base (381)..(381): a, c, t, g, unknown or other
  misc_feature (381)..(381): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtgatgaccagtctccagactccgtggtctgtgtctcgtgggcgagagggccaccatacgaactgcaacgtccagtccagtagttatttttaacacgtcctccaactaataacgtattaactacgtcttaggttaccagacaagaaaccacggactactcgtcctncgactgctactagttacgngggtcctactccgtagtaacgtccgggtcctgaccgtattcgagnggacgtaggtcggtcgtagggacctaggtacgttacctacgtctaccgtaaccaccgttagaccgggttaacccacgggtaccctcggacggtacgggtcttaaacggggaattacgggtcggttaacgaccgtttaaggtttttaacctgttttaccggactacgtaacgtaaattaacgtttacttaacttcctacctagtacggtaccgggttaaccgacggaaaccgggttactaacgggtactaacgtaacccgaaggtacttaggcggactacgtcaaaccg

SEQ ID NO: 182566 - DNA, 657 bp, Homo sapiens
  misc_feature: GYAE6OF02JP25U.22.14.B03.1.454.CMB.1.raw
  modified_base (132)..(132): a, c, t, g, unknown or other
  misc_feature (132)..(132): n is a, c, g, or t
  modified_base (518)..(518): a, c, t, g, unknown or other
  misc_feature (518)..(518): n is a, c, g, or t
  modified_base (595)..(595): a, c, t, g, unknown or other
  misc_feature (595)..(595): n is a, c, g, or t
  modified_base (629)..(629): a, c, t, g, unknown or other
  misc_feature (629)..(629): n is a, c, g, or t
  modified_base (642)..(642): a, c, t, g, unknown or other
  misc_feature (642)..(642): n is a, c, g, or t
tcagacatacgcgtcacgaccggtgctcgatttagtgtgagtagttccgcgggggagcgtacaacaggcaggcaggggcagcaagatggtgttgcagacccaggtctcatttctctgttgctctcggatctntggtgccgtacgggacacttgtgatgaccagtctcctagactccgcggtactgtcgtcgtcgtggcgtagacggaccacctagtcaacgtcgacaacgtcccgacgccgaggtacgttaacgtttttacaggtccttaccgaaccgtaaagtaacggttaaccgttacgtttaacgtaccgtttaccggtttacctaacggccgtaaaacgtaaacccccgagggtaaccccaacggtaccgtttaccgacgtacccgaaccttccggtacttaccggtaactttaccggttcggccccgtttaccgtaaccggtaccggtccggtaccgtacgaccgtatcgtacgtcgagtcgcgtcgaggtcacggtttacgctcacgctacncagaccatccgcgtacgacgtctagacggtatggcgactgtttaactcgtactgagtcagttactaccttgttaccncggctacgtcgacgtacgaaggcttaagcgtaancctaagcgttagnttacgcttacgagtc

SEQ ID NO: 182567 - DNA, 695 bp, Homo sapiens
  misc_feature: GYAE6OF02GV549.22.14.B03.1.454.CMB.1.raw
tcagacatacgcgtcacgaccggtgctcgatttagtgtgagtagttccgcgtggggacgctacgaacaggccaggccaggggcagcgaagactggtgttcgtcagacccaggtcttcatttctctgttggctcgtcggatctcgtggtgccgttacggggactagttgtgatccgaccagtctccagacctcccgtggactgtgtccgtcgtgggcgaggacggtccaccagtcaacgtcgactacgtccacgccagtactttacttttacacgtcctaccaaccaagtaacgacgtctaacgtacgtcgttacggtctaggcaacgaaccaggtacacgttacctccgtactacctcggtactacgtattacggccggtctacccggtaccggtacccgtccggtcctcggacctcgtacgacgtcgacgtcggtcggtgacgtcgagttacctacgacttcgaccctagtacgtcgacgacgtacgtcacggtacgaccggtcgtaagtacccgtaaggttgggtaccctaagtttaaccggttttacctacggtaacggtaccgtaaccgttataaccgtttagtaacctttcgtaccctgaaccgttcgtcggttaccgaccggtaagtaccggtaggtaacccgtacgtttaaccgacggttacgtccggtcaaccggtatacgtacccg

SEQ ID NO: 182568 - DNA, 705 bp, Homo sapiens
  misc_feature: GYAE6OF02IGRWJ.22.14.B03.1.454.CMB.1.raw
  modified_base (154)..(154): a, c, t, g, unknown or other
  misc_feature (154)..(154): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctgtatctctggtgccgtacgggacattgtgntcgacccagtctaccacgactccctggcgtgtgtctcgtcggcgagacggccaccatacaacgtcacgtaacgtcacgccagtacgtttatttttacgacgtcctaccaacctaagtaacgttacgtttaacttacgtcgtttacggtccgagtacgtaacgaaaccgagactaacgtccgttactcgcgtactcgtcctacttactttacgtgggtaccgttcggtaaccccggtacggttccgggtaccctacggaccgttacgttcgagggtcgcgacgggtcggtacgtacgggtactacgtacgtttccacttccgtactacctctactacggcaccgtacgtcgacgacggtacgacgaaagttcgtagtcggttacgtttaaagttacgtttatccggtaattaacgtaacgttactttaagttaccttttcgttacctccggttagtaccggttacggttaccggtaaccggtaacggtaaccgtaaggtaacggtaaactaacgtaacgttggtaacgtcgtacgtactcccgaagtttccg

SEQ ID NO: 182569 - DNA, 710 bp, Homo sapiens
  misc_feature: GYAE6OF02FOSCO.22.14.B03.1.454.CMB.1.raw
  modified_base (194)..(194): a, c, t, g, unknown or other
  misc_feature (194)..(194): n is a, c, g, or t
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgaccagtctccagactccctggctgtgtctctggcgagnggccaccatcaactgcaagtccagccagtagttattttttacacgcctaccacctaagtaagaagttaacttagtactttcgggttccaaggcctaagaaacccaggtaacacgtccgtccgtcgctactgcctctaatttcgtgggtccgtccgtaacccgggtaaccgttcccggggtccctcggaccgtattccgaggtcggtacgacgggtcggtgtacgggtaacgtacggtagtttccaccttctaccaccctaacttaccgaacggtcgtacgtaccgtcggaccgtaggtaccgtagaacgtggttacggtacggttaccttaagttttaactttagtttacgttacgtaacgtaccttaaagttaactttaactttacctttaccgacctttacgtaacggtttacccggttaccggacccgtaaacggggtaaccgtaacgggtaacggtaaacgtaaccgtaaaccggtacgtacggttacggtacgtacgtacctaaccgtacg

SEQ ID NO: 182570 - DNA, 754 bp, Homo sapiens
  misc_feature: GYAE6OF02HSLJA.22.14.B03.1.454.CMB.1.raw
  modified_base (162)..(162): a, c, t, g, unknown or other
  misc_feature (162)..(162): n is a, c, g, or t
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (214)..(214): a, c, t, g, unknown or other
  misc_feature (214)..(214): n is a, c, g, or t
  modified_base (234)..(234): a, c, t, g, unknown or other
  misc_feature (234)..(234): n is a, c, g, or t
tcagacatacgcgtcacgaccggtgctcgatttagtgtgagtagtccgcgggggagctacaacagcaggcaggggcagcaagatggtgttgcacgacccaggtcttcatttctctgttgctctggatctctggtgcctacggggacattgtagatcgacccnggtcctaccagacctcccgnggtctgtgtcngtgggngagagggtccaaccntcaactgacaacgtccgaanccgaagaagttttattttacgagtccacctaaccaagtaactaggttaaactcgtccttttaggacccgagagaacgaaaccgaacgggactacgtaccttcctacggaccttaagtcctatacttacgttacggtcggccgttaaccgccgggtaacttcccggggacctacgtaccgtacttacgcggtggttacggcggcggtaccggttaggtaaccggtagtaacttttaccctaccgggtaccttaccaacctacgttaccgaacggccgtaacgcccgttagccggaaggtacgttagaagtacggtggaacgggtccgtttaagttaaccgtttactagttaaccgacgttactaaagttttaattaacccgtttagttaccccgttacccgtataaccgggtcggttaacccggggttaaccaaccggggtaaccggtaaacggttacgggtaaacctaacgggaaaagttacccggtattagggtcccggtacgttacgaccccgtttaa

SEQ ID NO: 182571 - DNA, 848 bp, Homo sapiens
  misc_feature: GYAE6OF02I0SPU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctgatctctggtgccgtacgggacattgtagatgacccagttctccacgacctcctggctgtgtctcgtgggcgagacgggccacatacaactgacaagtaccacgaccaaggtaagtttaactttttttaacgacgtaccttacctaaccctaaaattaaaggtaacgttttaaaccttaggttaccgtttacgggttaccaagaacgtaaacggaaaaccgaaggtaaactacgttaccgttacccgtcggaccgtaaccgttcggccttacgtaacgttttaccggttacggggtcccggttaccggtaaccccggggtaacggtttccccgggggtcctaacggacccgtaacttacgtacggtacggccgtaacggtcggggttacgtaggggaaccgtaaggttacttttaccgaccgtttacctaaccgtaacctaactaccgtaacgactaaccgtccgttacgaccgtaacgggtacgtaggaaagtacggttaggtacggtacgttaaacgttttatttaacgtttcggtaaccgtagtaaaccttaatttaaacgtttaacttaaccgtttccctaccgtacgtaacggttaaccttaccgggaacccggtaaacgggtaacccggtaaaggttaaacggtaaaacgtaacccggttaaaacccggaacgtttacgggttacggaacccggttacgtacccgtaaccgttaaccg

SEQ ID NO: 182572 - DNA, 858 bp, Homo sapiens
  misc_feature: GYAE6OF02HUJQ1.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatcgacccagtctccagacctccctggctgtgtctcgtgggcgaggacgggccaccatacaactgcaacgtccacgccagtagtttactttttacagtcctaccaaccaagtaagtagtttaacttagtcgtttggttaccagactaacgaaaccaggactatccgtcctgctactcgctctatttacgtcgggtctaccgtaccgggtaacgtcccggggtccctaggtaccgtacgttccgaggtcggaccgacggtccgggtacgtacgggaccgtagttacgtttcccgaccgttccgtaccgtaaccgtactaccggtaacggtccccaacggtcccttacgggacggtaacgggtaccgttaacggaaacggttagggttccgggtacgggtttaacgtttaaacgggtttttaacgtttacggtttaccgggttaaccgtaacgggttaaccttaaaagttttaacttttaaccgtttttaacccgttcccccgtttaccgttaaaccgggtaacccgggtttaaccccgggtttacccggggaacccccggggtaaaacggggttaaaccccggttaaacggggggtttaaaccggtaaaacctttaaaccccgggtaaaaacccggttaacgggttttccgggggtaacccggttacccggtttaaaccggacccccgttaaacccgttaacccgg

SEQ ID NO: 182573 - DNA, 778 bp, Homo sapiens
  misc_feature: GYAE6OF02HM6BU.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgccgtacggggacattgtagatcgacccgagtctaccgagacctccgtggctgtcgtctcgtggacgagacggccacatacaactcgacaacgtcacgaccgagtaacgtttactttttacgcgtcctaccgtaaaccgtaaagttaacgtaacgtttaacgttaacgtccgttttacggttacccaagtaacgaaaccggtaaaccgacggtaaccgtactacccggttcgtacggacctacgtctactaccgttacgttacgtccgggtaccgtaccggtaacccgggtaccgttcccgggtacctacggaccgttatcgtaaggtcgacgtacggtacggtcgtacgggtaactagttacctttcgtaccgttacctccaaccgtactacgacgtacgtacgtccgtcgagtaacggcttaaggaacgttcgtacggtacgttagttaagttttacgtacgtttaccggaacgttaaacgacgtttaaattacggttaacttccgttttacccgtacgttaccgtaacgggttccggttaccggaacccggtttaacggtaaccggtaacgttaaaccggtaaacgtaacccgttaaaggtacggttcggtaccgttacggtacacccgtactttaccgg

SEQ ID NO: 182574 - DNA, 764 bp, Homo sapiens
  misc_feature: GYAE6OF02FLVXM.22.14.B03.1.454.CMB.1.raw
  modified_base (173)..(173): a, c, t, g, unknown or other
  misc_feature (173)..(173): n is a, c, g, or t
tcagacatacgcgtcacgaccggtgctcgatttagtgtgagtagttccgcgggggagctacaacaggcaggcaggggcagccaagatggtgttgcagacccaggtcttcatttctctgttgctctggatctcgtggtgccgtacgggacattggtgacgtcgacccgagtccnccgacgacctcccgtggctggtcgtcgtcgtcgggacggaggacgggcccgacctaatcgactagactaacgtccacgtccaagtactttactttttacgagtcctaccaaccgtaaataaacgatttaactagtcttaggttacacgactaacgaaaccgcggactaagtccgtaccgttacgcctaactccgtcgtacgttacgtttacgtacgggtcgtacccgttacccgggggaacttcccggggtacctgtaacccgtattacgcggtacgaccgtaggaccgggttcgacggaaccgtcgttaaagttccgtaccgtacctccgtaccgagtaccgtagaccgacggtccttaggacctggggtacctaaaggtaacgtcggtacgggttaaccgtacgttttaagggtttacttacggttagttaccgtaaggtaaccttaactaggtttaaccctttaacgttacccttccggtaagttaacccgtcgtacccgggtaacgtaacggggaacccttaaagggtaccgtaaaacttaaccgggaaccgttacggacggtacgtagttacccgagtaccgtacg

SEQ ID NO: 182575 - DNA, 742 bp, Homo sapiens
  misc_feature: GYAE6OF02FN8L7.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacctagtctccagactcctggctgtcgtctcgtgggcgaggacgggtccaaccgtatacaacgtgacctaacgtccagaccgagtaagttactttttacgacgtctaccaactaaataagtacgttaacttaacggtctttcgggttaccagacctaaacggaaaacctaggaacctaacgttccggtaccttacggaccctaacgtccggtaccttacttaacgttttacggtaggggtccgttacccggttaacccccggggtaacgttccccgggggttaccccgttacggaccgttaacgttccgaaggtacggtaccgaagggtcggggttacgtacggggagtaacgttacttacacgttcctacacctacgtcgtacggccagtccgtgtaacgacggtcctaggaaagttacgtacgggtcgtacgttaagttttaactttagttactacgtacgaacgttaattaactttacgttacttcccttacctacgtacgtaccgttacgaacggtaacggtaccgtaaggtacggaaacttaccgaaacgtacgtagtaccggtactcggtaccacgtacg

SEQ ID NO: 182576 - DNA, 660 bp, Homo sapiens
  misc_feature: GYAE6OF02JRT7I.22.14.B03.1.454.CMB.1.raw
  modified_base (126)..(126): a, c, t, g, unknown or other
  misc_feature (126)..(126): n is a, c, g, or t
  modified_base (444)..(444): a, c, t, g, unknown or other
  misc_feature (444)..(444): n is a, c, g, or t
  modified_base (460)..(460): a, c, t, g, unknown or other
  misc_feature (460)..(460): n is a, c, g, or t
  modified_base (489)..(489): a, c, t, g, unknown or other
  misc_feature (489)..(489): n is a, c, g, or t
tcagacatacgcgtcacgaccggtgctcgatttagtgtgagtagttccgcgggggagctacaacaggcaggcaggggcagcaagatggtgttgcagaccaggtcttcattctctgttgctctggtntctcgtggtgccgtacggggactagttggtgtagtacgacccgagtcctccgagtaccctccgtgggcctggttcgtctcggtggacgaggacggccacatacaactgaccgaacgtcctagacccgagtactttacgtttttacgagcctacctaaccgtaagtaacgttaacgtttacccttaaggttaccgtttcggtacccgtagaacccgaaccggaaaaccgagggtacctacggtccggttccacgccgtaactcgtacgttctaactttacgggtcggtaccgtacggaccggtacggccggggttaccngaccgtatgtaacggngcggtcgacggtacgtggggaataccgtntacgacctacggactcgatccacgtaccgtgcgagacggtcgattaggaacgtgtcgttagaccggttattggtactcggtactacgctagtacttctacgcctatcgtgtacccggtgaacgacggtcgtaacgtgaaacctcgtaaagctggtacgtcagaccttagtc

SEQ ID NO: 182577 - DNA, 772 bp, Homo sapiens
  misc_feature: GYAE6OF02HBEK8.22.14.B03.1.454.CMB.1.raw
  modified_base (177)..(177): a, c, t, g, unknown or other
  misc_feature (177)..(177): n is a, c, g, or t
  modified_base (198)..(198): a, c, t, g, unknown or other
  misc_feature (198)..(198): n is a, c, g, or t
  modified_base (459)..(459): a, c, t, g, unknown or other
  misc_feature (459)..(459): n is a, c, g, or t
tcagacatacgcgtcacgaccggtgctcgatttagtgtgagtagttccgcgggggagctacaacaggcaggcaggggcagcaagatggtgttgcagacccaggtcttcatttactctgttgctctggatctctggtgcctacggggacattgtgatgacccagtctccagactcccnggctgtgtctcgtggcgaggngggccaccatcgaactgacaacgtccgacgccagtagttatttttacacgctaccaaccaataagagttacttagtcttggttccagtcaagaaacccgaggacagtccgtacctcgccgtacgtcgccttcgtaagtttcggtcgggtccgtaccgtacccggggtacggtcccggggtaccctcggaaccgtattcgacggttggacgagggtccgggtacgtacgggacgtagtaacgttcgaccgtcctacaccgtnttaccgaaggtcctaacgcccgttggaccggttacggacgttagggaaagttcggttcggttcggggtaatttacgggttttttttaacacgttttagtccgtaaacggtaacctttaagtttaactttacgtttaacctttccccggtttaccggtaacgtttaccggggttaccggtttaaccccgggaaccgggtaacccgggggttaaaaccgtttaaggggaaaccgttaaacgttaacccccgaaaaggggttacccgtttcggggtaggtaccccggttacgaaaccccggttcctttaacccggg

SEQ ID NO: 182578 - DNA, 922 bp, Homo sapiens
  misc_feature: GYAE6OF02GEO4E.22.14.B03.1.454.CMB.1.raw
tcagacatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactcctggctgtgtctcgtgggcgagcgggccaccatcaactgacaagtccagccagtagttacttttttacgacgtcctacccaaccaaattaacgtacgtttaacttacggtactttcgggtttcccaagacctaacgaaaacccgtagggaacctaacgttccgtaccgtcgaccgtaaccttcggtaccttacctaagtttttaaccggtccgggtaccgtttacccgggtaacccccggggtaaccggttccccgggggttaccccgttacgggtaaccccgttagtttaccggtaagggttcggggaccgtacgggtccggggttaccggtacggggtaaccgtacgttaccggttttacctaccgttacccaccgttaaccccgtacgtttaccggaggttaacccacgggtaccccgtttacggaaccggtacgggttccggtaaaggttaacggtaaccggtttagggttacccggttaaacccgggttttagtttttaaaccttttaggtttacccggttaacgtaaccggtttaacctttaaaggtttttaaacgtttactttaacccgtttaccctttcccggttaacttaacccggggttcgggtttaaaccccgggttaccgggaaaccgggggtttaacccgaaaaccggggtttcgggtaaaaacccttaaccgggtaaaacccggttaccgtttagggtaccggttacctaaccgggtacccttaacggttacccg

SEQ ID NO: 182579 - DNA, 613 bp, Homo sapiens
  misc_feature: GYAE6OF01DIA5B.24.75.G09.1.454.CMB.1.raw
  modified_base (235)..(235): a, c, t, g, unknown or other
  misc_feature (235)..(235): n is a, c, g, or t
tcagactactatgtcacgaccggtgctcgatttagtatagacatcagggggtcggagacccaggtcgaggacacagcagtggacatgagggtcccgctcgagctcctgggctcctgctgctctggctcccgaggtgccaaatgtggacatccagatcgacccagtctccttccaccctgtctgcagtctgtaggagacagagtcaccatcacttgccggccagtcagagtgttcngcctgggtggcctggtatcagcagaaaccaggaaacgccctaaatcctcgatctaataaggtcgtctattttacaaagtgggtacccttcgaacggttcaggtcgcagtggatcgtgggacagaattcgactctcacaatcacgtcagacctgcagccgtgatggtattttggactaacgtttattaccgtgacctaactacgtatgtatacgtctttaacgttcccgtaaccgtttccgggacccgtaacgggggtacctaaccggtacgttagggaaccttagtttaaaccgtaccggtaaacggttcggttacgggtaccgttacggaacccgtacccgtaacgtttcccttacgggttcctttccgtaaacccg

SEQ ID NO: 182580 - DNA, 490 bp, Homo sapiens
  misc_feature: GYAE6OF01CZF8L.24.75.G09.1.454.CMB.1.raw
  modified_base (318)..(318): a, c, t, g, unknown or other
  misc_feature (318)..(318): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaaagtggggtcccttnaaggttcagcggcagtggatctgggacagaattcactctcacaatcagcagcctgcagcctgatgattttgctaacttattactgccaacagtatgatgcttatccctaccttcggccgaggggacacgactggactattaatcgaatgtggctgcaccatctgtcttctac

SEQ ID NO: 182581 - DNA, 565 bp, Homo sapiens
  misc_feature: GYAE6OF01CTUYX.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtgttctgcctgggtggcctggtatcagcagaaaccagggaaagcccctaaattcctgatctataaggctctattttacaaagtgggtccttcaaggttcagcggcagtggatcgtgggacagaattcactctcacaatcagcagcctgcagctgatgaatttgactaactttatactgacctaactagtatagattcgtactttacgtcccctaaccgttccgggacctaacgggggacctaaccggaacttacgggaaacctaagtttaaaacgtccggtaaagttcggtacgggccgttaggaccctaacccgtattacccgttcgttccctttcgtaaccc

SEQ ID NO: 182582 - DNA, 526 bp, Homo sapiens
  misc_feature: GYAE6OF01B30G9.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaatcctgatctataggcgtctatttacaagtgggtccttgaggttcagcggcagtgatcgtgggacagaattcactctacacaatcagcagcctgcagcctgatgtatttgactaacttattactgaccaacagtatagtatgtcttatcccctaccgttccggaccgtaggggaccacggtacgtacgggactaagttaacgtacgtaacgttggtcggacttcgacctaacccattacttcgttcttcgtac

SEQ ID NO: 182583 - DNA, 741 bp, Homo sapiens
  misc_feature: GYAE6OF01B2J4R.24.75.G09.1.454.CMB.1.raw
  modified_base (285)..(285): a, c, t, g, unknown or other
  misc_feature (285)..(285): n is a, c, g, or t
  modified_base (372)..(372): a, c, t, g, unknown or other
  misc_feature (372)..(372): n is a, c, g, or t
tcagactactatgtcacgaccggtgctcgatttagtatagacatcaggggggtcagacccagtcaggacacagcatggacatgagggtccccgctcagctcctggggctcctgctgctctggctcccaggtgccaaattgtgacatcctagatgacccagtctccttccaccctgtctgcatctggtagggagacaggacgtcaccagtctacttggccgggccagtcagtagttcgtttctggccgtgggtcggcctggtatcagcaaggaaaccagggaaacncccctaaattcctaggactctaagtaacggcctacgttaattttaacgaaaggttcggggtaccctttagaagggttcaggtcggtntacggtgagtcgtaggggaactagtaattcgactctacaactatacgagcacgcctgcacgcctagattagtattttacgacttaaactttatttaacctacggtaccctaaactaacggttaatacggtaacgtttacggtaccttttaaccgtacccccgttaacccggttttacccggggaacccggtaacggggggtaaaccctaacccgggttaacgttaacgggtaaaccgtttaaacgtttaaaaccgggtacccggtaaacggtttagggttaccggggtaacccgttacgggtaccccgtaaacccggttaagttttcccgggtttaaccggttaccgtttttcccggttaaacccccgg

SEQ ID NO: 182584 - DNA, 787 bp, Homo sapiens
  misc_feature: GYAE6OF01C6LUY.24.75.G09.1.454.CMB.1.raw
  modified_base (230)..(230): a, c, t, g, unknown or other
  misc_feature (230)..(230): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttgccgggccagtcagtagtgttcngccgtgggtggcctggtatcgagacaagaaaccaagggaaacgacccctaaattccgtgtaatactaagtaacggcgttacttaattttaacgaaacggttcggggttacccctttacgaaacggggtttccaagggcccgggtacgtaaggttgggtattaccgttaggggggaacctaaggtaaaactttccgaaccttacgttacccaaacgaaaacttccgaaaggccaacgggtccccttgggaccaacgggtcccctagggaatttcggttaattttttagggaacctttaaaaccttttaacttttaacccgttacggaaacccctaaacgttaacggttaataacgggttaaattcggttaaccttttaaccttaaccccccgttaacccgggttttacccggggaccccgaaacggggggggttaaccctaaccgggtaaacccgttagggtaaacccttaaagtttaaacggtacccggtaaacggttggtaccgggtacgttaccggacctacccgtaattccgtttcgtcctttacgttaacccg

SEQ ID NO: 182585 - DNA, 535 bp, Homo sapiens
  misc_feature: GYAE6OF01DRFJI.24.75.G09.1.454.CMB.1.raw
  modified_base (529)..(529): a, c, t, g, unknown or other
  misc_feature (529)..(529): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaatgtggacagtccaggatgacccagtctccttccaccctgtctgcatctgtaggagacagagtcaccatcacttgccgggccagtcagagtgtttctgccgtgggtggcctggtatcagcagaaaccagggaaagcccctaaattcctgatctataaggcgtctattttacaaagtggggtacccttcaaggttcagtcggcagtggatcgtagggacagaattcactctcacaatcagcagcctgcagctgatgtattttgactaacttattaactgacctaactagtatgattgacctttactcccctacttccgggaccgtaggggacaacggacgtaggaactaacttaagtaccgtaactggtcggactgactaccgtatcctgtccttntacccg

SEQ ID NO: 182586 - DNA, 571 bp, Homo sapiens
  misc_feature: GYAE6OF01BAKRL.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaacgcccctaaatcctgatctataggctctatttacaagtcgggtcccttgaaggttcagcggcaggtggatcgtgggacagaattcactctacacaatcagcagcctgcagcctgatgtatttgactaactttattactgaccaatagttatagtattcgtacctttactaccccgtaccgtttccgggaccgaacgggggtaccaaccggtacgtacgggaacctaagtttaacgtaccggtaaacgttggttacggccttacggaccctaaccctacgttcccttacggttcccttccgtacccg

SEQ ID NO: 182587 - DNA, 508 bp, Homo sapiens
  misc_feature: GYAE6OF01BW2UA.24.75.G09.1.454.CMB.1.raw
  modified_base (316)..(316): a, c, t, g, unknown or other
  misc_feature (316)..(316): n is a, c, g, or t
  modified_base (501)..(501): a, c, t, g, unknown or other
  misc_feature (501)..(501): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtgcctggtatcaagcagaaaccagggaaacgcccctaaattcctgatctataaggcgtctattttacaagtgggtccttnaaggttcagcggcagtggatcgtgggacagaattcactctcacaatcagcagcctgcagcctgatgtattttgactaactttattactgtaccaactagtatgtatcgtcttactccctaccgttcggccgacggggacacggtactaggactagttaacgtcgtaactggtgctgctacatctntctctac

SEQ ID NO: 182588 - DNA, 491 bp, Homo sapiens
  misc_feature: GYAE6OF01D5A6Q.24.75.G09.1.454.CMB.1.raw
  modified_base (267)..(267): a, c, t, g, unknown or other
  misc_feature (267)..(267): n is a, c, g, or t
  modified_base (459)..(459): a, c, t, g, unknown or other
  misc_feature (459)..(459): n is a, c, g, or t
  modified_base (487)..(487): a, c, t, g, unknown or other
  misc_feature (487)..(487): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgccgtgggtggcctggtatcagcagaaaccagggaaancccctaaattcctgatctataaggcgtctattttacaaagtgggtcccttcaaggttcagcggcagtggatctgggacagaattcactctcacaatcagcagcctgcagcctgatgattttgactaacttattactgaccaacagtatgatgcttatcccacttcggccaggggacacgactggacattaancgtaatgtcggctgccacatctgtcttntacc

SEQ ID NO: 182589 - DNA, 511 bp, Homo sapiens
  misc_feature: GYAE6OF01EEAMA.24.75.G09.1.454.CMB.1.raw
  modified_base (325)..(325): a, c, t, g, unknown or other
  misc_feature (325)..(325): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacgaaagtgggtcccttcaggttcngcggcagtggatcgtgggacagaattcactctacacaatcagcagcctgcagcctgatgtatttgactaacttattactgaccaacagttatgatgtacttactcccctaccttcggccgagggaccacggactggacaagttaactcgtaattggtggctagccacgtattctgttccttctacc

SEQ ID NO: 182590 - DNA, 526 bp, Homo sapiens
  misc_feature: GYAE6OF01B2TM2.24.75.G09.1.454.CMB.1.raw
  modified_base (423)..(423): a, c, t, g, unknown or other
  misc_feature (423)..(423): n is a, c, g, or t
tcagactactatgtcacgaccggtgctcgatttagtatagacatcagggggtcagacccagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgtgggcaagtgagaccattagcagctctttgagttggcatcaattcaaacgagggaaacgccctaacctcctgatctatactgcgtaccaatttacactagtcggggtccatccaggttcaggtggacaagtggatcgtagggacagacgttcaacgtctacaccatcagcagtctgcaactgaagtactttgactaacgtttactattgtacaanagtagttaactacgttaccccgtctaccgttcgggacggaggaccgaagggtcgaagtagtacgacgaacgaactggacgctgaccactatcttgtcttaccg

SEQ ID NO: 182591 - DNA, 581 bp, Homo sapiens
  misc_feature: GYAE6OF01DIDJ1.24.75.G09.1.454.CMB.1.raw
  modified_base (229)..(229): a, c, t, g, unknown or other
  misc_feature (229)..(229): n is a, c, g, or t
  modified_base (323)..(323): a, c, t, g, unknown or other
  misc_feature (323)..(323): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctgggtggcctggtatcagcaaggaaaccagggaaacgcccctaaattcctgatctataaggcgtctattttacaaaggttcgggtccttanaaggttcagcggcagtggatctaggggacagaattcaactctcacaatcagcagcctgcagcctgatgtatttgactaacttattactgacctaactagtatgattacgtacttacctccccgtaccgttccgggaccgtaacggggaccaaccggtacgttacgggaactaagtttaaacgtaccggtaaacttcgggtcggtaccttacggaccctaacccgtaacttccgtttcgtttacccttcgttaaccccg

SEQ ID NO: 182592 - DNA, 560 bp, Homo sapiens
  misc_feature: GYAE6OF01DVJF9.24.75.G09.1.454.CMB.1.raw
  modified_base (229)..(229): a, c, t, g, unknown or other
  misc_feature (229)..(229): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngccgtgggtggcctggtatcagcaagaaaccgaagggaaacgccccttaaatcctagatctaagtaaggcgttacttaattttaacgaaaggttcggggtaccctttacgtaagggtttcgaggcggcaggtggatcgtggggacagtattcactctacacaatcagcacgcctgcacgctgatgtatttgactaacttattactcgacctaacagttatgtatgtaccttactccccgtacgttccgggaccgagggtaccacggtaccgtggactaattaacgtcgtaagttggtcggcttcgacctactactcttcgttcttctaccg

SEQ ID NO: 182593 - DNA, 545 bp, Homo sapiens
  misc_feature: GYAE6OF01E31CX.24.75.G09.1.454.CMB.1.raw
  modified_base (229)..(229): a, c, t, g, unknown or other
  misc_feature (229)..(229): n is a, c, g, or t
  modified_base (266)..(266): a, c, t, g, unknown or other
  misc_feature (266)..(266): n is a, c, g, or t
  modified_base (415)..(415): a, c, t, g, unknown or other
  misc_feature (415)..(415): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctgggtgcctggtatcagcagaaaccagggaaacncccctaaattcctgatctataaggctcttattttacaaaggttcgggtaccttcgaaggttcaggcggcagtggatcgtgggacagaattcactctcacaatcagcagcctgcacgcctgacttgtattttgactaactttattacgtnaccaatagtatgtattcgtaccttactccccgtaaccgttccggaccgaggggaccacggtactaggactagttaacgtcgtaaacgtggtcgggcctacggacctaccgtatcgttcttcctctacccg

SEQ ID NO: 182594 - DNA, 554 bp, Homo sapiens
  misc_feature: GYAE6OF01DK2H5.24.75.G09.1.454.CMB.1.raw
  modified_base (205)..(205): a, c, t, g, unknown or other
  misc_feature (205)..(205): n is a, c, g, or t
  modified_base (450)..(450): a, c, t, g, unknown or other
  misc_feature (450)..(450): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcccccccanatcacttgccgggccagtcagagtgtttctgccgtgggtgcctggtatcagcaagaaaccgagggaaacgtcccctaaattcctagatctaagtaaggcgtacttaattttaacgaaaggttcggggttacccttacgaagggtttcaggccgggacaggtggatcgtaggggactagtaacttcgactctacactaatcagcagcctgcagctgatgtatttgactaacttatactgacctaanagttatgatgacttactccctacgtcgcgaggacacgtacgtgactaattaacgtcgtaagtggtcggtctacggacctacctattcctggttcctcgtacccg

SEQ ID NO: 182595 - DNA, 497 bp, Homo sapiens
  misc_feature: GYAE6OF01BCOZM.24.75.G09.1.454.CMB.1.raw
  modified_base (296)..(296): a, c, t, g, unknown or other
  misc_feature (296)..(296): n is a, c, g, or t
  modified_base (315)..(315): a, c, t, g, unknown or other
  misc_feature (315)..(315): n is a, c, g, or t
  modified_base (448)..(448): a, c, t, g, unknown or other
  misc_feature (448)..(448): n is a, c, g, or t
  modified_base (468)..(468): a, c, t, g, unknown or other
  misc_feature (468)..(468): n is a, c, g, or t
  modified_base (489)..(489): a, c, t, g, unknown or other
  misc_feature (489)..(489): n is a, c, g, or t
  modified_base (492)..(492): a, c, t, g, unknown or other
  misc_feature (492)..(492): n is a, c, g, or t
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaacgccctaaatcctgatctatagctctatttacaagtgggtcctnagttcagcgcagtgatcgnggacagattcactctcacaatcagcagcctgcagcctgattgtattttcgactaactttattactcgaccaatagtatgatgactttactccctacgttcggaccgagggacctacgactaggactagttaancgaacttggtgctgaccacntctgtcttcacttccttcccnctntaccg

SEQ ID NO: 182596 - DNA, 541 bp, Homo sapiens
  misc_feature: GYAE6OF01BBZBQ.24.75.G09.1.454.CMB.1.raw
  modified_base (231)..(231): a, c, t, g, unknown or other
  misc_feature (231)..(231): n is a, c, g, or t
  modified_base (271)..(271): a, c, t, g, unknown or other
  misc_feature (271)..(271): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
  modified_base (452)..(452): a, c, t, g, unknown or other
  misc_feature (452)..(452): n is a, c, g, or t
  modified_base (524)..(524): a, c, t, g, unknown or other
  misc_feature (524)..(524): n is a, c, g, or t
tcagactactatgtcacgaccggtgctcgatttagtatagacatcgagggggtacagacccagtcaggacacagcatggacatgagggtccccgctcagctcctggggctcctgcttgctctggctcccaggtgccaaatgtgacatccagatgacccagtctccttccaccctgtctgcatctgtaggagacagagtcaccatcacttgccggccagtcagagtgtttcngccgtgggtgccgtggtatcagcaagaaaccagggaaacncccgtaaattccgtgatctagtaaggcgtacttatttacgaaaggttcgggtaccctttagaaggttcaggtcggactagtggatcgtagggacagtaattcgactctacaacaatcagcagcctgacacgctgatgtatttgactaactttntacngaccaatgtactgatgaccttacncccgtaacttcggacgtagggacacgagtggaactagttaacgtcgtaatggtgtcctggacctacgtactnttcgttcttcgtacccg

SEQ ID NO: 182597 - DNA, 501 bp, Homo sapiens
  misc_feature: GYAE6OF01DZPIR.24.75.G09.1.454.CMB.1.raw
  modified_base (266)..(266): a, c, t, g, unknown or other
  misc_feature (266)..(266): n is a, c, g, or t
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaancccctaaattcctgatctataaggcgtntattttacaaagtggggtcccttnaaggttcagcggcagtggatctgggacagaattcactctcacaatcagcagcctgcacgctgattgattttgactacttattactcacaacagtatgatgcttactccctaccttcggaccaggggacacgacgtagactattaactcgaactgtggctgaccactattctagttccttctac

SEQ ID NO: 182598 - DNA, 585 bp, Homo sapiens
  misc_feature: GYAE6OF01AVLEY.24.75.G09.1.454.CMB.1.raw
  modified_base (317)..(317): a, c, t, g, unknown or other
  misc_feature (317)..(317): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaaagtcgggtccttnaaggttcagcggcagtggatctgggacagaattcactctcacaatcagcagcctgcagcctgatgtattttgactaacttattactgaccaactagtatgatgaccttactcccctaccgttccgggacccgtaacgggggaccacggtacctacggggtaaacctaagtttaaacgttaccggtaaacgttcgggttacgggtaccttacgggaccctaaaccccgtacgtttaccctttacggtttcccgtttcccgttaaacccg

SEQ ID NO: 182599 - DNA, 523 bp, Homo sapiens
  misc_feature: GYAE6OF01C3KKS.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagttgtttctgccgtgggtggcctggtatcagcaagaaaccagggaaacgccctaaattcctgatctataaggcgtctaatttacgaaggtcgggtacccttcaaggttcagcggcagtggatcgtgggacagaattcactctcacaatcagcagcctgcagcctgatgtattttgctaacttattactgaccaatagtatgtatgtacttactccctacgttcggaccgaggggacacggtactggactaagttaacgtacgtaactggtcggctcggctaacctattcttcgtcttctacc

SEQ ID NO: 182600 - DNA, 513 bp, Homo sapiens
  misc_feature: GYAE6OF01BB9EE.24.75.G09.1.454.CMB.1.raw
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttgccgggccagtcagagtgtttctgcctgggtgcctggtatcagcagaaaccagggaaagcccctaaattcctagatctataaggcgtcttaattttacaaagttcggggtccttnaaggttcagcggcagtggatcgngggacagaattcactctacacaatcagcagcctgcagcctagatgtattttgactaacttattactcgacctaanagttangtatcgtacttactccctaccgttcggaccgacgggacacgacgtagactattaagtcgtaatggtggctgacacnttctntcttntac

SEQ ID NO: 182601 - DNA, 576 bp, Homo sapiens
  misc_feature: GYAE6OF01BNEYA.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaaagtggggtcccttcaaggttcagcggcaggtggatcgtgggacagaattcactctcacaatcagcagcctgcagcctgatgtattttgactaactttattactgaccaactagtactagatcgtactttactccccgtaccgtttccgggacccgtaagggggaccaacggtaccgttacgggaactaacgtttaacgtaccgtaaacgttgggttacggaccttaggaccctaacccgtacgttccgttacggttccctttccgtaacccg

SEQ ID NO: 182602 - DNA, 524 bp, Homo sapiens
  misc_feature: GYAE6OF01CONFB.24.75.G09.1.454.CMB.1.raw
  modified_base (217)..(217): a, c, t, g, unknown or other
  misc_feature (217)..(217): n is a, c, g, or t
  modified_base (303)..(303): a, c, t, g, unknown or other
  misc_feature (303)..(303): n is a, c, g, or t
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtctccttccaccctgtctgcatctgtaggagacagagtcaccatcacttgccgggccagtcagagtgtttcngcctgggtggcctggtatcagcaagaaaccagggaaacgcccctaaaattcctgatctataaggctctatttacaagtgggtcctnaggttcagcgcagtggatcgtgggacagaattcactctcacatcagcagcctgcagtcctgatgtattttgactaactttattactagtacccaactagtatgacttgtctttactccctaccgttcggaccaggggaccacggactggaactattaacgcgaactggtcggctcgacctacctattcctgttccttctacttcctttccccgctcttacg

SEQ ID NO: 182603 - DNA, 499 bp, Homo sapiens
  misc_feature: GYAE6OF01C944A.24.75.G09.1.454.CMB.1.raw
  modified_base (313)..(313): a, c, t, g, unknown or other
  misc_feature (313)..(313): n is a, c, g, or t
  modified_base (465)..(465): a, c, t, g, unknown or other
  misc_feature (465)..(465): n is a, c, g, or t
  modified_base (494)..(494): a, c, t, g, unknown or other
  misc_feature (494)..(494): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttaccgggcagtcagagtgtttctgcctgggtggcctggtatcagcagaaaccagggaaagcccctaaatcctgatctataaggcgtctatttacaaagtgggtccttnaaggttcagcggcagtggatctgggacagaattcactctacacaatcagcagcctgcagcctgaatgattttgactaacttattactgaccaaacagtaatgatgacttatcccaaccgttcggaccgaggggacacgactaggacattaancgaaactgtggctgcacctatctgtctcnttccc

SEQ ID NO: 182604 - DNA, 862 bp, Homo sapiens
  misc_feature: GYAE6OF01C3AOO.24.75.G09.1.454.CMB.1.raw
tcagactactatgtcacgaccggtgctcgatttagtatagacatcagggggtcagacccagtcaggacacagcatggacatgagggtccccgctcagcctccgtggggctcctgctgctctggctcccaggtgccaaatgtgacatccagatcgacccagtcctcccttccaccctgtctgcatctggtaggagacagagtcaccatccacgttcggccgggccagtcagtagttcgttctggccgtggggtcggtccgtaggtactcgagaccgaaacggaaaaccggaacgggaaaaccgtaccccttaaagttccctaggtacttacttaaagtaacggtcgttactttaaacgttttaacggaaacgggtttccggggttacccctttacgtaacgggtttccaacgggtccggacgtaaggtaggtacgttcgggtaacggggtaacctaaggtaaactttaccaaccgtttacctaacctaaactaaacgttccgaaaccggaccctaccgggtcccgttaggccctaaccggtacccgttaggtaacgtttacggtttaacttttttaccggaacctttaaacgtttttaaccgtttaacccgttaccggaacccttaaacgttaagtttaacgttacgtaacgtttaccgtaccctttttaaccccgtacccccggtttaacccggttaccccggggaacccgggtaaccggggtaccctaaccgggttaaccgttaaccgggtaaaccttaaacgtttaaccggtaaccgggttaaacgtttcgggtccggtacccgttaccggaaccctaacccgttacgtttcccggttactttcccgtttcttaaccccg

SEQ ID NO: 182605 - DNA, 706 bp, Homo sapiens
  misc_feature: GYAE6OF01ET1II.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtcctcccttccaccctgtctgcatctgtaggagacagagtcaccatcacgttcggccggcagtcagtagttgtttctcggccgttggggtcggtccgttaggtactccgaagaccgaaacggaaaacccggaaggggaaaccgtacccccgttaaaggtccctaggtactcgttagtcgtcctcgtacctaccgtttacccgtttaacgtaacgggtccgggtaccctaagtaccgtaacggttacgaggttcggacgtaggtggtacgtcgtaggaccaacgtagttactttccaacctcctaccacctactaccgacgcctacgccgtcgaccgtacgtccgttagtacgttagtttacgtttacgtaactttaaactttacgttacgtaccgtaccctaaacgtagttactacgtacgttacgtacctttacccttaccccgtaccggttacccgggacggtaccgggaccaccggtacgtacggtaattacgttaaaccgtacgtaacggttggtaccgtcgtaaccgtcctaccgtcgttccg

SEQ ID NO: 182606 - DNA, 761 bp, Homo sapiens
  misc_feature: GYAE6OF01C9GP7.24.75.G09.1.454.CMB.1.raw
  modified_base (178)..(178): a, c, t, g, unknown or other
  misc_feature (178)..(178): n is a, c, g, or t
  modified_base (236)..(236): a, c, t, g, unknown or other
  misc_feature (236)..(236): n is a, c, g, or t
  modified_base (404)..(404): a, c, t, g, unknown or other
  misc_feature (404)..(404): n is a, c, g, or t
tcagactactatgtcacgaccggtgctcgatttagtatagacatcagggggtccagacccagtcaggacacagcatggacatgagggtccccgctcagctcctggggctcctgctgctctggctccaggtgccaaatgtgacactccgagactgacccaggtctccttccacctgtcngcatcgtgaggagacagtagtcacatccacgttcggccggcagtcagtacgttgttcncggtccgtgggtggtcccgtggtatcgagacaacggaaaaccgaggggaaaccgtaccccttaaattccccgttagaacttaccgtaagtaacggtcgttactttaacgttttacgtaaaacgggtcggggttaacccctttcgaaacggtttccaacgggccggtanaggttacggtacttacggttcggggaaacttaaaggtaaacttcctaaccttaccttaccaaacggtaaaacttccgaagaccgacggtcccgttaacggcccgtaacgtcccgttaagtacgtttacgtttacgttttacggacctttaacctttaacttacgtaccgaaccctaagtaacggttataggtcttaacgttaccgtttaccgttccccgtaccgggtttacccggacgggtaaccgggaccgtacccgggtaacgtaacggtaccttaaagttaccgtaaccggtagttcgggtacgtcccggtcgtaccctaccttacggttcctttacgttccttacgtttaccc

SEQ ID NO: 182607 - DNA, 715 bp, Homo sapiens
  misc_feature: GYAE6OF01C7QJD.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgaccagtcctccttccaccctgtctgctatctgtaggagacagacgtcaccatcacgttcggccggcagtcagtagttcgttcgtggtccgtggggtcgtccgtggtactcgagacgaacgaaaccgacgggaaaccgtaccccttaaattccgtataacttactaaagtacggtacgttactttaacgtttaacggaaacggttccgggttacccttaacgtaacggttcgacggtccggtagtacggtacggtacgtacgtacgggaacgtaacgtaaacgttccgaacttcctaacactaactcgacgcaacgttcgagtccacgtacgtgtacttgttacgtttacgactttaacgttacttaacgtacggtaacctaagtagttaacgtacgtacgttccgttaaccttacccgtaccccgttaccggttaccgggaacccggtaacgggtacccgaaaccggtttactaaccgggtaaacttaaaccgttaactaaccggaaattgggtacgtccgtacgaccctacgttacgtacctttacgtccttaacgttccccg

SEQ ID NO: 182608 - DNA, 646 bp, Homo sapiens
  misc_feature: GYAE6OF01CB5O2.24.75.G09.1.454.CMB.1.raw
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctcccttccaccctgtctgcatctggtaggagacagagtcaccatcacttcggccgggccagtcagtgttgtttcnggccgtgggtcggccgtggtatcgagcaagaaaccgagggaaacgtaccctaaattccngatctagtaggcgttacttaagttttaacgaaggttcgggttacccttagtaaggttcgaggcggcaggtggatcgtagggacagtaacttcactctacaactatcagacacggtcctgaccgacgtccgtaggatttgttaacttttacgaacctttaacgtttacttaaccgtacgtaaccctaaagtagttactagtaacttcgttaacctttacccgtacccccgtaccggttcccgggaacccggaacggggtaccctaaccgtacggttacggtaaaccttaagtttaaccgtacggtaacgttcggtcggtcctagaccctactcttcttcgttccttccgtaccg

SEQ ID NO: 182609 - DNA, 590 bp, Homo sapiens
  misc_feature: GYAE6OF01AD7N0.24.75.G09.1.454.CMB.1.raw
  modified_base (376)..(376): a, c, t, g, unknown or other
  misc_feature (376)..(376): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcactgccgggccagtcagagtgtttctgccgtgggtcgcctggtatcagcaagaaaccgagggaaacgcccctaaattcctgatctaatacggcgttacttattttaacgaaaggttcggggtacccttacgaaggttcaggcggcaggtggatcgtgggacagtaattcactcncacatcagcagcctgcacgcctgattgtatttgactaactttatactcgaccaagtagtatagtatcgtaccttactaccccgtaccgttaccgggaccgtaacgggggtaccaccggtacgtcgggtaaaccttaagtttaaaccgtacggtaacgttggttcgggtaccgtcgtaacccgtaccttacttccgtttcgttcttccttacccg

SEQ ID NO: 182610 - DNA, 817 bp, Homo sapiens
  misc_feature: GYAE6OF01BEE25.24.75.G09.1.454.CMB.1.raw
tcagactactatgtcacgaccggtgctcgatttagtatagacatcagggggtcagacccagtcaggacacagcataggacatgaggtccccgctcagctcctggggctcctgctgctctggctcccaggtgccaaatgtgacatccagatgacccagtctccttccaccctgtctcgcatctgtacggagacagacgtccaaccgactctacgttcggcccgggccaggtccaagtacgttgtttccgtgcccgttggggtggacccgttggtactcgacgcgaagaaaccgagggaaactaccccgttaaaagttcctacggtaactacgtaacgtaacggtaccggttacctttaagttttaaaccgtaaaacgggttccggggtttaccccgttaacgtaaacggggtttccgaacgggttaccgggaccggtaacgggttaggtaacgtacggttacgggggtaaaacaggtaaacctttaccgaacctttaccttacaaacctaaacgttccgaaacggtccaacgtacccgttggaccgacggtacccgttagtaacgttggttaacgttttacgtaaccttaaacctttaatttaccgtacgtaccctaaagtacggtttaatacgggtattacggtacctttaccgtaccccttaacccgttcggaaccccggtaaggggtacccgaaccggtaaccgtaacgggtaacttaaacccggttaaaggttacggaaaccctttcgggggacgttaccgtaccggtaacctaacccgtactttacgttcccgttaacgtttcctaacccggg

SEQ ID NO: 182611 - DNA, 953 bp, Homo sapiens
  misc_feature: GYAE6OF01DGR42.24.75.G09.1.454.CMB.1.raw
  modified_base (197)..(197): a, c, t, g, unknown or other
  misc_feature (197)..(197): n is a, c, g, or t
tcagactactatgtcacgaccggtgctcgatttagtatagacatcagggggtcagacccagtcaggacacagcatggacatgagggtccctgctcagctcctgggcctcctgctgctctggctctcgaggtgccatatgtgacatccagatcgacccagtcctccactccctccctgtcctgctatcgtggtggganacagacgtcacctatcctcgtcgccgagggcgacgtcgacgggtacttaactttaacttacgttttaaggttaaaagtttcggttaacttacctaaactaaaccgaaaaaccgacgggaaccgtaaaccggggtaaccccttaaaccgtccgttacggtaccgaaacgtagtacgtacctacgtaccgtaacggttccgggaccggacccggacccggggacccctaggtaaccggtaaacggttaccgacggtccggtacgtaaggtacggtacgtcggtaacgggtactttaccgtttaccgttaccctaccctttaccgacctacgtccggaccggtcccggtaccgtcggaccgtacggtccggttagggtacgggttacgtttgggtaacccgtaacgttaaccgttaagttttaacccgttacggttaaccttaaaccgtaaaacgttaaacgtttaacgggtaaccggttaaacgttttaaaccgtttaacggttttaacccggttttaaccgggtttaaaccgggggttttttaccccgggggtaaaacccggggggtaaacccggggggggttaaaaacgggggtttaacgggggttaaacccgggggtaaacccgggttaaaccccggttaaaacgggggtaaaaaaccccgggtttacgggttttaaccggggggtacccgttttaaacccgggtacccgggttaaacccccgttaaaccgggtttccctttttaacccccgggg

SEQ ID NO: 182612 - DNA, 752 bp, Homo sapiens
  misc_feature: GYAE6OF01CPQII.24.75.G09.1.454.CMB.1.raw
  modified_base (242)..(242): a, c, t, g, unknown or other
  misc_feature (242)..(242): n is a, c, g, or t
tcagactactatgtcacgaccggtgctcgatttagtatagacatcagggggtcagacccagtcaggacacagcatggacatgagggtccccgctcagctccgtggggctcctgctgctctggctcccaggtgaccaaatgtgacatccagatcgacccagtcctccttcccaccctgtctgctatcgtgtaggacgacagacgtccacatcacgttcggccgggccagtcagtgttgtttcnggccgtgggtcgccgtggtatcgagacgaaacggaaaccgacgggaaacctaccccttaaattccgtagtaactacgtaagtacggtacttacttaacgttttaacggaaacggtttcggggtacccctttaggaaacggtttcgaacgggtaccggacgtaggtaggtaactacgggtacgggaaacttaaggtaaactttccaaccgtttacctaactaaaccgtaacgtacgaaacggcctaacgtcccgtagaccgtacgtccgtaagttagtttacgtttaacgtttaccgtaacttaacctttaacgttaccgtacgaaacccgttaataagttacgtacgttaagttccgtaacctttacccccgtaccgtacccggttaccgggaacggtaaccgggtaccaaacggttacggtaaccgtacgttaaattaaccggtacgttaacggttcggcgtacccgtacaacccgttactaacttcgtaccgttccttcgttaccccg

SEQ ID NO: 182613 - DNA, 698 bp, Homo sapiens
  misc_feature: GYAE6OF01A23CI.24.75.G09.1.454.CMB.1.raw
  modified_base (263)..(263): a, c, t, g, unknown or other
  misc_feature (263)..(263): n is a, c, g, or t
  modified_base (615)..(615): a, c, t, g, unknown or other
  misc_feature (615)..(615): n is a, c, g, or t
  modified_base (682)..(682): a, c, t, g, unknown or other
  misc_feature (682)..(682): n is a, c, g, or t
tcagactactatgtcacgaccggtgctcgatttagtatagacatcagggggtcgagacccagtcaggacacagcatggacatgagggtccccgctcagctcctggggctcctgctgctctggctcccaggtgccaaatgtgacatccagatcgaccagtctccttccacctgtctagcatcctgtaggagacagagtcaccatcacttcggcccggacagtcaagtgtttcgttcctcgcgtcgggttgccgtggtataccgngacgtaacggaaaccgagggaaacctacccgttaaaattcccgtagtaacttactaaaggtacggtaccgtttacttaacgttttaacgaacgggttaccgggttacccttaaggtaaacggtttccgaacggtccgggtactacgggttacgtaacggttcggttaacgggaactacggtaactttacctacgtacgtaaccctaaggtaacttacccggagtaccgacggttacccaggaccaccggtaccgtgtaacgtttaggtacttttacgacttaacggttttaattccacgtaaccctataagttcattgcttactaacctccgtacgtcggactagggaaccncggtaatacggtaattacgtaacgtcgtaaattcgggagtcctacggaacctaccttaggttacctntttcccgtactacccg

SEQ ID NO: 182614 - DNA, 516 bp, Homo sapiens
  misc_feature: GYAE6OF01D7H3G.24.75.G09.1.454.CMB.1.raw
tcagactactatgtcacgaccggtgctcgatttagtatagacatcagggggtcagacccagtcaggacacagcatggacatgagggtccccgctcagctcctgggggctcctgctgctctggctcccaggtgccaaatgtgacatccagatgacccagtctccttccaccctgtctgcatctgtaggagacagagtcaccatcacttgccgggccagtcagagttgtttctgccgtgggtggcctggtatcagcagaaaccagggaacgcccctaaatcctgatctataaggcgtctatttacgaagtcgggtccttcgaagttcagcgcgagtggatcgtgggacagattcactctcacatcagcagcctgcagcctgattgtattttcgacttaacttattactgtaccctaatagtatgattcgtaccttactcccctaccgttccggaccgagggacacgactggactaattacgtcgactggtcgctgacctactatcttcgtcttctacc

SEQ ID NO: 182615 - DNA, 559 bp, Homo sapiens
  misc_feature: GYAE6OF01D5UJ8.24.75.G09.1.454.CMB.1.raw
  modified_base (232)..(232): a, c, t, g, unknown or other
  misc_feature (232)..(232): n is a, c, g, or t
  modified_base (376)..(376): a, c, t, g, unknown or other
  misc_feature (376)..(376): n is a, c, g, or t
tcagactactatgtcacgaccggtgctcgatttagtatagacatcagggggtcagacccagtcaggacacagcatggacatgagggtccccgctcagctcctgggggctcctgctgctctggctcccaggtgccaaatgtgacatccagatgacccagtctccttccaccctgtctgcatctgtaggagacagagtcaccatcacgttgccgggccagtcagagttgtttcngccgtgggtggcctggtatcagcaagaaaccgagggaaacgacccctaaatcctagactactagtaacggacgttactttacttttaacgaaaggttcggggttacccttagtaaggttcgaggcggcgagtggatcgtggganagtaattcactctacaactatcagcacgctgccagctagatgtatttagactaactttcttacgcgactaactagtactgtactgtaccttactccccgtaccgttcggacgacgggaccacgacgtacgactaagtacgtacgtattggtcgctcgacctacctattctcgttcctcgtacc

SEQ ID NO: 182616 - DNA, 744 bp, Homo sapiens
  misc_feature: GYAE6OF01C09RV.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctcccttccaccctgtctgcatctgtaggagacagatcaccatcacgttgccgggccagtcagtagttgttctggtccgtgggtcggcctggtactcgagacaacgaaaaccgagggaaacgtacccctaaattcctagacttactaagtacggtcgttacttaacgttttaacgaaacggttcggggttacccctttacgtaaaggttcgacggcggtactaggtcggtacgtcgtagggaactaaggtaactttccgaaccttcctacctaactaaacgttaccgaacggtccgaagtccccgttagaccgtacggtacccgttaggtaacgtttacgtttaacgtttttaccgtaccgttaaacctttttaacttaacccgtaacgtaaccctaaacgttaacgttaagttacgtaagtttaccgtacgtttaaccccttacccgttaccgttacccgggtaccggtaacgggtaccgtaaccggtaacgtacggtaaacctaagtttaacgtaccggttaaagtcggttacggccgttacgacctacccttacgttcgttcgttccgtttaccgtaccccg

SEQ ID NO: 182617 - DNA, 594 bp, Homo sapiens
  misc_feature: GYAE6OF01EDV8Y.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagttgtttctgccgtgggtggcctggtatcagcaacgaaaccgaggaaacaccctaaattcctgatactagtaaggtcgtacttaatttacgaaggtcgggttacccttagtaaggttcagcggcagtggatcgtgggaacagtaatcactcgtacacaatcagcacgcctgcagcctgattgtattttcgaacttaacgtttacttactacgacctaacgtagttactgaactcgttaaccttacctaccccgtaccgtttccgggacccgtaacggggaccctaacgggtactacgggtacctaaagtttacgaccgtaagttggtacggtactccgtaaccgaccttacgtccttcgttccttcgtacccg

SEQ ID NO: 182618 - DNA, 526 bp, Homo sapiens
  misc_feature: GYAE6OF01AW3KP.24.75.G09.1.454.CMB.1.raw
  modified_base (415)..(415): a, c, t, g, unknown or other
  misc_feature (415)..(415): n is a, c, g, or t
  modified_base (428)..(428): a, c, t, g, unknown or other
  misc_feature (428)..(428): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgccgttggggtggcctggtatcagcaagaaaccagggaaacgcccctaaattcctgatactagtaaggcgttctattttacgaaaggttcggggtcccttcgaaggttcaggcggcaggtggatcgtgggacagaattcactctacacaatcagcagcctgcagcctgatgtatttgactaacttnttactcgaccaanagtactgatcgtcttactcccgtacttcggaccgaggggaccacggactggaactattaacgtcgtaatggtcgctcgactaccattctcgtctctac

SEQ ID NO: 182619 - DNA, 674 bp, Homo sapiens
  misc_feature: GYAE6OF01CSDHB.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgaccaaatgtgacatccagatcgacccagtcctccttccaccctgtcctgcatcgtgtacggagacagtagtccaccatctacgttggtggacaagtgacgacctattagcacgtcttcgttgagttggctagtactaacttacaaaccgaagggaaccgtacccctaacctccgtacgtactacttactacgtcgtaccgtaacttaacttaacgacgtacggtcgggtacccagtccgtagttcgagtcggactaagtcgtacgtcgtaggactaggtactaccacgtactaccgactactcagtactcgtactacgacgtaacgtagtacgttacgtacgaccttaacgtttctaattacgaacctaagtacgtaacgttacccgtaaccgttacccgtacgttacccgtacccgggttacggaccgggtaacggtaccgtaagggttacgaacgtacgtaaccgaacggttaacggtacgttcgggtacggtaccgtacggtaccccttaactaccggttcttcgggttacccttaccgg

SEQ ID NO: 182620 - DNA, 889 bp, Homo sapiens
  misc_feature: GYAE6OF01D8K1I.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctccccgaggtgaccaaatgtgacatccagatcgaccctagtctccttcccaccctgtctgcatcgtgtaggagacagagtccaacctataccgtaccgttcggcccgggaccctaggttccaaggtaggtttcgttttccgtcggtccggtggggttacggtcccgttagggtactccgaggcgaaaacgaaaaccggaaacggggaaaaccgtacccccttaaaattcccgttagtacttacttaacggttaaacggtccgttacgttttaacgttttaaaccgtaaaacggggtttccgggggttttacccctttacgggtaaaacggttttccgaacgggtccgggtaccgtaaggggttacggtaacgtttacggtacgggggtaacctaaggttaaactttaccgaccttaccgtactaactaaactcgaacgaccgaacgtcccgttagaccgtacggtccttaggtacgttagttaattttaccggaccctttaaacttttacgtttaacgtacccgtaacctaaaacgttaggtttaattacggttaacgttacggtttaaccctttaacccgttaccccccgttaacccgggtttaccgggaaccccggtaacgggggacccgtaaaccggtaaccgggttagttaaacccgtaaaagttttaaccggtaaccggttaaccgggtttagggtcggacccgttacgaaccccgtacccttaacgtttaccggtttacccttaccctttcgttaaacccc

SEQ ID NO: 182621 - DNA, 743 bp, Homo sapiens
  misc_feature: GYAE6OF01BERJI.24.75.G09.1.454.CMB.1.raw
tcagactactatgtcacgaccggtgctcgatttagtatagacatcagggggtcagacccagtcaggacacagcatggacatgacgggtccccgctcagctccgtggggctcctgctgctctggctcccaggtcgaccaaatgtgacatccagatcgaccctagtcctcccttccacccttgtctgctatcgtgtaggagacagtacgtccacctatcacgttcggccgggccagtcaggtagttgtttctggccgttgggtcggtccgtggtatcgagacgaacggaaaccggaagggaaacctaccccttaacttaccgtacgtaacttacgtaacgtaacggtcgttactttaacgtttaacgtaaaggttccgggttacccttagtaacggttccgaaggtaccggacgtaagggtacggtacgttcgggtagggtaaccgtaagtaacgttaccgtacctaccgttaacaaccgtaaacgtaccgaacggcccgtaacgccccgtttagacccgtacggtaccgtagggttacttagtttaacgttttacgaacctttttaaccttaagtttaccggtacctaaacccggtaattaggttacgtagtacgttcgtaccccttaacccgtacccgtacgggtacccgaaggtaccgtacacgtagtaacgtactaacgtaacgtcgtaaggcgttacgcgtactaccgtacgtactttaccgacgttccttccgtacccg

SEQ ID NO: 182622 - DNA, 649 bp, Homo sapiens
  misc_feature: GYAE6OF01DQETK.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagcgtcacatcacgttcgccggccagtcagagttgtttctgccgtgggtcggtcctggtatcagacaagaaaccgagggaaacgccctaaatcctagatctaagtaacggtcgttacttagtttaacgaaggttcgggttacccttagtaaggttcgagcggcaggtcggtatcgtagggaactagtaacttccaccttacctacgaactaactacgacgaccgacgtcctagaccgtaacgtccgtagtagttagttacttttcgacttaactttacttaccgacgtaacctaactagttagtagtagtacgtactttaccgtccccgtacccgttccgggacccggtaacggggacctaaccggtaccgtacggtaacgtaacgttaaacggtaccgtaacgttggtacgtaccgtacgacccgtacttacttacgttccgttccttcgttaacccc

SEQ ID NO: 182623 - DNA, 668 bp, Homo sapiens
  misc_feature: GYAE6OF01AKFQ8.24.75.G09.1.454.CMB.1.raw
  modified_base (275)..(275): a, c, t, g, unknown or other
  misc_feature (275)..(275): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttggccgggccagtcagtagttgtttctgccgtggggtggcctggtatcagcaagaaaccgagggaaacnccctaaattcctgatctataggctctatttacgaagtgggtccttagagttcagcggcagtggatcgtggacagacttcactctacactatcgagcagcctagccacgtccgtagtattgttacttttacgactaacgttttacttaccgtacgtaaccctaacgtagtttacgtacgttacttaccggtaccttttacccgttacccccgtaacccgggtttaccgggaccgggtaaccgggggtaccctaacccgggtaacgttaccgggtaaaccttaacggtttaaaccggtaccggttaaaccggtttcgggttaccggaccgttaaccgggacccttaacccggttactttacccggtttccgtttaccgtttcccgttaaccccgg

SEQ ID NO: 182624 - DNA, 724 bp, Homo sapiens
  misc_feature: GYAE6OF01BA9BX.24.75.G09.1.454.CMB.1.raw
  modified_base (233)..(233): a, c, t, g, unknown or other
  misc_feature (233)..(233): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtcctccttccacctgtctgcatcgtgtaggagacagacgtcacatcacgttcggccggcagtcagtgtgtttcgngtcgtgggtcgtccgtggtatcgagacaacggaaaccgagggtaaaccgtaccccttaaattccgtagtaacttacgtaacgtaacggtccgtttacttaagttttaacggaaacgggtttccggggttaccctttaagtaacgggtttccgaaggtccggtagtaggtacggtagttaccggtagggaactagtaacgttactacctctacaactaactacgacgacacggtcctgaccagtcctagtacttacgttatttacgaacttaacgttttactaccgtacgtaaaccctagttaaggttactacggttacttaccgttaacccgtttaccccaccccggttaacccgggttcccgggtaaccggtaaccgggaactacccgggtaagtccgtaaacgtaaacgtttaaacgccggttacgttcggggtacgtcctaccggtaacctaccgttacgttaccgtttccttcgttaacccttcccg

SEQ ID NO: 182625 - DNA, 570 bp, Homo sapiens
  misc_feature: GYAE6OF01CD2R4.24.75.G09.1.454.CMB.1.raw
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgttctgccgtgggtgcctggtatcagacaaggaaaccgagggaaactcccctaaattcctgatcgtaattaacggcttacttaattttaacgaaaggtcgggttcccttacgtaaggttcaggcggcgtaaggtggatcgtagggacagtaattcactctacacaatcagcagctgcacgctgattgtaatttcgacttaacttaattactcacctaacgagttanagtacgtntacttacctaccctacgttaccgcgaacggggacaacggtacgtagactaattaacgtcgtaagtggttcgaccgttcgacctaacctagttaccgttattccttacgtaccc

SEQ ID NO: 182626 - DNA, 695 bp, Homo sapiens
  misc_feature: GYAE6OF01BPIE0.24.75.G09.1.454.CMB.1.raw
  modified_base (225)..(225): a, c, t, g, unknown or other
  misc_feature (225)..(225): n is a, c, g, or t
  modified_base (630)..(630): a, c, t, g, unknown or other
  misc_feature (630)..(630): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccacctgtctgcatctgtagagacagagtcacatcacgttgccggcagtcagtgtgtttcngcgtgggtgccgtggtatcgagacaacgaaaccgagggaaactaccccgttaaattcccgtagtatacgtagtaacggtcgttacttaagttttaaccgaaagggttccggggttacccctttagtaaacggttcgacgtcgggacgtaggttaggaacgttcgtagggaactaaggtaacttccgtaacgttcctacgaacctaaagtaccacgtacgacgcccgttacgcctaacggtccgttagtacttaggttactttttacggaacctttaaacgtttcgttaaccgtacgtaacccgtaaacgttagttaatacgagtttacctactttaccgtacccccgtagtttcccgggaccgtaacggggaactaaccggacgttacggaactaacgtttaacnccgggtaaagttcggtcgtactacggaccctaccttacttcggtttactccgttcccttacccgg

SEQ ID NO: 182627 - DNA, 721 bp, Homo sapiens
  misc_feature: GYAE6OF01ACSO6.24.75.G09.1.454.CMB.1.raw
  modified_base (226)..(226): a, c, t, g, unknown or other
  misc_feature (226)..(226): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcacatcacttgccggcagtcagagtgttcngccgtgggtgccgtgtatcagcagaaccgagggaactaccctaaattcctagactacgtagtacggtcgttacttagttttaacgaaacggttcggggttcccctttagaacggttcgaggccggtacgtaggtaagtacgttccggtaggggtaactacttttccgttacctaacctttacacccgtatcccgacggtccgggtaccctgggccgacgtccgtagggaggtacgttcgggttacgggactaacttacttactttaccgtacgtaacctaaactaattaacgtacgtaacggtaatttaacgttacgtttaaccgtttacggttttaccgggaccggggttaacgggggtaacgggtaacggggtacggtaacgtaccggtaaaccgtaaaacgggtaacgttcgggtacggttaccgtccggtaccctaaccgttaccgtttacgttcggttaccctttaccgttcccttccccgttacccccg

SEQ ID NO: 182628 - DNA, 833 bp, Homo sapiens
  misc_feature: GYAE6OF01CP88Z.24.75.G09.1.454.CMB.1.raw
  modified_base (140)..(140): a, c, t, g, unknown or other
  misc_feature (140)..(140): n is a, c, g, or t
  modified_base (157)..(157): a, c, t, g, unknown or other
  misc_feature (157)..(157): n is a, c, g, or t
  modified_base (201)..(201): a, c, t, g, unknown or other
  misc_feature (201)..(201): n is a, c, g, or t
tcagactactatgtcacgaccggtgctcgatttagtatagacatcagggggtcagacccagtcaggacacagcatggacatgagggtccctgctcagctcctgggcctcctgctgctctggctctcaggtgccatatgtnacatccagatcgaaccngtcctccactccctccctgtctcgacctagtctgggtcgggaanaccgaaggtacgtaccacctacgttccttaccgtcggaccgaagggcgacggtcgaaacgggtacttaacgtttaaaccttaattttaaggttaaagtttaggttaatacaaacttaaaccgaaaaaaccgacggtaaccgtaaaccgggtaacccctaaaccgttaccgtaaggtaccaacgtaactcgaactaccgtacaacggtcgggacggacccgaccgggaccctagtaccgtaacggttcgacggtcgacgtaagtacgacgttacggtacggaacttactttacctaccgtaccctactaacctacgtaccgtacggccgcccgtacgtcgtaccggtaccgtacggaggttacggtggttacggaaccctaataacgtttaactttacggaacttaaccgtaaaaccgttaaagtaccggttaaacggttaaacgttaaactttaacgggttaaccgttaaccggtttaaccggtttaacggggggaaccccggtaaaggggggtttaaacgggaaacggggtttacggggaaacccggttaaccccgtaaaagggttaaaaccccggtaaggttccgggtaaaccggttccggtaactacccggtaccttaacccggtttcg

SEQ ID NO: 182629 - DNA, 756 bp, Homo sapiens
  misc_feature: GYAE6OF01C2JR8.24.75.G09.1.454.CMB.1.raw
tcagactactatgtcacgaccggtgctcgatttagtatagacatcagggggtcagacccagtcaggacacagcatggacatgagggtccccgctcagcctccgtggggctcctgctgctctcggctcccgagggtcaccaaagtgtacgactatccgaagacgtcgacccctagttcctcccttccaccctggtcctgactatcgtaggaggaacacgagacgtacacctatacctacgtccggaccggcctaagtcgagttagttcgtttcgcgtccggtgggtcgtcctaggtacacgagacaaccggtaaacgagggaaacctacccgtaattccgataagtacgtaagtacgtccgttaatttaagttaacggtaacggttcggtacccttaagaacggtcgaacgggccgataggtacgagttacggagggaactagtaacctttcaacttcgaacactaaggctaacggcaacgcctagactccgagtacgtagttattaaccgtttagaaacctttaacgttaactaccggtaacaaaccttaagtaacgtttaacgacgttaacgttacgttaacccttacccgtaacccggttaacccggtaccggggaaccggaccgggtaaccgaacctaaccgggttagtaaaaccgtatttaaacccggtacggtaaagggtcgttccggtaccgtacccggtaaccttaccggtaccttttagtttacccgtttcctaaacctttcccccgg

SEQ ID NO: 182630 - DNA, 545 bp, Homo sapiens
  misc_feature: GYAE6OF01D4X8K.24.75.G09.1.454.CMB.1.raw
  modified_base (227)..(227): a, c, t, g, unknown or other
  misc_feature (227)..(227): n is a, c, g, or t
  modified_base (521)..(521): a, c, t, g, unknown or other
  misc_feature (521)..(521): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtctccttccacctgtctgcatctgtaggagacagagtcaccatcacttgccggcagtcagagttgttcngccgtgggtgctggtatcagcaagaaccaagggaaacgcccctaaattcctgactactataacggcgttactaattttaacgaaggttcgggtaccttacgtaacggttcaggcggtacaggtcggatcgtgggactagtaactctactctacacaatcagcacgctgacagctgatgtatttcgacttaacgtttattactcgacctaacgtagttatgtattcgtacttactccctaccgtcggaccgacgggaccacgtacgtacgacgtaattaacgcgtaagtgtgctnacctactactctcgttctctaccg

SEQ ID NO: 182631 - DNA, 692 bp, Homo sapiens
  misc_feature: GYAE6OF01BWG4U.24.75.G09.1.454.CMB.1.raw
  modified_base (239)..(239): a, c, t, g, unknown or other
  misc_feature (239)..(239): n is a, c, g, or t
  modified_base (440)..(440): a, c, t, g, unknown or other
  misc_feature (440)..(440): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgaccaaatgtgacatccagatcgacccagtcctcccttccaccctgtctgcatctgtaggagacagacgtcaccatcacgttggcccgggccagtcagtagttgtttcncgtccgtggggtgtccgtggtatcgagacaacggaaaccgacgggaaaccaccccttaaacttcctagactacgtaagtacggtcttactttacgtttaacgaaggttcgggttacccttacgtaaggttccgacgggcggtacgaggtacggatcggtagggaactaagtaacttacaccttactacaactaatacgacnccgtacgacccgtcggaccacgtccgttaggtacttacgtttacgttttaccgactttaacctttaactttaccgtaccgtaacctaacgtaacgttagtcgtaagttccgttacttaccccgttaccccgtacccgttacccgggaccggtaacggggaacctaccgggtaccgtaggtaccttaagttacgtaccgtaaggttcggtcgtacgtcgaacctccgttactcgttacttcccgttactcccg

SEQ ID NO: 182632 - DNA, 833 bp, Homo sapiens
  misc_feature: GYAE6OF01CRKXN.24.75.G09.1.454.CMB.1.raw
  modified_base (182)..(182): a, c, t, g, unknown or other
  misc_feature (182)..(182): n is a, c, g, or t
tcagactactatgtcacgaccggtgctcgatttagtatagacatcagggggtcagacccagtcaggacacagcatggacatggagggtccccgctcagcctccgtggggctcctgctgctctggctccgaggtcgaccaatgtagactatccgagtactcgaccctgttcctcccttacccncccgttgtctcgcctagttcgtaggtaagggaacacgaggtacttaccaaccagttaccgtacgttccggggcccgggtacctaacggtacgtacggttacggtttcgttttcgcgggtccggttggggtccgtccgttaggtacgtacaacggtaacgaacgaaaccggaacggtaaccgtacccttaaacttcgtagtaaccgttataacggtacggtctttaacttacgtttaaacggacggttccgggtacttacgtacggttacaacgggtcggacgttagggtacgtacgttaccgggtaacggtaacgtaacgttaacgttacccgtaacgtacctttaaacaacgttaaacgaccggtaacggtaccgaccggtttaccgacggtaccctacggttaacgtaacggttactttaacggtttaacggtttaaactaacctttaaacgtttaactttaccggaacgtaaacctaacggtaactttagtacggttaacctttacgttaacccggtttaccctacccgggtacggttaccggggtaacgaaccgggtaacaccgtaggtaccgttaactagttaaccggtacgtagggctcggaccgtcgtaccctatactccgtttaactcggttacctttacccg

SEQ ID NO: 182633 - DNA, 649 bp, Homo sapiens
  misc_feature: GYAE6OF01EIJU9.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtcctcccttccaccctgtctgcatcgtgtaggagacgagacgtcacctatcctacgttcggccgggcagtcagtgttgttctcgtccgtgggtcgccgtggtactcgagaccaaacggaaaccgaacgggaaacctaccccttaaattccgtagtactacgtagtacggtcttactttaagtttaacgaacggttccggttacctacgtaagtcgaggcgtacgtaggtcgatcggaggactagtactctcgtcacaactatcacgcacgtctgactcgctagtactgttactttcgaactttactttactactaccgtactaacgtgttatacgtacttccgtacctttacccgtacccgttaccggtaccgggacgtaaccgggtaccctaacgggtaccgtacggtaaacctaacgtttaacggaccgttaggttcggtcgaccgtacgaccctaccggttagttcccttcgttccgtcccttacccg

SEQ ID NO: 182634 - DNA, 654 bp, Homo sapiens
  misc_feature: GYAE6OF01E4UBQ.24.75.G09.1.454.CMB.1.raw
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (524)..(524): a, c, t, g, unknown or other
  misc_feature (524)..(524): n is a, c, g, or t
  modified_base (614)..(614): a, c, t, g, unknown or other
  misc_feature (614)..(614): n is a, c, g, or t
  modified_base (628)..(628): a, c, t, g, unknown or other
  misc_feature (628)..(628): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaagtgtagacatccagatcgacccagtcctccttcccacctgtctgctatcgtaggtaggagacagacgtcaccatctacgttcggcccgggacagtcgagtgttcgtttcgcggtccggttggggtcgccgtaggtactcgacgaccgaacgaaaccgaacgggtaaacctaccccttaagttcctagtactacgtagtacggtaccgttacttaagtttacggaacgggttccgggttaccttagtaacggttcgacggaccggtgtaggtgacgtcggtaggaacgtagtaacttcgtactctacaactaatcagacacgtccngaccgacgtctagtnttacgtatttcgaacttaactttagtacctacgaacctaagacggttnaggtactcgtaccttacctcccgtacgtcggaccggtacgggacacgtacgtaggtaactaagttaacgtcggttaagtggtcgttaccncggtactaccgttnttaccgttcgttacctccgttacccg

SEQ ID NO: 182635 - DNA, 698 bp, Homo sapiens
  misc_feature: GYAE6OF01BVSQ2.24.75.G09.1.454.CMB.1.raw
  modified_base (187)..(187): a, c, t, g, unknown or other
  misc_feature (187)..(187): n is a, c, g, or t
  modified_base (278)..(278): a, c, t, g, unknown or other
  misc_feature (278)..(278): n is a, c, g, or t
  modified_base (580)..(580): a, c, t, g, unknown or other
  misc_feature (580)..(580): n is a, c, g, or t
tcagactactatgtcacgaccggtgctcgatttagtatagacatcagggggtccagacccagtcaggacacagcatggacatggaggtccccgctcagctcctggggctcctgctgctctggcctcccaggtcgaccaatgtcgacatccgagatcgacccgtagtcctcccttcccaccgtgtctncatctaggtaggacgactagacgtccacatacctacgtcggccggacacgtcgagtgtcgtttcgtggtcggtcggtcggtccgtggtacncgagaacgaacgaacgagggtaacctaccccgttaagtcttacgtaagtacgtaagttacggtacgttacctttaagttttaaccggaaacgggttcccgggttaacctttacgtaagggttcccgaaggtccggtagttaacggtcggtacgtacggtaaggaaccgtaacgttctacgtaccttactaaccagtacctacgacgcggtacctcgtagaccgtgtccgtagtactttagttacctttacgaactttaacgtaacttaccgtacaaccgttagtagttacgttgaccggttntttacccgtaccctaacccgggtccgttacccggggataccgggactacccgtaggtacttacaagttacccgaggtcgtcgacgactccgacttccgactttgacttactccgtacc

SEQ ID NO: 182636 - DNA, 537 bp, Homo sapiens
  misc_feature: GYAE6OF01B5LKT.24.75.G09.1.454.CMB.1.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (329)..(329): a, c, t, g, unknown or other
  misc_feature (329)..(329): n is a, c, g, or t
  modified_base (425)..(425): a, c, t, g, unknown or other
  misc_feature (425)..(425): n is a, c, g, or t
  modified_base (530)..(530): a, c, t, g, unknown or other
  misc_feature (530)..(530): n is a, c, g, or t
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtctccttccaccctgtctgcatctgtaggagacagagtcaccatcacttgccggccagtcagagtgttcngcctgggtggcctggtatcgagcaacgaaccgagggaaacncccctaaattcctagatctataaggcttcttaacttttacgaaaggttcgggtacccttagaggttcaagcgnagtgatcgtgggacagaatcactctcacaatcaagctacgctgacagcctgagttcgtatttcgactaactttactaacgtcgacctaacgtaatntacgatgtaccttactcccacgttccgaccgagggactacggacgtggaacttagtactacgtatgtggctcggccacctattctgtctctacttcctccccgtntcgtacg

SEQ ID NO: 182637 - DNA, 701 bp, Homo sapiens
  misc_feature: GYAE6OF01A2EON.24.75.G09.1.454.CMB.1.raw
  modified_base (232)..(232): a, c, t, g, unknown or other
  misc_feature (232)..(232): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtcgccaaatgtgacatccagatcgaccagtctccttccaccctgtctgcatctgtacggagacagagtcaccatcacttcggccggcagtcagtagtgtttcngccgtgggtgcctggtactcgagacaacgaaaccgagggaaactcccctaaatccgtagactacgtagtacggtccttacttaattttaaccgaaagggtcgggttacccttagaacggttcgacggcggtacgaggtacggtacgtcgtaggggacaagtaacttcacttacgtacgaactaacgtccagccgacgacctcggacacgtccgttagacgttagtttacgttagaccttaactttaacttaccgttaacgaacctaacgtgttaactacggttaactacggtttaccgttaaccctaccccggttaaccgttacccggggaccgtaacggggacccttaaccggggtaacttacggtaaaactttaaccggtttaaacgtacccggtagttccgggttacgacctaccgtaaccggtaccctttagttacccgtttacggttacctttccttaacccgg

SEQ ID NO: 182638 - DNA, 702 bp, Homo sapiens
  misc_feature: GYAE6OF01B6X4D.24.75.G09.1.454.CMB.1.raw
  modified_base (249)..(249): a, c, t, g, unknown or other
  misc_feature (249)..(249): n is a, c, g, or t
tcagactactatgtcacgaccggtgctcgatttagtatagacatcagggggtcagacccagtcaggacacagcatggacatgagggtccccgctcagctccgtggggctcctgctgctctggctcccagggtgaccaaatgtgacatccagatcgacccagtcctccttccaccctgtctgctatctggtaaggagacagagtccaccagtcacgttcggccgggcagtcagtagtgttctgccgtggnggcctggtactgagacgaagaaaccgagggaaactacccctaaattcctagtactactagtaacggtcgttacttaatttaacggtaaacgttcgggttacccttacggtaacggttcgacggtacggtcgtaaggttaggtaacgttcgtaggggtaacctaacggtaacttaccgtaaccttacgtacaaacgtaacgtccgaagacgaccgtccgtaggacctacggtccgttagtagtttgtaacgttttcctaacgttaactttaaccgttaactcggaaaccctaacgtagttaacttagtaagttaccgtacttaaccccgtaccccgttaccggttcccggaccggtaacggggtaccctaaacggtcgtaacgggacttaacgttaaccgtcggtaacgttggacccggtatcgactaccgtattacgtcttgttaacgtcccg

SEQ ID NO: 182639 - DNA, 811 bp, Homo sapiens
  misc_feature: GYAE6OF01CDB49.24.75.G09.1.454.CMB.1.raw
  modified_base (235)..(235): a, c, t, g, unknown or other
  misc_feature (235)..(235): n is a, c, g, or t
tcagactactatgtcacgaccggtgctcgatttagtatagacatcagggggtcagacccagtcaggacacagcatggacatgagggtccccgctcacgctcctggggctcctgctgctctggctcccaggtgccaaatgtgacatccagatgacccagtcctccttccacctgtctgccatctgtagagacagagtcacatcacgttcggccggccagtcgagtagttcgtttcngccgtgggtcggtcctggtatcgagacgaacgtaaaccgaaggggtaaaccaccccttaaacttccgtaggtacttaccgttaagttaacggtccgtttaactttaacgttttaaaccggtaaacgggtttccggggttacccctttacggtaaacgggtttccgaacgggtccgggtactaggggttacggtaacgttacgggtaaggggaaacctaaggtttaaaccttaccgtaaccttccttaaccgtaaaccgtaaacgttcgaacggtacccgtacggtacccgtacgtacccgtacggtaccccgtttaggtaacgttacgtttaaccgttttccggtaaaccttaaccgttttaaccgtttaacctaccgtaacccgtaaacgttaggttaacgttagttaacgttaccgttaccgtttaccccgtaccccgttacccggttacccgggaccgaaccggggtaccgtaaccggtcgtaaacgtaacgtaacgtttaacgtacggtaccggttagtccggttaccacgtccctaaaccgttcttaccgttcgttccttcgttaaccccg

SEQ ID NO: 182640 - DNA, 576 bp, Homo sapiens
  misc_feature: GYAE6OF01ELXIS.24.75.G09.1.454.CMB.1.raw
  modified_base (234)..(234): a, c, t, g, unknown or other
  misc_feature (234)..(234): n is a, c, g, or t
  modified_base (254)..(254): a, c, t, g, unknown or other
  misc_feature (254)..(254): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
  modified_base (515)..(515): a, c, t, g, unknown or other
  misc_feature (515)..(515): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (559)..(559): a, c, t, g, unknown or other
  misc_feature (559)..(559): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaaatgtgacatccagatgacccagtctccttccaccctgtctgcatctgtaggagacagagtcaccatcacttggtccgggcctagtcagagttgtttcngccgtgggtcgccgtggtancagacaacgaaaaccgagggaaaaccgcccctaaaagttcctagattactaataagggctactttatttaacgaaaggtcgggtacccttagaagttcgcgcgacagtgatcgnggacaagaactcatctanaacaatcgagacacgtccngactgaccgtagtactacgttaatttcgaacttaacttacttacgtccgaccaaactagtaactgaagtcgtaaccttcgtaccccctaactcgggaaccgagggaaccngtaccgtagtactaattaacgactaatcggntacgtnccaactnactctttcgacttaccc

SEQ ID NO: 182641 - DNA, 865 bp, Homo sapiens
  misc_feature: GYAE6OF01COFUH.24.75.G09.1.454.CMB.1.raw
tcagactactatgtcacgaccggtgctcgatttagtatagacatcagggggtcagacccagtcaggacacagcatggacatgagggtccccgctcagctccgtggggctcctgctgctctggctcccaggtcgccaaatgtcgacatccagatcgaccctagtccttcccttcccaccctgttcctgactacgtcgtaggtaaggacgacaggtactaccaacctatcctaccgttcgggcccgggaccgagtacggagttacggtttcgtttccgtcgggtcccggttagggggttcggtcccgttttaggtaacgtaccgaacggaccgtaaaaaccggggaaaacccggaacggggtaaaaccccttacccccgtttaaaacgtttcccgtaaggtaaccttaccggtttaaagtaaccggggttacgttttaaccttttaaagtttttaaccggtaaaccgggggttccgggttttaccccttaacggtaacgggttaccggacgggtccggtaccggttagggtaacggtaccgttacggggtaacggggtaaaccctaggtaacttccgtaacctaaccgtactaacctaaacgtcgaacgaccttccggccgtacgacgttacgtccgtaagttacttacgttacgtttaaccgtactttaacctttaacgttacgaccctaaacggtaataagtcgttaagtctccgtttaacctacccgttccccgtaccgggttaccgtaccgaaccgggttacgaccgtacggtttacgaccgtttaacgtaaccgtacggttggtcttacggccggttaccacccgtaccgttacttaccggttacctcgtttacccgtaccc

SEQ ID NO: 182642 - DNA, 799 bp, Homo sapiens
  misc_feature: GYAE6OF01DXE8I.24.75.G09.1.454.CMB.1.raw
  modified_base (247)..(247): a, c, t, g, unknown or other
  misc_feature (247)..(247): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtcgccaaatgtgacatccagatcgaccagtctccttccacctgtctgctatctggtaggagacgagacgtccacctatcctacgttcggcccgggcctagtccgagtagttgtttcgnggtccgtgggtcgtccgtaggtactcgacgacgaacgaaaccgaacgggaaaccgtacccgttaaacttccgtagacttacgtaacgttaacgggtcgtttacgtttaacgttttaacgtaaacgggtttccggggtttacccctttacggtaaacggttcgaacgggtccggtacgtaggtacggtagttacggtagggtaacgtacgtaacttacgacctactacgtaacctaacgtaccgaacgacgtccgtaccgttacggacccacgtccgtaaggtactttacggttaacgttttacgaacccttttaacgtttacttaccgtacgaacttaacgtagttagttacgtagttccgttaccttacccgttacccccgtaacggttacccgggacgggtaaccggggtacctaaccggggtaacgtcgttaaaccgtaagtttaaacccgggtacgtttaaacccgggtgggttaacccggtcccgttacgaacccgtttaccgttaccggtttaccgttacccgtttcggttaccccttaaccccgg

SEQ ID NO: 182643 - DNA, 768 bp, Homo sapiens
  misc_feature: GYAE6OF01DCZII.24.75.G09.1.454.CMB.1.raw
  modified_base (507)..(507): a, c, t, g, unknown or other
  misc_feature (507)..(507): n is a, c, g, or t
  modified_base (744)..(744): a, c, t, g, unknown or other
  misc_feature (744)..(744): n is a, c, g, or t
tcagactactatgtcacgaccggtgctcgatttagtatagacatcagggggtcagacccagtcaggacacagcatggacatggagggtccccgctcagctccgtggggctcctgctgctctggcctcccgaggtcgacctaaatggtagacactccgagacgtcgaccctagtccctcccttcccacccttggtcctgactacgttcgtaggtaagggacgacgaggtaccgtaccaaccgtaacttccgtaccggttccgggcccgggtacctaacggtacgtaggttacggtttcggtttcgtccggtcgggttcgggtcgtaccgttaggtactaccgaagaccgaaacggtaaaccggtaacggaaacccgtacccttaacgttccgtacgtagtactaacggtacggtcgtttacttaagtttaacggaacgggtttccgtaccttagacggttcgagggtcggtgtaacggtgtacgttcggaggactagttactcctacnctacgacgtaactcgtaccgacgtacggtccgtacgtaccgtacgttaccgttagttaacgtttaggtttaccgtttaacgaacccgtttttaacgtacgtttaacccgacgtaccgtaagttggtaacctgttacgtactttacccgtaccgtcccgtacggtaccggacggtacggactaccgtacgtacgtactagtaaacgtcgtacgtgtccgtacgtctaaccgttcgttntaccgttcgttccgcgttaacccg

SEQ ID NO: 182644 - DNA, 754 bp, Homo sapiens
  misc_feature: GYAE6OF01C1839.24.75.G09.1.454.CMB.1.raw
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
tcagactactatgtcacgaccggtgctcgatttagtatagacatcagggggtcagacccagtcaggacacagcatgggacatggagggtccccgctcagctctggggctcctgctgctctggctcccagggtgccaaatgtgacatccagatcgacccngtctccttccacctgtcngcatcgtggtaggagacgagacgttaccaccatacctacgttccgggcccggggtaccaacggtacgaggtacgttcggtttcgtcggtccggttgggggtcgtcccggttaggttaactcgaacggtaccgaaaacggtaaaaccgggaacggggtaaaacctaccccttaaagttccgagtaacttacgtaagtaacggcgtttactttaaacgtttaccgaaagggttccgggttacccttacggtaaacggtcgacgggtcggactacggtggacgtcgggtaggaccgaagtttaacgttccaacgttccgtacaactaacgtacaacgcgacgtccgtacggcctaacgtccgttaggatttggttagttttacaccgtttaacgtttaacttccgaacggtaacctaagttaggtacttaaggtcttaacgccttttaaccaccccgttccgggtacgaccgggtaacgggtaccctaacggttaacgtacgaaactttaacgttaacggcgttaaaccgtggttaccgacttcgaacctactacgttgttacccttgttccgttacccc

SEQ ID NO: 182645 - DNA, 923 bp, Homo sapiens
  misc_feature: GYAE6OF01BDQRH.24.75.G09.1.454.CMB.1.raw
  modified_base (140)..(140): a, c, t, g, unknown or other
  misc_feature (140)..(140): n is a, c, g, or t
  modified_base (901)..(901): a, c, t, g, unknown or other
  misc_feature (901)..(901): n is a, c, g, or t
tcagactactatgtcacgaccggtgctcgatttagtatagacatcgagggtggaaggagacgtgggtcatctggattggtcacagtttggcaccgtagggcctcctgctgctctggcctcccaggtcgaccaaagtggtnaccataccgagtacgtagtacccagttcctcccttaccacccgttgtcctgcctaactcgtgtaggagtaccaggacgtcaaccatcctaccgttgtcgggactaaggtgacgacctagttacgacgacgtctttacgttaggtaggttcggacctaactacgaaacgtttacccgaaaaacccggtagggtaaaccctcccccttaaacctcggtaagtaacctttaccttaacgtaccttcggtaccggttaacccttaaacggtttaccaacggttacggggttaacccggggttcccctaaacggtttccccggaaagggttttaccaacgggttacggaaaccgtaagtcggggtaacgtccggggttaaggggaacccaggggttacccttttaaccaacctttcccgaaccaacccgtaggtttcccaaacgggtccttaaaccgtccggtacttaacggaaaccgtttacggaaccggtttaactttaccgtaaaccgtttaacgttaacgtttacggttttaacaaaccgtaaccggttaagttaaccggtttacccacggttttttacccccggaaagttaacccccgggtttggggaaccccgggttaacggggtaacccgtaacggggtttaccggaaaccgggttaaccgtacgtttaaacccgggaacctaaagggttccggaaccggtcgtaacgtcccacccggtaagttcccttacgttacgtacccttacccgggtttacccncccggtttaaactgttaacccg

SEQ ID NO: 182646 - DNA, 744 bp, Homo sapiens
  misc_feature: GYAE6OF01B5BJF.24.75.G09.1.454.CMB.1.raw
  modified_base (178)..(178): a, c, t, g, unknown or other
  misc_feature (178)..(178): n is a, c, g, or t
  modified_base (226)..(226): a, c, t, g, unknown or other
  misc_feature (226)..(226): n is a, c, g, or t
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtcctccttccacctgtctgcatcgtggtagganacagacgtccaccatcacgttcgccgggaccagtcagtagttgtttcnggccgtggggtcgcctggtatcagacaacgaaaccgaagggaacctaccccgtaaattccgagactacgtaagtaacggtcgttactttaacgttttaacgaaacgggttccgggttaccctttacgaacgggtttcgaacggtccggacgtaaggtggaacttacggtacgggaactaaggtaacttccgtacttacctacaaactactacaggtacacgtcctaggaccacggtacctaggtagttacgtttctttaacggaccttaaactttacgtacccgtacgtaaccgaaagttacggttagtagttacgttccttaaccttaccgtaccccgttaccggtcccggggtaaccggaacggggtacctaacgtaccgggttacgtaacttaacggttaacccgtcggttaaccggttggtaaccggtccgtaaccggtcctaaaccgttcgttaccgttacgtttcccttaaccttcccgtttaccccgttacccgtacttccggttaaaccg

SEQ ID NO: 182647 - DNA, 785 bp, Homo sapiens
  misc_feature: GYAE6OF01B2WNX.24.75.G09.1.454.CMB.1.raw
  modified_base (131)..(131): a, c, t, g, unknown or other
  misc_feature (131)..(131): n is a, c, g, or t
  modified_base (228)..(228): a, c, t, g, unknown or other
  misc_feature (228)..(228): n is a, c, g, or t
  modified_base (233)..(233): a, c, t, g, unknown or other
  misc_feature (233)..(233): n is a, c, g, or t
  modified_base (515)..(515): a, c, t, g, unknown or other
  misc_feature (515)..(515): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtnccaaatgtgacatccagatcgacccagtcctccttccaccctgtctgcatctgagagactagactcacatcacgtgccgggtcagtcagtagggttnttcgngccgtaggggtcgtccgtggtactcgaggccaaggaaaacccgaggggtaaaacctaccccttaaaacttccgtagtaacttaccgtaagtaacggtaccgtttactttaacttttaacggtaaaacggggtttccggggttaccccttacgtaaacgggtttccaagggtccgggacgtaggggttaggaaccgttcggggtaacggggtaactaacgttaaaccgtttcccaacgttcgttaaaccaactaaagtccaacggctaaccgtccacggtacnccggttacctagtaccgttaagtttacgttttacctaattaaacccgtttattaccgtacgtaacccgaaacgtaacggttagtacggtaacttccgttaacccttacccgttaccccgttaacccgggtaccgtacggggtaaccgggtaacctaacggaaccggttaactaaccggtttactaaaaccggtttccggaaaggttcggtcggtactacccggcccttaaaccgtacgtttcccgttaacgttcccttcggttaaccccc

SEQ ID NO: 182648 - DNA, 694 bp, Homo sapiens
  misc_feature: GYAE6OF01A8R97.24.75.G09.1.454.CMB.1.raw
  modified_base (181)..(181): a, c, t, g, unknown or other
  misc_feature (181)..(181): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
  modified_base (609)..(609): a, c, t, g, unknown or other
  misc_feature (609)..(609): n is a, c, g, or t
  modified_base (650)..(650): a, c, t, g, unknown or other
  misc_feature (650)..(650): n is a, c, g, or t
tcagactactatgtcacgaccggtgctcgatttagtatagacatcagggtggaaggagacagagtcaccatcacttgccgggccagtcagagtgtttctgcctgggtggcctggtatcagcagaaaccagggaaagcccctaaatcctgatctagtagcgtctatttacaagtgggtcctnaaggtcagcgcagtgatctgggacagattcactctcacatcagcacgcctgcacgcctgattgtatttcgacctaacgtttacttaccgtcacctaacgtgttactcgtatcgtacctttaccgtaccccgtaccgttccggaccggtaggggtaccacggtactaggtaacctaagtttaaaccgtaccggtaaacgttgggtaccggtacctacggaccctaacccgtacgtttaccgtttccggtttaccttaccgttaacccggtttcccccgtttacccccggacctttaaaccgttccggttaacgaaaccgtttaacggtttaacggttaaccgtttccggttaagggacccggggtacccgggtaccggttacgggaaccggtaacgggtacccgtaacgtagttaaccggngtacgngngtacgtgacgacgacgagtacgtacgcgacgtcgacgtacncgacgacacgtacgagacgtcactatcgtcgacatactgtcgcg

SEQ ID NO: 182649 - DNA, 791 bp, Homo sapiens
  misc_feature: GYAE6OF01CWK4Y.24.75.G09.1.454.CMB.1.raw
  modified_base (495)..(495): a, c, t, g, unknown or other
  misc_feature (495)..(495): n is a, c, g, or t
tcagactactatgtcacgaccggtgctcgatttagtatagacatcagggggtcagacccagtcaggacacagcatggacagtgacgggtccccgctcagcctccgtgggctcctgctgctcgtcggctacccgagggtcaccaatgtgacactccgagtactcgaccctgttcctcccttcccacccttgtcctacgcctatcgtaggtagacgacgtagactccactactctaccggttcggaccgacctagtacgtaggtgttccgttcttcgacgggttcgggtacgtccgttggtacacggaacgacaaaaccggaacggtaaccggaacctaaccccttaagtaccgtacgtacgtaacgtacggttacgtacttactttaagttacgtacggtcgggttactacgtacggtacgcggtacggagtacggtatacggtcggtagggactagtacttaccacgttactacgaactacgtaccgacgtaccncgcgtaccggacgtaccgtaacggttagtatttacggtttacttaacgtttaacgttaacgttacgttaccgtaccttaactaagttaacgttagtacgttaactttccgtaacccgttaccttaccccggggtacgttaccccggggagggttaaaccccgtacgggtaaccggtaaccgttaaagtacccggttaaaacggttccggtaaaccttcgggtaaacgtcccgggttacaccggtaacccgtacggttttaccaacgtttccttacccgtttcccgttaaccccggg

SEQ ID NO: 182650 - DNA, 748 bp, Homo sapiens
  misc_feature: GYAE6OF01CWTXP.24.75.G09.1.454.CMB.1.raw
  modified_base (239)..(239): a, c, t, g, unknown or other
  misc_feature (239)..(239): n is a, c, g, or t
  modified_base (260)..(260): a, c, t, g, unknown or other
  misc_feature (260)..(260): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagactcgacccagtccttcccttcccaccctgtctgctatcgtgtaaggagacagagtccaccatcacttcggccggcagcagtgttgttcgngtccgtgggtcgcctggtacncgagacaacggaaaccgacgggaaacctaccctaattcctagtacttacgtaagtacggtcgttactttaacttttaacggtaaacgggttccgggttaccccttagtaacggttcgacgcggtacgtaggttggacgttcggtacgggaactaaggttacttacgacgttacctacctaaacaacgtaccgtaacgaccgtaccggaccgtcgtacccgacgtacccgtaggtaagtttacgttaacgttttacgaactttaaaccgtttacgttaacctacgtaaccctaaaggttaacgttacgttaacgttaacttaccggttaccctttaacccgtaccccgttaccggttaccgggacccggttaacggggacctaaccggtacgtaacggtaacgttaacgttaaccgtaccggtaagttacgggcggtaccgtccgtacccgtacttacgttcccgtttacggttccctttccgtacccg

SEQ ID NO: 182651 - DNA, 834 bp, Homo sapiens
  misc_feature: GYAE6OF01AVEN3.24.75.G09.1.454.CMB.1.raw
  modified_base (188)..(188): a, c, t, g, unknown or other
  misc_feature (188)..(188): n is a, c, g, or t
tcagactactatgtcacgaccggtgctcgatttagtatagacatcagggggtcagacccagtcaggacacagcatggacatgagggtcccgctcagctcctggggctcctgctgctctggctcccaggtgccaaatgtgacatccagatcgacccagtcctccttccacctgtctgcatctgtagganacagacgtcaccatcacgttggaccgggccagtcaggtagttcgtttctcggccgttgggtcggaccgttggtactcgagacgaacggaaaaccgaagggaaacgtacccccttaaaattcccgtagaacttcgttaagtaacggtcttacgttaacttttaacgaaagggtttccgggttaccctttacggtaacgggtttcaacggtccggtactaacgggtggtaacgttccgtaggggaacctaaggttaacttaccgtaacttacctaccgtaaacgtaacttccgaacggtaccgtaacggtacccgttacggaaccctacggtaccccggttagttaacggttacgtttaacgttttaccgaaacgtttaacgttttaacgtttaaccgtaccgtaaccgtaaaccgtagtttaacggttacgttacgttaccgtacctttaacccggtcccccgttaaccccgggtttaccggggaaccccggttaacggggacccttaaacccggggttcgtaaccgggtaaacctttaaccggtttaaaccggtccggttaaacgttcggggttaacccggtacgtaccggtaaaccccttaccggttacgtttacccgttacgtttcccttaaccgggttacccc

SEQ ID NO: 182652 - DNA, 742 bp, Homo sapiens
  misc_feature: GYAE6OF01BD1UD.24.75.G09.1.454.CMB.1.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
  modified_base (729)..(729): a, c, t, g, unknown or other
  misc_feature (729)..(729): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttcccacccttgtctgcctatcgtgtagganacagagtcaccatcacgttcggcccggtaccagtccaggtagttcgtttcgtcgtcggttcggggtggcccgttaggtaacncgacgtacgaaccggaaaaccgacggggtaaacctacccccgttaaagttccctaggtaactcgttaacgaacgggtctttacgtttaaacgttttacgtaaacgggttcgggtttacccctaggtaacgttcgaggcggctaggtacggtatcggacggtaacgtagtacttcaccttacaccgataactacacgccagtccgtgaccgtgaccgttgtacgttagttacgtttacgtaacccgttattaccgttaacgacgtaaccttaacggtacgttcgtaactaccgtaacggttaccctttaaccccgtacccgttaaccccgggttcgggtaacccggtaacgggggtaaccctccggttacggtaacgtaaacttaacggttaaaccgtaccggttacgtagggtaccgacgttaccgaccgtaaccttacgttagtttcccgttnttcccgtaccccg

SEQ ID NO: 182653 - DNA, 750 bp, Homo sapiens
  misc_feature: GYAE6OF01EQQUB.24.75.G09.1.454.CMB.1.raw
  modified_base (232)..(232): a, c, t, g, unknown or other
  misc_feature (232)..(232): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagactcaccatcacttcggccgggccagtcagagttgtttcncgccgtgggtggccgtggtatcagacgaacgaaaccgagggtaaacgaccccttaaattccctaggacttacgtaagttaacgggtcgttactttaacgttttaacgaaagggtttccggggttaccctttacggtaacggtttaccgacggaccgggtacgtaggggttacggtacgttcggtaggggtaaacctaaggtaaccgtttaccaaccgttacctaacctaacgtaaactaccgaacgtccaacggtcccgtacgaccgtacgtaccccgttagggtacctttaaggttacgttttacgaacctttaacgttttacttaacgtccgtaacctaaacggtagttaactagtaacgttcgttaaccttacccgtaccccgttaccgttaccggggacccgtaaggggtacccaaccgggttaacgtacggtaacttaagttaaccgtaccgtaaaggttggtccgggtacgtccgaccgtaaccttagttccctttcgttcttccgttaccc

SEQ ID NO: 182654 - DNA, 1045 bp, Homo sapiens
  misc_feature: GYAE6OF01AOEMZ.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtcgccaaatgtgacactccagatcgacccagtcctccttccaccctgtctgactatcgtgtacggagacaggtacgtaccaccctaattccgaaccgtttcgggcccgggacctagttaccgaaggtaccggtttggttttaccgttcggtcccgttggggggtaccgggtacccgttaggggttaacgtccgacggaaccgtaaacgggtaaaacccggaacggggtaaaacccgaacccccggtttaaaaattccccctaaggtaaccttaaccggttaaagtaaccgtaccgtttaacgtttaacgtttttaaaaccggaaaccggggttttccggggttaaccccctttaacggtaaaaccggggtttccaacggggtacccggggtaacttaacggggttacggtaaccgttacgggttacggggaaaactacgggttaaaacctttccgtaacgtttaccctaaaccaaaccttaacctacgaaccgtaccggaaccgttcccgtagacccgtaccgttacggttacgtaaacgttttggttaaccggttttaacgtaaccctttaaaacccgttttacgtttacccggtaaccgttaaacccgtaaacgtaacggttttaaggttaaccgttaaggtttaccgttaaaccgtttttaacccccggtaaccccccgtttccccgggttttaaacccggggacccgggtaaaccgggggttaaacccccgtaccgggttaaacccggtacgggttaaaaaccgtttaaccggtttaaaaccggttaaccccgggggtaaactttacgggggttccccgttaccggtaaacccgggttcccctttaaaccccgttaaacggggtttccccttttacccgggtttaaacccgtttcccccttttaacccccgg

SEQ ID NO: 182655 - DNA, 778 bp, Homo sapiens
  misc_feature: GYAE6OF01EIWAK.24.75.G09.1.454.CMB.1.raw
  modified_base (459)..(459): a, c, t, g, unknown or other
  misc_feature (459)..(459): n is a, c, g, or t
tcagactactatgtcacgaccggtgctcgatttagtatagacatcgagggggtcagacccagtcaggacacagcatggacagtggacggtccccgctcagctccgtggggctcctgctgctcgtcggcctccgaggtcgacctaaagtggtacactactccgaagtactcggaccctgttccttaccctccctaccgtgtctgtactagtcgtagggtaggaacgtacgaacggccgtacctaacgtacgtacgttaccgttccgggcccgtacgaccggtagtacggttacgttcggtttcgacggttcgggtggggtcgtccggtaaggttcaacggacgaaccggaaaacgtaaccggaaggtaacccttacgttacgtcggtaatacgttaacgttacggtacgttccgtacgtttaagtttacggaccgggttccgtaccttagtacggtcggngaccggtagtagggtcgtacgtcggtacgaactacgttactaccgttaacactacgaaataccgacgtacgacctaggtccagtacgtagtcgttagttgttacgtacttcgtaactttacgtactaccgctagtagtacgttatacgtcgttaccgtaccttacccggtccgtaaaccggccggtaacgggaaccgtacggtaccgttaacggtaaccgttaaacgtaccggttaaggttacccgttgggtcggtaaccgtcgtaaccgttacccggttactacggttccctttaccgttaccccttcggttaacccc

SEQ ID NO: 182656 - DNA, 716 bp, Homo sapiens
  misc_feature: GYAE6OF01AXQ30.24.75.G09.1.454.CMB.1.raw
  modified_base (513)..(513): a, c, t, g, unknown or other
  misc_feature (513)..(513): n is a, c, g, or t
  modified_base (687)..(687): a, c, t, g, unknown or other
  misc_feature (687)..(687): n is a, c, g, or t
  modified_base (701)..(701): a, c, t, g, unknown or other
  misc_feature (701)..(701): n is a, c, g, or t
tcagactactatgtcacgaccggtgctcgatttagtatagacatcgagggggtcacgacccagtcaggacacagcatggacatggagggtccccgctcagctccgtggggctcctgcgtcgctcgtcggcctccgaggtcggacctaaagtgtacgacactcgacgatcgacctacgtcctcccgttaaccctccgtcgtcgtcactacttcggtaggtagacgaagacggtaccacctaccgacgtacgtaccgtccgggccggtacgacgtccgtaggttcgttacgttccgtggtccggttagggtcgtccgtaggtactaccgacggaacgaaccggaaccggtaaacggaaccctaacccgtaacgttctacgtacgtacgtacgtaacggttcgtaaacttacgtttaacggtaacgggttccgtaccgttacgtacggtacgtaccggcgtacgacggtgtagtaccggtggaactaacgtactctacgtctaacgtacaaacgtnaaacgacgtaccgtccgtagtaacccgcgtacgttagttaacccttggttttaacctacggttacttaacttaaccgttacgacctaacacgtatacgtactcgtctaacgtccaccgttcgacggcgacggtactacgacgtagtactaaacgtcggtcgtacgtgccgtacnccgtagtactcttntactgttcccgtacg

SEQ ID NO: 182657 - DNA, 725 bp, Homo sapiens
  misc_feature: GYAE6OF01CIYUN.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtcctccttccaccctgtctgcatctgtaggagacagagtccaccatcacttcgccgggccagtcagtagttgttctgccgtgggtcggcctggtactcagcaacggaaaaccgacgggaaacgtccccctaaattcctagtactactagtaaggtccttacttaatttaacgaaaggttccggggttaccctttagaaggttcaggtccggataggtcggactcgtagggactagaacttccaacttcgtacaactaatcacgtcacgccctaggacctacgcccttaggactttaggttaactttttacggaaccttaaaccgttttaagtttaacctacgtaaccctaaacgttaggttaattacgtacttaaccggttacccttttaaccgtacccccccgttaaccggttcccggggaaccggtaaccggggaacgtaacccggtacgttacgggtaaaccttaaccgttaaaccgttacccggaacgtttgggtccggtacccggttaccaccccgtaaccgtacgtttacccgttacgtttcccgtttcccgttaaccccg

SEQ ID NO: 182658 - DNA, 493 bp, Homo sapiens
  misc_feature: GYAE6OF02HDX5W.24.75.G09.1.454.CMB.1.raw
  modified_base (464)..(464): a, c, t, g, unknown or other
  misc_feature (464)..(464): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtgcctggtatcagcagaaaccagggaaagcccctaaattcctgatctataaggcgtctattttacaaagtgggtccttcaaggttcagcggcagtggatctggcacagatttcactctcaccatcagcagcctgcagcctgaagatcttggaacttattactgtctacaagattacaattacccgtggaccgttcggccaagggaccaaggtgaaatcgaacgactgnggctgcacatctgtcttcatctcccgcta

SEQ ID NO: 182659 - DNA, 563 bp, Homo sapiens
  misc_feature: GYAE6OF02FLOJJ.24.75.G09.1.454.CMB.1.raw
  modified_base (235)..(235): a, c, t, g, unknown or other
  misc_feature (235)..(235): n is a, c, g, or t
tcagactactatgtcacgaccggtgctcgatttagtatagacatcagggggtcagacccagtcaggacacagcatggacatggacgggtccccgctcagctccgtggggctcctgctgctctggctcccagggtgaccaaatgtgacatccagatgacccagtctccttccaccctgtctgcatctgtaggagacagagtcaccatcacttggccgggcagtcagagttgtttcngccgtggggtcggccgtggtatcagcaagaaaccgagggaaacgaccctaaattcctagatctaagtaaggcgttacttatttaacgaaaggttcggggtacccttagtaaggttcaggcggcaggtggatcgtgggacagattcactctacacaatcagcagcctgcagcctagatgtatttgactaactttattactcgtaccctaaactagttactgtatcgtactttactccctaccgttccgggaccgacggggaccaacgacgtggactattaacgtcggaacttggtcggtctacgactacctattcgtcgttcttctacc

SEQ ID NO: 182660 - DNA, 487 bp, Homo sapiens
  misc_feature: GYAE6OF02HPAHG.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaaagtggggtcccttcaaggttcagcggcagtggatctgggacagaattcactctcacaatcagcagcctgcagcctgatgatttgctaacttattactgccaacagtatgatgcttatcccaccttcggccaggggacacgactggacattaatcgaactgtggctgcaccatctgtcttctac

SEQ ID NO: 182661 - DNA, 550 bp, Homo sapiens
  misc_feature: GYAE6OF02IOOXY.24.75.G09.1.454.CMB.1.raw
  modified_base (410)..(410): a, c, t, g, unknown or other
  misc_feature (410)..(410): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctatttacaaagtggggtccttcaaggttcagcggcagtggatcgtgggacagaattcactctcacaatcagcagcctgcagcctgatgtatttgactaacttattactgacctaanagtatgatgactttactccctacttccggaccgtaaggggaccaacggtactagggactaagtttaacgtcggtaaacttggttacggccttacggaccctaacccgtattcccgttacggtttaccttaccgtaacccg

SEQ ID NO: 182662 - DNA, 779 bp, Homo sapiens
  misc_feature: GYAE6OF02I5GHA.24.75.G09.1.454.CMB.1.raw
  modified_base (231)..(231): a, c, t, g, unknown or other
  misc_feature (231)..(231): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttgccgggccagtcagagttgtttcngccgtgggtggcctggtatcagcagaaaccgagggaaacgcccctaaatcctgatctataagggtctacttattttaacgaaaggtcggggttccccttacgtaaagggtttccaagggtccgggactacggtagggtacttcgttagggggaacctaagggtaaactttcctaactccttaccaaacctaaattccaacggaccgtaacggtccccttagggacccgtaaacggtccccgttagggtaacgtttaggttacgttttttacggaacccgtttaaaaccgttttaacctttaaagttttacggttaccctaaaaccggttacggtaaaccggttttaacccgtaaccgggtttttccccccggttacccgttaacccggttttccgggggaccgggggtaacggggtaaacccggtaagggttacgggaacgtactaccgtaaccgtaaccgtaaaccggtggttaccgggcttaccggaccgtaaccgtacgtttccgttcggtttacccttacgttacctttcccggttaccccccg

SEQ ID NO: 182663 - DNA, 490 bp, Homo sapiens
  misc_feature: GYAE6OF02GH4Q1.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagccccctaaattcctgatctataaggcgtctattttacaaagtggggtcccttcaaggttcagcggcagtggatctgggacagaattcactctcacaatcagcagcctgcagcctgatgatttgctaacttattactgccaacagtatgatgcttatccctaccttcggccagggacacgactggacattaagtcgaactgtggctgcaccatctcgtcttctac

SEQ ID NO: 182664 - DNA, 506 bp, Homo sapiens
  misc_feature: GYAE6OF02GNV0I.24.75.G09.1.454.CMB.1.raw
  modified_base (319)..(319): a, c, t, g, unknown or other
  misc_feature (319)..(319): n is a, c, g, or t
  modified_base (503)..(503): a, c, t, g, unknown or other
  misc_feature (503)..(503): n is a, c, g, or t
tcagactactatgtcacgaccggtgctcgatttagtatagacatcagggggtcagacccagtcaggacacagcatggacatgagggtccccgctcagctcctgggggctcctgctgctctggctcccaggtgccaaatgtgacatccagatgacccagtcctccttccaccctgtctgcatctgtaggagacagagtcaccatcacttgccgggccagtcagagttgtttctgcctgggtggcctggtatcagcagaaaccaggggaaagcccctaaattcctgatctataaggcgtctattttacaagtgggtccttnaaggttcagcggcagtggatcgtgggacagaattcactctcacaatcagcagcctgcagcctgatgatttgactaacttattactgacctaacagtatgattgacttactccctaccgttcggccgaaggggaccacgactaggactattaacgtcgaatggtggctgacacctatctgtcttntac

SEQ ID NO: 182665 - DNA, 502 bp, Homo sapiens
  misc_feature: GYAE6OF02HS86D.24.75.G09.1.454.CMB.1.raw
  modified_base (316)..(316): a, c, t, g, unknown or other
  misc_feature (316)..(316): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaagtgggtcccttnaaggttcagcggcagtggatctgggacagaattcactctcacaatcagcagcctgcagcctgatgtatttgactaacttattactgaccaacagtatgatgtacttactccctaccgttcggaccacggggacacgactggactattaacgtcgtaactggtgtctgctaccatctcgtcttctac

SEQ ID NO: 182666 - DNA, 485 bp, Homo sapiens
  misc_feature: GYAE6OF02GUK0E.24.75.G09.1.454.CMB.1.raw
  modified_base (313)..(313): a, c, t, g, unknown or other
  misc_feature (313)..(313): n is a, c, g, or t
  modified_base (473)..(473): a, c, t, g, unknown or other
  misc_feature (473)..(473): n is a, c, g, or t
  modified_base (482)..(482): a, c, t, g, unknown or other
  misc_feature (482)..(482): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaccagggaaagcccctaaattcctgatctataaggcgtctatttacaagtgggtccttnaaggttcagcggcagtggatctgggacagaattcactctcacaatcagcagcctgcagcctgatgtatttgactaacttattactgcaacagtatgatgacttatccctaccttcggccaggggacacgactggactattaagtcgaactgtgctgcacntctgtcttntac

SEQ ID NO: 182667 - DNA, 528 bp, Homo sapiens
  misc_feature: GYAE6OF02ITHZ3.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctggggtggcctggtatcagcagaaaccagggaaagacccctaaattcctgatctataaggcgtctattttacaaagtggggtcccttcaaggttcagcggcaggtggatctgggacagaattcactctcacaatcagcagcctgccagcctgatgtatttgactaacttattactcgaccaatagtatgattgtaccttactccctaccgttccggaccgtaggggaccacgtacgtacggactaagttaacgtacgtaacgtggtcgcgtgccacgtattcgtcgttcttactac

SEQ ID NO: 182668 - DNA, 549 bp, Homo sapiens
  misc_feature: GYAE6OF02IS3QN.24.75.G09.1.454.CMB.1.raw
  modified_base (229)..(229): a, c, t, g, unknown or other
  misc_feature (229)..(229): n is a, c, g, or t
  modified_base (268)..(268): a, c, t, g, unknown or other
  misc_feature (268)..(268): n is a, c, g, or t
  modified_base (423)..(423): a, c, t, g, unknown or other
  misc_feature (423)..(423): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngccgtggggtgccgtggtatcagcaagaaaccagggaancccctaaattcctgatctagtaaggcgtacttatttaacaaaggttggggtacccttcgaaggttcagcggcagtggatcgtagggacaagaattcactctacacaatcagcagcctgcagcctgatgtatttgctaactttattactgaccaanagttatagtatgtaccttactaccctaccgttcggaccgtacggggtaccaacgacgtagggacctaagttaacgtcgaaccttggtacggtctcggaccacctagtccttcgttccttactaccc

SEQ ID NO: 182669 - DNA, 553 bp, Homo sapiens
  misc_feature: GYAE6OF02GACM4.24.75.G09.1.454.CMB.1.raw
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctgggtgcctggtatcagcagaaaccagggaaacgcccctaaattcctgatctataggcgtctatttacaaggtcgggtccttnaaggttcagcggcaggtggatcgtgggacagaattcactctcacaatcagcagcctgcacgcctgatgtatttgactaacttattactgaccaagtagtatgattgactttactacccgtaccgttccggaccgaaggggtaccaacggtacgtacggtactaacgtttaacgtaccgaacgttcggtacggtcctacggaccctacctacgttccttacggtttccttacttacccg

SEQ ID NO: 182670 - DNA, 568 bp, Homo sapiens
  misc_feature: GYAE6OF02HE2JJ.24.75.G09.1.454.CMB.1.raw
  modified_base (229)..(229): a, c, t, g, unknown or other
  misc_feature (229)..(229): n is a, c, g, or t
  modified_base (315)..(315): a, c, t, g, unknown or other
  misc_feature (315)..(315): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctggggtggcctggtatcagcagaaaccagggaaacgcccctaaatcctgatctataaggcgtctatttacaagtgggtccttnaggttcagcggcagtgatcgtgggacagtaattcactctcacatcagcagcctgcagcctgattgtatttcgactaactttattacgtgaccctaaactagttatgtattcgtacctttacctcccgtaacccgttccggacccgaaggggaaccaccgtacgtacgggactaagtttaacgtaccggtaactttcgggtacggtccgttacgacccttacctacgtttccttacggttccctttactacccg

SEQ ID NO: 182671 - DNA, 537 bp, Homo sapiens
  misc_feature: GYAE6OF02I4V55.24.75.G09.1.454.CMB.1.raw
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (392)..(392): a, c, t, g, unknown or other
  misc_feature (392)..(392): n is a, c, g, or t
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
  modified_base (523)..(523): a, c, t, g, unknown or other
  misc_feature (523)..(523): n is a, c, g, or t
  modified_base (534)..(534): a, c, t, g, unknown or other
  misc_feature (534)..(534): n is a, c, g, or t
tcagactactatgtcacgaccggtgctcgatttagtatagacatcagggggtcagacccagtcaggacacagcatggacatgagggtccccgctcagctcctggggctcctgctgctctgactcccaggtgccaaatgtgacatccagatgacccagtctccttccaccctgtctgcatctgtaggagacagagtcaccatcacttcgccgggccagtcagagttgtttctgccgtggggtgccgttggtatcgagcagaaaccagggaaacgcccctaaattccctagatctataacggcgtataatttacgaaagtcgggtccttnaaggttcagcggtnagtggatcgtggacagtaacgttcactctacaacgatcagcagcctgacncgacctgatgtagtttnactaacttattactgaccaatatatgtatcgtacttactacccacgttaccggccacgggactaccgataccgganatttaacgcgtaactggtagtctaggaccaacccgttntactcttcctntac

SEQ ID NO: 182672 - DNA, 538 bp, Homo sapiens
  misc_feature: GYAE6OF02G4ZMS.24.75.G09.1.454.CMB.1.raw
  modified_base (191)..(191): a, c, t, g, unknown or other
  misc_feature (191)..(191): n is a, c, g, or t
  modified_base (389)..(389): a, c, t, g, unknown or other
  misc_feature (389)..(389): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacngagtcaccatcacttgccgggccagtcagagtgtttctgccgtgggtggcctggtatcagcagaaaccagggaaacgcccctaaattcctagatctataaggcgtactattttacaaaggtcgggtaccttcgaaggttcagcgcaggtggatcgtgggacagtaattcatctcacatcagcagcctgccagcctagntagtatttgactaactttattactcgacctaacagtatgattcgtacttactacccaccgttcggaccgagggtacaccggactcggactaattaacgcggtaacgtggtacgtcgtacgacaacctcttcgttcgttcttactacccg

SEQ ID NO: 182673 - DNA, 515 bp, Homo sapiens
  misc_feature: GYAE6OF02G8RKZ.24.75.G09.1.454.CMB.1.raw
  modified_base (229)..(229): a, c, t, g, unknown or other
  misc_feature (229)..(229): n is a, c, g, or t
  modified_base (320)..(320): a, c, t, g, unknown or other
  misc_feature (320)..(320): n is a, c, g, or t
  modified_base (367)..(367): a, c, t, g, unknown or other
  misc_feature (367)..(367): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngccgtgggtggcctggtatcagcagaaaccgagggaaacgaccctaaattcctagatctataaggcgtctatttacgaagtgggtaccttnaggttcagcgcagtggatcgtgggacagaattcacttcacacatcancagcctgcagcctagatgtatttgactaactttattactgaccaagtagtatgatcgtaccttactccctacgttccggacgacgggacacgtagtagactattaacgcgtatggtagtctgacctacgtattcttcgtcttactacc

SEQ ID NO: 182674 - DNA, 787 bp, Homo sapiens
  misc_feature: GYAE6OF02FWNLL.24.75.G09.1.454.CMB.1.raw
  modified_base (231)..(231): a, c, t, g, unknown or other
  misc_feature (231)..(231): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagtagttgtttcngccgtggggtcggcctggtatcagacaagaaaccgaagggaaacgtacccctaaacttcctagacttacgtaagtaacggtccgttacttaacgttttaaacgtaaagggttccggggttacccctttacgtaaacgggtttaccaacgggtccggtacgtaaggttcggtaagttccggttaggggaacctaaggttaaacttaccgtaacttaccttacaaaccgtaaattccgaacggaccgtaacggtcccttacggacctacggtcccgttaggtacttagtttacgttttaccggaaccctttaaacgttttacgttaaccgttacgtaacccgtaaaacctaggttaacttagtaacgtttacggtaccctttaacccgttacccccgttaacccggtttaccgggaacccggttaacggggaaaccctaacgggtaccgttaacgggtaacctaaaggtttaccgttaaaccggtaaccgttacgggtcggtacctacgggaccctaaccgttaacgttcctttccgtttaccgttaccttaacccgg

SEQ ID NO: 182675 - DNA, 556 bp, Homo sapiens
  misc_feature: GYAE6OF02ISQTX.24.75.G09.1.454.CMB.1.raw
  modified_base (227)..(227): a, c, t, g, unknown or other
  misc_feature (227)..(227): n is a, c, g, or t
  modified_base (372)..(372): a, c, t, g, unknown or other
  misc_feature (372)..(372): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagtgttcngcctgggtggcctggtatcagcagaaaccagggaaacgcccctaacctcctgatctatactgcgtccaatttacacagtcggggtccatccaggttcagtggacaatggatctgggacagagttcactctcaccatcagcagtcngcaacctgaagtactttagacctaacttactattcgtacaacgagtacgttacacggtttaccccggtctaccgtttcgggacgggtaacgggaaccgaagggtaggagtactacgaacgaacgtaacgtcggtaggtcctaggacctaaccgtattccgttggtcctttacgacgtttccccg

SEQ ID NO: 182676 - DNA, 508 bp, Homo sapiens
  misc_feature: GYAE6OF02HOL9F.24.75.G09.1.454.CMB.1.raw
  modified_base (266)..(266): a, c, t, g, unknown or other
  misc_feature (266)..(266): n is a, c, g, or t
  modified_base (404)..(404): a, c, t, g, unknown or other
  misc_feature (404)..(404): n is a, c, g, or t
  modified_base (445)..(445): a, c, t, g, unknown or other
  misc_feature (445)..(445): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaancccctaaatcctgatctataaggcgtctattttacaaagtggggtcccttcaaggttcagcggcaggtggatctgggacagaattcactctcacaatcagcagcctgcagcctgatgattttgactaacttattactnccaacagtatgattgtacttactccccacgtttccgaccgnggggaaccacgtacgtcggacattaacgtacggtaactgtgctgcacctatctcgttctctac

SEQ ID NO: 182677 - DNA, 509 bp, Homo sapiens
  misc_feature: GYAE6OF02GJZIQ.24.75.G09.1.454.CMB.1.raw
  modified_base (315)..(315): a, c, t, g, unknown or other
  misc_feature (315)..(315): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtgcctggtatcagcagaaaccagggaaacgcccctaaattcctgatctataaggcgtctatttacaaagtgggtccttnaagttcagcgcagtggatctgggacagaattcactctcacaatcagcacgcctgcagcctgatgtatttgactaacttattactgaccaacagtatgatgtacttactccctaccgttccggccgaaggggacacgtactcggactagttaacgtcgaactcggtgcgtacgacacgtactcgtgttcctctac

SEQ ID NO: 182678 - DNA, 739 bp, Homo sapiens
  misc_feature: GYAE6OF02F6KIV.24.75.G09.1.454.CMB.1.raw
  modified_base (187)..(187): a, c, t, g, unknown or other
  misc_feature (187)..(187): n is a, c, g, or t
  modified_base (265)..(265): a, c, t, g, unknown or other
  misc_feature (265)..(265): n is a, c, g, or t
tcagactactatgtcacgaccggtgctcgatttagtatagacatcaggggtcgagacccagtcaggacacagcatggacatgagggtccctgctcagctcctggcctcctgctgctctggctctcaggtgccatatgtgacatccagatgacccagtctccatcctccctgtctgcatctgtgggancagagtcaccatctcttgccaggcgagtcagggctaattaacgtactttagtaaattggtaattctatacaaaaaccnggacaacgggaccctaaaactccgtacggttaccaacggtatggacctaactacccgtaaagttccgggttagccccgtaacgggggacccctaacgtaccaacgggtttaccgacggaccgggtaccgaacggttacggaacgttcgtaacggggtaccgtagtttaaccgttccgttacccgtttactacccgtaagttaccacggtaccgggcccttccggaccgtaactcccggttacgtacgggaattcgggtttacggactaacgtaacttaggttaaccttaggtaaccctaagaaactttacgtcgaaacgttactaacttacgtaactttaaccgttttaggtacccggttaaggggacccgttaaggggtaccgggtaaggttaacccgaaccggtttaaaaccgaaccggttttacgggacgggttaaccgacgggttacccgtaaaccgttgttaaacccgg

SEQ ID NO: 182679 - DNA, 483 bp, Homo sapiens
  misc_feature: GYAE6OF02GNHJT.24.75.G09.1.454.CMB.1.raw
  modified_base (444)..(444): a, c, t, g, unknown or other
  misc_feature (444)..(444): n is a, c, g, or t
  modified_base (454)..(454): a, c, t, g, unknown or other
  misc_feature (454)..(454): n is a, c, g, or t
  modified_base (475)..(475): a, c, t, g, unknown or other
  misc_feature (475)..(475): n is a, c, g, or t
  modified_base (480)..(480): a, c, t, g, unknown or other
  misc_feature (480)..(480): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaagcccctaaattcctgatctataaggcgtctattttacaaagtggggtcccttcaaggttcagcggcagtggatctgggacagaattcactctcacaatcagcagcctgcagcctgatgatttgctaacttattactgaccaacagtatgatgcttatcccacttcgcagggacacgacnggacattaancgaatgtggctgcaccatctntcttntac

SEQ ID NO: 182680 - DNA, 553 bp, Homo sapiens
  misc_feature: GYAE6OF02GMA6R.24.75.G09.1.454.CMB.1.raw
  modified_base (229)..(229): a, c, t, g, unknown or other
  misc_feature (229)..(229): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctggggtgcctggtatcagcagaaaccgagggaaagcccctaaattcctagatctagtaaggcgtacttatttaacgaaagttcggggtcccttacgaaggttcagcggcagttggatcgtgggacagaattcactctacacaatcagcagcctgcagcctgatgtatttgactaacttattactacgacctaacagtatgattgtactttactcccctaccgttccggaccgtaaggggaccaacggacctaggtactagttaactcggtaacgttggtacggcttcgacctacgtacttcgttacttccttacgtacccg

SEQ ID NO: 182681 - DNA, 641 bp, Homo sapiens
  misc_feature: GYAE6OF02J1M3D.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctccggctcccacggtgccaaatgtgacatccagatgacccacgtctcccttccaccctgtctgcatctgtaggagacagagtcaccactctacttcggccgggccagtcagagttgtttctgtcctgggtggccgtggtatcagcaagaaaccgaagggaacgtacccctaaattcctcgatctaacgtaggtcgtcttaattttacgaaaggttcgggtccttactaaggttcgacgcggactaggtcggtatcgtgggacagtaactcgactctacacaaatcagacacgctcgcacgtcctgactgtagtttacgtactaaactttcgttactcgacctaaagtacgttaatagtagttcttaccttacccgtacccgttaccgttaccgggtacccgggaacgggtacccggtaacgaccgttacggtaaccgttactttaacgacggttaaccgttggtaacggtcctacggaccttaacgtaacgttccgttaccgtttcctttacgaccctttcccgg

SEQ ID NO: 182682 - DNA, 566 bp, Homo sapiens
  misc_feature: GYAE6OF02FJ15J.24.75.G09.1.454.CMB.1.raw
  modified_base (230)..(230): a, c, t, g, unknown or other
  misc_feature (230)..(230): n is a, c, g, or t
tcagactactatgtcacgaccggtgctcgatttagtatagacatcagggggtcagacccagtcaggacacagcatggacatgagggtccccgctcagctcctgggggctcctgctgctctggctcccaggtgccaaatgtgacatccagatgacccagtctccttccaccctgtctgcatctgtaggagacagagtcaccatcacttgccgggccagtcagagtgtttcngcctgggtggcctggtatcagcagaaaccagggaaagcccctaaattcctgatctaataaggcgtctaattttacaaaggttggggtcccttagaaggttcagcggcagtggatcgtgggacagaattcactctcacaatcagcagcctgcagcctgattgtatttgactaacgtttattactcgaccaactagtattgattcgtacctttatccccttaaccgtttccgggacccgtaaggggaccgaaccgtacgtagggactaatttaacgtaccgtaacgttggtacggtctcggaccacccgtatttcctacggtttccttacgttacccg

SEQ ID NO: 182683 - DNA, 652 bp, Homo sapiens
  misc_feature: GYAE6OF02IXTMB.24.75.G09.1.454.CMB.1.raw
  modified_base (190)..(190): a, c, t, g, unknown or other
  misc_feature (190)..(190): n is a, c, g, or t
  modified_base (233)..(233): a, c, t, g, unknown or other
  misc_feature (233)..(233): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
tcagactactatgtcacgaccggtgctcgatttagtatagacatcagggggtcgagacccagtcaggacacagcatggacatgagggtccccgctcagctcctggggctcctgctgctctggctcccaggtgaccaaatgtgacatccagatgacccagtctccttccaccctgtctgcatctgtagganacagagtcaccatcacttgccgggtccagtcgagtagtgttcngcctggggtggccgtggtatcagcaaggaaaccagggaaactacccctaaatcctgatctataaggctnttatttacgaagtgggtaccttnaaggttcagcgcaggtggatcgtagggacagtaacttcaacgttctacgtaactaacgtacaggtacacggtccctagaccgaacgtccctaggtacgttagttacgttttacgtaaccttaaactttagttaacctacggtaaccctaaacgtaacgttaactaggtaacttcgtaccgttttaccgtaccccgttaaccgtttccgggaaccgtaacggggacctaacggtacgtacgggtactaacgtttaaccggccggtaaacgtcgggtacgtaccgttcggaccgtaccctacgttccgtacgtttaccctactaacccg

SEQ ID NO: 182684 - DNA, 572 bp, Homo sapiens
  misc_feature: GYAE6OF02HWY31.24.75.G09.1.454.CMB.1.raw
  modified_base (268)..(268): a, c, t, g, unknown or other
  misc_feature (268)..(268): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagttgtttctgccgtgggtggcctggtatcagcagaaaccagggaaacnccctaattcctgatctaataaggcgttactattttacaaaggttcgggtaccttagaaggttcagcggcagtggactcgtgggacagaattcactctcacactcagcagcctagccagcctagattgtactttgacctaaacgtttaacttacgtcgacctaacgtagtatgtattacgtacttacctaccccgtacgttacggacccgaaggggaaccacggtactacggaactacgtttaacgacgtaacgtcggtacggtacctcggaccaccgtagttaccgttcgttaccttcctaccc

SEQ ID NO: 182685 - DNA, 527 bp, Homo sapiens
  misc_feature: GYAE6OF02IRO4A.24.75.G09.1.454.CMB.1.raw
  modified_base (228)..(228): a, c, t, g, unknown or other
  misc_feature (228)..(228): n is a, c, g, or t
  modified_base (513)..(513): a, c, t, g, unknown or other
  misc_feature (513)..(513): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgttcngcctgggtgcctggtatcagcaagaaaccagggaaacgcccctaaattcctagatctataggcgttctatttacgaaagtcgggtccttcgaagttcagcggcagtgatcgtagggacagaattcactctacacaatcagcagcctgcagcctgatgtatttgactaacttattacctgacctaacagttatgtatgtacctttacaccccgtacgttccggaccgtaacggggaccctaacggacgtacggactagttaactcgtaacgtgtcgctgccacgtntctcgtccttctac

SEQ ID NO: 182686 - DNA, 585 bp, Homo sapiens
  misc_feature: GYAE6OF02JHSRZ.24.75.G09.1.454.CMB.1.raw
  modified_base (233)..(233): a, c, t, g, unknown or other
  misc_feature (233)..(233): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
tcagactactatgtcacgaccggtgctcgatttagtatagacatcaggggttcagacccagtcaggacacagcatggacatgagggtccccgctcagctccgtggggctcctgctgctctggctcccaggtgccaaatgtgacatccagatgacccagtctccttccacctgtctgcatctgtaggagacagacgtcaccatcacttcggccgggccagtcagtagttgttcngccgtgggtcgctggtatcagcaagaaccgagggaaacaccctaatcctagatctaagtaaggtctacttaatttacgaaaggttcgggtaccttacgtaaggtcagcggcaggtcggatcgtagggacagtaattcgactcacanaactcagcacgtcngacgacgctagattggtatttcgaacttaacgttattacctacgaccctaaatagttaactggtacttacgttacctttaccgcccgttaaccgttccgggaccgaacgggtaccacggtacgtagactagttaacgacggtaagttggtacgcctaggacctacctattccgttacgttctacccgttacg

SEQ ID NO: 182687 - DNA, 599 bp, Homo sapiens
  misc_feature: GYAE6OF02HBNVP.24.75.G09.1.454.CMB.1.raw
  modified_base (230)..(230): a, c, t, g, unknown or other
  misc_feature (230)..(230): n is a, c, g, or t
  modified_base (417)..(417): a, c, t, g, unknown or other
  misc_feature (417)..(417): n is a, c, g, or t
  modified_base (479)..(479): a, c, t, g, unknown or other
  misc_feature (479)..(479): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagtagttgttcngcgttggggtcgcctggtatcgagacaagaaaaccgagggtaaacgtaccccttaaattccgtagactactaagtaacggtcgtacttaattttaacgaaaggttcggggttcccttagaaggtttcaggcggtagacggtggtactcgtgggactaagaattcactctacaacaatcagcagtccngcacgtcctaggatgtatttcgactaactttaagttactacgaccaagtacgttataacgtntacgttaccttaacgtccccgtaacgttccgacggtacgggactacggactacggtactattaacgacgtacgtaggtggtacctcgaccgtactagttaccttcgttactccttaaccg

SEQ ID NO: 182688 - DNA, 495 bp, Homo sapiens
  misc_feature: GYAE6OF02GFR3P.24.75.G09.1.454.CMB.1.raw
  modified_base (229)..(229): a, c, t, g, unknown or other
  misc_feature (229)..(229): n is a, c, g, or t
  modified_base (414)..(414): a, c, t, g, unknown or other
  misc_feature (414)..(414): n is a, c, g, or t
  modified_base (485)..(485): a, c, t, g, unknown or other
  misc_feature (485)..(485): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctgggtggcctggtatcagcagaaaccagggaaagcccctaaattcctgatctataaggcgtctattttacaaagtggggtccttcaaggttcagcggcaggtggatctgggacagaattcactctcacaatcagcagcctgcagcctgatgtattttgctaactttattactgaccctaaanagtatgattgacttactccctaccttcggccagggacacgactggacattaatcgaactgtgctgcacatntctcttctac

SEQ ID NO: 182689 - DNA, 583 bp, Homo sapiens
  misc_feature: GYAE6OF02GVX7Z.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttcgccgggccagtcagtagttgtttctgccgtggggtggcctggtatcagcaagaaaccgagggaaacaccctaaattcctgatctagtaaggcgttacttaatttacgaaggttcgggttacccttacgtaacggttcaggcggctaggtgagtcgtaggacagtaattcactctacacaatcgagcacgcctagcacgcctagatgtatttcactaacttagttactacgtaccaatgtactagtatcgtacttaccacccgtaccgttccggacgtacggaccacgtacgtacggactaagttaacgtacgtaacgttcggtacggtacctacggacctaacccgtagttacccgttcgtttaccgtcgttaccc

SEQ ID NO: 182690 - DNA, 528 bp, Homo sapiens
  misc_feature: GYAE6OF02HS6SI.24.75.G09.1.454.CMB.1.raw
  modified_base (228)..(228): a, c, t, g, unknown or other
  misc_feature (228)..(228): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
  modified_base (523)..(523): a, c, t, g, unknown or other
  misc_feature (523)..(523): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtgtttcngcctgggtgcctggtatcagcaagaaccagggaaacgcccctaaattcctgtactctataaggctactattttacaaagtcggggtcccttgaaggttcagcggcaggtggatcgtggacagaattcactctcaacaatcagcagcctgcagcctgatgtatttgactaacttaattactgaccaacngtatgnttgtacttactacccacgttcggccgaacggggacaacgacgtggacctagttaacgtcgtaacgtggtggtacctgaccgaccacgttctcggttccttntaacc

SEQ ID NO: 182691 - DNA, 603 bp, Homo sapiens
  misc_feature: GYAE6OF02JAX2M.24.75.G09.1.454.CMB.1.raw
  modified_base (187)..(187): a, c, t, g, unknown or other
  misc_feature (187)..(187): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (226)..(226): a, c, t, g, unknown or other
  misc_feature (226)..(226): n is a, c, g, or t
  modified_base (242)..(242): a, c, t, g, unknown or other
  misc_feature (242)..(242): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccacctgtctgcatctgtagganacagagtcaccatcacttgccggccagtcagngtnttcngctgggtgctggtatnagcaagaaaccgaggaaacgcccctaaattcctgtatctaagtaagcgtctatttacaaaggttcgggttacctacgtaaggttcaggtcggcaggtggactacgtagggacaagtacttcactctcaactaatcgagactagcctgcagccgtagacttgtatttacgaccaacgttttactacgtacgtacctaaccgagtttacagttacgtacgttccttacctacccgtacccttacgggaccgtaacggggtacaaccggtacgttacggaaccttaattaacggtaccggtaaacgttggtacgggtaacctcggtacctaacccgattcccgttcggttaccttacccgttcg

SEQ ID NO: 182692 - DNA, 598 bp, Homo sapiens
  misc_feature: GYAE6OF02JI5YT.24.75.G09.1.454.CMB.1.raw
  modified_base (228)..(228): a, c, t, g, unknown or other
  misc_feature (228)..(228): n is a, c, g, or t
  modified_base (341)..(341): a, c, t, g, unknown or other
  misc_feature (341)..(341): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggccagtcagagttgttcngccgtgggtcggcctggtatcgagcaaggaaccgagggaacgacccctaattcctgatctatagctctaatttacgaaggtcgggtccttagaggttcaggcgcagtgatcgnggacagattcactctacacatcagtcacgcctgaccgacgtccgtagtattagttatttcgaccttaaactttacgttaccgttacgaaccctaaagtagttatagtacttacgtacctttaccgtcccgttaccgttcgggaccgaacggggtaccacggtacgtacggtaacttaacgttacgttaccggtaacgttcggtacgtacgttacggaccctaaccttacgttcccgtttacgttaccttacttaccg

SEQ ID NO: 182693 - DNA, 787 bp, Homo sapiens
  misc_feature: GYAE6OF02JSMRL.24.75.G09.1.454.CMB.1.raw
  modified_base (124)..(124): a, c, t, g, unknown or other
  misc_feature (124)..(124): n is a, c, g, or t
  modified_base (129)..(129): a, c, t, g, unknown or other
  misc_feature (129)..(129): n is a, c, g, or t
  modified_base (238)..(238): a, c, t, g, unknown or other
  misc_feature (238)..(238): n is a, c, g, or t
  modified_base (453)..(453): a, c, t, g, unknown or other
  misc_feature (453)..(453): n is a, c, g, or t
tcagactactatgtcacgaccggtgctcgatttagtatagacatcaggggtcagaccagtcaggacacagcatggacatgagggtcccgctcagctcctggggctcctgctgctctggctcccnggtcnccaaatgtgacatccagatcgacccagtctccttccaccctgtctgctacttcgcgtaggagtacagacgtccaccatcacgttcgccggtcagtcagtagttcgttcngccgtgggtcgacgtggtactcgagtcaaggtaacccgaggaaccgtacctaacgtcctagtactacgtaacgtaacggtcgtactttaactttaaccgaaaggtccgggttaccttacgaacggtttcgaacgtccgggacgtaggtgtacgttgtcgggaactaggtaactcgtacgtacctacgaacaacttacgacgtacacggtccgtanccgtacgtcccgtagtaacgttggttacctttaggtaacccttttaacgtaaccgtttacgttaaccgtacccgaaaggttaaaccttttagtaccgtaaaggttatttaaccccgggttaaccttttcccccggtaaacccggtttaccggggtacccgggtaaaaccggggtccctaaaacgggtaccccgttaacgggtttacccgaacggttttttaacccgtaaaccggggttaacgttttacgggggaccgtaccggtttaacccggtacccttaacgttaccccggtttttaactccgggttttaacccttccgggttttaaccccc

SEQ ID NO: 182694 - DNA, 781 bp, Homo sapiens
  misc_feature: GYAE6OF02HDLPC.24.75.G09.1.454.CMB.1.raw
  modified_base (235)..(235): a, c, t, g, unknown or other
  misc_feature (235)..(235): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcacgttcggccggccagtcagtacgttgtttcngccgtgggtcggtccttggtatcgagacaacggaaaccgaagggaaacgtaccccttaaattcctagtacttactaagtaacggtccgttacttaacgttttaacgaaacggtttccggggttaccccttacggtaacgggtttaccgaacggtccgggtacgtaagggtcggtacgttacgggtagggtaaccgtaaggtaaacgtttccgtaacgttccgttaacaaccgtaacgttaccgaacgtccgtaacgtcccgtggaccgtaaccgtccgttaggtacttacggttacgtttacgaacctttaacgtttaacgtttaaccgtacgtaaccctaaagtacgtttaatacggttacttacggttacctttaccctaccccgtacccggtttaccgggacccggttaacggggacctaacggtaaccgttacgggtaaccttaacgttaacggtaaccggttaacggtttcgggtaccggtacgttaccggtaaccgttacccgtaacgtttcccgttacgtttcccgttaccttacccgg

SEQ ID NO: 182695 - DNA, 553 bp, Homo sapiens
  misc_feature: GYAE6OF02GMRV4.24.75.G09.1.454.CMB.1.raw
  modified_base (229)..(229): a, c, t, g, unknown or other
  misc_feature (229)..(229): n is a, c, g, or t
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttcngcctgggtgcctggtatcagcagaaaccagggaaanccctaaatcctgatctataagcgtacttaatttacgaaaggtcgggtcccttgaaggttcagcggcagtgatcgtgggacagatcatctacanaatcagcagcctgcagcctgatgtatttcgactaactttattactcgtacccaaactagtaatgtattcgtacctttactccccgtaaccgtttccgggaccgtaacggggaacctaacggaacgtaggacctaagttaacgtcggtaaacttggtaggtcctgaccacctagttcgttacgttaccttgtaccc

SEQ ID NO: 182696 - DNA, 563 bp, Homo sapiens
  misc_feature: GYAE6OF02FVOWE.24.75.G09.1.454.CMB.1.raw
  modified_base (218)..(218): a, c, t, g, unknown or other
  misc_feature (218)..(218): n is a, c, g, or t
  modified_base (397)..(397): a, c, t, g, unknown or other
  misc_feature (397)..(397): n is a, c, g, or t
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtctccttccaccctgtctgcatctgtaggagacagagtcaccatcacttgccgggccagtcagagttgtttcngcctgggtggcctggtatcagcagaaaccagggaaacgcccctaaattcctgatctataaggcgtacttatttacaagtgggtcccttgaaggttcagcgacaggtgatctagggacagaattcactctacacaatcagcacgcctgcagtcctgatgtattttgactaacttattacngtaccaacgagttactagtattgtaccttactccctaacccgtttcgggaccgtacggggacctaccgtacgtacggaactattaaacgtcgaacgttgtcggacgttgacctacgtacgttcttacggttccttaccgtacttcccgtttccccacctattaccg

SEQ ID NO: 182697 - DNA, 809 bp, Homo sapiens
  misc_feature: GYAE6OF02IKUDH.24.75.G09.1.454.CMB.1.raw
  modified_base (234)..(234): a, c, t, g, unknown or other
  misc_feature (234)..(234): n is a, c, g, or t
tcagactactatgtcacgaccggtgctcgatttagtatagacatcaggggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtccaccatccacttggccgggccagtcagtagttgttcnggtccgtggggtggccgtggtactcgaggacaaacggaaaacccgaaggggaaaaccgtacccccttaaaaactttcccgtaagtactaaccgttaagttaaaaccggggtccgttaactttaacgtttttaaaccaaaaggggtttcggggggttacccccttttaacggtaaacgggttttccgaacgggtccggggtaccgaagggttagggtaagttcccgggttaagggggaacctaaggtaaaacgtttccgtaaccttccgttaacaaacctaaattcccgaaacggtaccaacggtcccttacgggccctaacgggtaccccgtaggtaacgttcggtttaaacgttttacgggtaaccttaaactttaaacgtttaacccgtacggtaacctaaaccgttagttaacgtacgtaattcgtaaccgtttctaccccgtaaccgtttaccgggacccgtaagggggacctaacgggtacgtacgggtacctaattaacggtaaccgtaagttcgggtacggtactacgggtccctaccgtacgttccgttacgttaccttactacccg

SEQ ID NO: 182698 - DNA, 707 bp, Homo sapiens
  misc_feature: GYAE6OF02FR6GY.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagttgtttctgccgtgggtcggcctggtatcgagacaagaaaccgaagggaaacgtacccctaaattcctagactactagtaaggccgttacttaacgtttaacgaaaggttcggggttacccttacgtaacggttcgaggtccggcgtaggttaggtacgtcgtagggacagtaacttcacttacctactaactaactcacgacgacgtcctagacctaagtccgttagagttgttaacttttcggaccttaaactttaacgttaccgtaccgtaaccctaaacggtagttaacgtagtacttacgtaacccttttaccgtaccccctttaaccgggttcccgggaccgtaaaccgggggtacctaaccggtacgttaaccgggtaacctaacggttttaaaccgtacgggtaacgtttccgggttacggacgttaccgtaccctacgttaacgtttaccggttcgtttacccttacgttaccccg

SEQ ID NO: 182699 - DNA, 648 bp, Homo sapiens
  misc_feature: GYAE6OF02FVEES.24.75.G09.1.454.CMB.1.raw
  modified_base (263)..(263): a, c, t, g, unknown or other
  misc_feature (263)..(263): n is a, c, g, or t
  modified_base (541)..(541): a, c, t, g, unknown or other
  misc_feature (541)..(541): n is a, c, g, or t
tcagactactatgtcacgaccggtgctcgatttagtatagacatctagggggttcgagacccgagtcgaggacaccagcctagtggtaccatgagggtccccgcctcaggctcctggggctcctgactgactctggctcccaggtgcctaaagtgtgacatccgtagtatgaccctagttacgtccttccacctgtcctggcatctgtaggagacgaggagtcaccgatcgaccggttcgccgggaccagtcagtagtgttcngcctgggtgctggtatctagctagaaacctagggaactaccccttaaattcccgtaggtactccgtaagtaacggtcgtaccgttaagtttacgaaagggttcggggttcccttacgtaacgggttccaggtaccggaactaacgttggaactacggtacgggaccaagtaaactttcaacttctacgactaacgtcgaacgacgagccgtgaccagtccctagatgtatttcgactaacttatacgtacgaccgaatagtctagatacgtacttacnccccgtaccgttaccggaaccgacggggacaccggtacgtagtactacttaacgtcgtaactggtacgtactcggtacctacgtacttcttcgttacttcgtacccg

SEQ ID NO: 182700 - DNA, 634 bp, Homo sapiens
  misc_feature: GYAE6OF02FL5AQ.24.75.G09.1.454.CMB.1.raw
  modified_base (232)..(232): a, c, t, g, unknown or other
  misc_feature (232)..(232): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttcgccgggccagtcagagttgtttcngccgtgggtgcctggtatcgagcaagaaaccgagggaaacgacccctaaacttcctagtatctaagtaacggtcgttacttaattttaacgaaacggttcggggttacccttacgtaacggttcacggtcggcgtaggtgagtcgtagggacagtaattcactctacacaactcacgcacgcctgacgacgtcctagtatgttactttcgacttaactttacttacctacgtaacctaagtacgttaatgtaacttcgtacctttacctaccccgtaccggttccggaccggaacggggtaacctaccggtacgtacggtaactaacgttacgtaaccggtaacgttgggtaccggtactccggacctaccgttacgttccgtccgtttacgtcttaccccg

SEQ ID NO: 182701 - DNA, 591 bp, Homo sapiens
  misc_feature: GYAE6OF02FPDKY.24.75.G09.1.454.CMB.1.raw
  modified_base (188)..(188): a, c, t, g, unknown or other
  misc_feature (188)..(188): n is a, c, g, or t
  modified_base (355)..(355): a, c, t, g, unknown or other
  misc_feature (355)..(355): n is a, c, g, or t
  modified_base (398)..(398): a, c, t, g, unknown or other
  misc_feature (398)..(398): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttcgccgggccagtcagagttgtttctgccgtggggtgccgtggtatcagcaagaaaccgaggaacgacccttaattccctgtatcgtaataggcgtacttaatttacgaaaggttcgggtccttacgaaggttcagcggctagtgatcgnggacagtatcactctacactatcagcagcctgacctagtcgtntacgtgttatttcgacgtaactttagttaactcgtaaccgtaagtagtacttggacttcgtacctttactccccgtacgttccgaccgaacggggtactaaccggtactacgggtacctagttaacgtaccggtaacgttcgggtaccgtcgttacggacctacgttacttaccggtctttaccttctacccg

SEQ ID NO: 182702 - DNA, 554 bp, Homo sapiens
  misc_feature: GYAE6OF02FVD7B.24.75.G09.1.454.CMB.1.raw
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
  modified_base (269)..(269): a, c, t, g, unknown or other
  misc_feature (269)..(269): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttggccgggccagtcagtagtcgtttcngcctgggtggcctggtatcagcagaaccgaggaaacncccctaaattccagatctatacggcttactattttaacgaagtcggggtccttgaacggttcagcgacagtgtatcgtggacagtaacttcactcgtacactaactcacgcacgtctgcagccctagatcgtatttcgacctaattacttacgcgtaccaagagttatagtactgtccttacgtcccctacgttccggacgtacgggacacggtactacgaccgttataacgtacgaacgttggacggttctacgtcacttaaccgtcttacgttctcttacccg

SEQ ID NO: 182703 - DNA, 480 bp, Homo sapiens
  misc_feature: GYAE6OF02JBOIU.24.75.G09.1.454.CMB.1.raw
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
  modified_base (399)..(399): a, c, t, g, unknown or other
  misc_feature (399)..(399): n is a, c, g, or t
  modified_base (476)..(476): a, c, t, g, unknown or other
  misc_feature (476)..(476): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagagtcaccatcacttgccgggccagtcagagtgtttcngcctggtgcctggtatcagcagaaaccaggaaancccctaaattcctgatctataggctctatttacaaagtcggtccttcaaggttcagcggcagtggatctgggacagattcactctcacaatcaagcagcctgcagcctgatgatttgactaacttatctgccaangtatgatgcttactcctacttcggacagggcacgactgacattaacgcgaactgtgctgactacgcttcgtagtctntacc

SEQ ID NO: 182704 - DNA, 570 bp, Homo sapiens
  misc_feature: GYAE6OF02HES2E.24.75.G09.1.454.CMB.1.raw
  modified_base (226)..(226): a, c, t, g, unknown or other
  misc_feature (226)..(226): n is a, c, g, or t
  modified_base (316)..(316): a, c, t, g, unknown or other
  misc_feature (316)..(316): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttgccgggcagtcagagtgttcngcctgggtggcctggtatcagcagaaaccagggaacgacccctaaattcctgatctataacggcgtctatttacaaaggtgggtcccttnacggttcagcggcagtggatcgtgggacagtaattcactctacacaactcagcacgcctgcagcctagacttgtatttcgactaacttagttactcgaccaagtgttatggattggtacctttactccccgttaccgttccgggaccgtaaggggaccctaacgggacgttacgggacttaacgttaacgtacgtaaacgttcggttacgggccttacgacccgtactacgttcctcgttacttccttaacccg

SEQ ID NO: 182705 - DNA, 742 bp, Homo sapiens
  misc_feature: GYAE6OF02HNI03.24.75.G09.1.454.CMB.1.raw
tcagactactatgtcacgaccggtgctcgatttagtatagacatcagggggtcagacccagtcaggacacagcatggacatggagggtccccgctcagctcctggggctcctgctgctctggctccaggtgccaaatgtgacatccagatgacccagtctccttccacctgtctgcatcgtgtaggagacagacgtcaccatcctacgttcggcccgggacctaagtccaggtagtttcgtttcgtacggtccggttggggtcggtccgttaggtaactcgagacgaacgtaaaccgaagggaaacctaccctaaacgttcctagaacttacgtagtaaggtcgtaactttaagttttaacgaaacggttccggggtttacccttacgtaaaggtttccgacggtacggtaccgtaggttacggtaacgttccggtacggggtaaccgtaagttaaaccgtttaccgaaccgttaccgttaacgtaaaccttaaacgttaaccacggtaccgtaaccgtaccgtacggtaccgaagtacccggtagtaacttgttaacgttacgaactttaaactttacgttaaccgcgaacctaacgtagtactactatcgtaccttacgtacccgtaccgtaccgaccggagggtaaccaacgtacgtacggtaactaagttaacggtaacgtacggtacggtacggtccacggtacctaaccgttacgtcttacggttcttacctaccg

SEQ ID NO: 182706 - DNA, 724 bp, Homo sapiens
  misc_feature: GYAE6OF02IMLY9.24.75.G09.1.454.CMB.1.raw
tcagactactatgtcacgaccggtgctcgatttagtatagacatcagggggtcagacccagtcaggacacagcatggacatgagggtccccgctcagctcctggggctccctgctgctctggctcccaggtgccaaatgtgacatccagatgacccagtctccttccaccctgtctgcatctgtaggagacagagtcaccatctacttcggcccgggcagtacagtagttcgtttctcgccgttgggggtcggtccgttggtactcgacggaccaacgaaaacccgaaggggaaaccgtacccccttaaagttcccgtagtaacttcgtaagtaacggtccgttacttaacgttttaacgaaacgggttcggggttacccttacgtaacgggttcgacggcggtacgaggtcggtacgtacggtagggaactaacgtaagttcctaaccgttccgtaaccaacctaacgtaccgaacggacctaacggtcccgtcggaaccgtaacgtccccggtttaaggacgtttacggttaacttttacgaacctttaaaccttttattaaccgtaccgtaaccctaaacgtacgtttaatacggtacttagttaccctttaccgtaccccttacgggttccgaccggtaagggacctacggtactaggtactaatttacgcgttaacgtggtacgactccgtaccacttacttcgtccgttctctacccg

SEQ ID NO: 182707 - DNA, 692 bp, Homo sapiens
  misc_feature: GYAE6OF02IM6TG.24.75.G09.1.454.CMB.1.raw
tcagactactatgtcacgaccggtgctcgatttagtatagacatcagggggtcagacccagtcaggacacagcatggacatgagggtccccgctcagctccgtggggctccctgctgctctggctcccaggtgccaaatgtgacatccagatgacccagtcctcccttccaccctgtctgcatctgtaggagacagacgtcaccatcacttcggccgggccagtcagtagttgttctggtccgtgggtcggcgtggtatcagacaacgaaacgagggaaacctacccttaaattcctgatactaagtaacggtcgttacttaatttaacgaaaggttcgggttaccctacgtaggttacaggtcggacgtaggtggtactcgtagggactagtaacttctactcgaactaactaactcgaacgcgtacgccgtcggacacggtacctagtaagtttacgttatttacgtaaaccttaaactttaccgttaacgtccgtaaccgtaaagttacgttaacgtagtagttaccgttacctttaccgtacccccgttacgggttacccggaccgggaaccggggtacctaacggtaccgtaacgtaactttaaaggttaccggttaacggaaccgttgggtaacggcccttacggtacctaccgttaacttcgtttaacccgtttctaccgtaccg

SEQ ID NO: 182708 - DNA, 724 bp, Homo sapiens
  misc_feature: GYAE6OF02IGSI8.24.75.G09.1.454.CMB.1.raw
  modified_base (234)..(234): a, c, t, g, unknown or other
  misc_feature (234)..(234): n is a, c, g, or t
  modified_base (276)..(276): a, c, t, g, unknown or other
  misc_feature (276)..(276): n is a, c, g, or t
  modified_base (515)..(515): a, c, t, g, unknown or other
  misc_feature (515)..(515): n is a, c, g, or t
tcagactactatgtcacgaccggtgctcgatttagtatagacatcagggggtcagacccagtcaggacacagcatggacatgagggtccccgctcagctcctgggggctcctgctgctctggctcccaggtgccaaatgtgacatccagatgacccagtctccttccaccctgtctgcatctgtaggagacagacgtcaccatcacttcggccgggccagtcagagttgtttcngccgtggggtcgcctggtatcagcaagaaaccgagggaaacnccctaaattcctagatacgtaagtaacggcttacttaatttaacgaaaggttcggggttacccttagaacggttcaggcggcgaggtcggtatcgtagggactagtaacgtttcacttcgtacaactaactcgacgcgaacgtccctggacctacgtcccgtaggtacttaggttaacttttcggaacctttaaacgtttaacttttaaccgtccgtaacccgtaaaattacggtttanacggtaacttcgttaacctttacccgttacccccgttaccggtttacccggggaaccggtaaacgggggtaaccctaaccggtaaccgttaggtaaacccgttaagttttaaaccggtccggtaaaccgtttcggggtacgggttaccctaacgggtaccctaaccgtttaccgtacggtttaccgtttcccttaccgtttaaccccgg

SEQ ID NO: 182709 - DNA, 699 bp, Homo sapiens
  misc_feature: GYAE6OF02H5YO5.24.75.G09.1.454.CMB.1.raw
  modified_base (158)..(158): a, c, t, g, unknown or other
  misc_feature (158)..(158): n is a, c, g, or t
  modified_base (241)..(241): a, c, t, g, unknown or other
  misc_feature (241)..(241): n is a, c, g, or t
tcagactactatgtcacgaccggtgctcgatttagtatagacatcagggggtcagacccagtcaggacacagcatggacatgagggtccccgctcagctcctggggctcctgctgctctggctcccagggtgccaaagtgtgacatccagatgacccngtcctcccttccaccctgtctgcatcgtggtagagacagacgtcaccatctacgttcggccggctagtcgagtagttcgttcncggtacggtgggtcggtccttggtactacgagaccgaacgaaaccggaagggtaaaccgtacccctaattaccgtagacttaactaagtaacggtaccttacttttaacgttttaaacggaaacgggtttcccggggttaccctttacggaaacgggtttccaacgggcggacgtagggtacgtacgttacggtagggacgtaaacgtactttaccgacttccgtactaacagtacacgtcacgtcgacgccacgtacgtagtacgttagttagttacgtactaacgtttataccgtacgtaacagtacgtatacggttactcttaaccttaccgttacccgtaccgtcccggaaccggtacggtaacgaccgtaacgtagtacgagttttaccgacggtacgtacggtacgtacgtacgtacctacgtaccgttcgtaccgttaccttcgttacccg

SEQ ID NO: 182710 - DNA, 1026 bp, Homo sapiens
  misc_feature: GYAE6OF02G2PXR.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgaccctagtctccttccaccctgtctgcatctgtaggagacagagtcaccatcacgttgccgggccagtcagagttcgtttcgtcggtccgtggggtcggtcccgttggtatacgacgtaccgaaaggaaaacccgaaacggggaaaaccgtaccccccgttaaaactttacccgtacggtaactttaccgttaaacggttaaacgggtaccggttttaacccgtttaaacgttttttaaaccggttaaaaacggggtttccggggggttttaaccccccttttaacggttaaaacggggtttacccgtaacggggtacccgggtccgtaaacggggttacgggtacggttaccggtaacggggggtaccttaaaacgggtttaactttacccgtaacgttaccttaacccgtaaacctaaaccgttacctaaccggtaccgtaccggtacccgttaacgggccccgtaacggtaccccgttaagggtaacgtttaacgtttaccgtttttaacggaacccttttaaaaccgtttttaacgtttaaccgttaacccggttaaacccgtaaaaccgttaacgttacgtttaacggtaacgtttaccgtttaccgttttacccccttaaccccccgggtttaacccggtttaccccgggggtaaccccgtttaaaccggggggaaaaccccggttaaccggggtaaacccgggtttacgggtaaaccccgtttaaaggttttaaaacccgggttacccgggttaaaaccggtttcggggttaaccggtacccggtttaaccggaccccggttaacccgttaacccggttttacccgtttacccgggttttccccttttaacccggtttaaccccccgg

SEQ ID NO: 182711 - DNA, 558 bp, Homo sapiens
  misc_feature: GYAE6OF02F9L32.24.75.G09.1.454.CMB.1.raw
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtgttcngccgtgggtcggcctggtatcagcaagaaaccgagggaaacncccctaaattcctagactctagtaggcgtacttatttacgaaaggttcggggtacccttcgaaggttcaggcggcaggtggatcgtgggactagtacttcacttctacaacaattcacgcacgtcctagcacgtctgtatgtatttagctaaattacttaactcgacctaactagtatgtatgtacttactccctaccgttacggaccgtagggaccacgtactacggactagtaacgtcgtaacgtggtcgtacgtacgacctacctacgtctcggttctacgttaccg

SEQ ID NO: 182712 - DNA, 717 bp, Homo sapiens
  misc_feature: GYAE6OF02I3I9W.24.75.G09.1.454.CMB.1.raw
  modified_base (254)..(254): a, c, t, g, unknown or other
  misc_feature (254)..(254): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtccacatcacttcggccggccagtcagagttgttctgccgtgggtggccgtggtatcganacgaagaaaccgaggaacgtacccctaaagtcctagactactaagtaaggtcgtacttaacgtttaacgaaaggttcgggtacccttacgtaaggttacaggccggtagaggtggtaactcgtagggaaccaaggtaacttcaacttcctactaacctaagtacgaccgtacgtacgacccttacgaccgtaccgtccgtaggtactttaggttagttttaaccggaccttaaaccggttttaactttaaaccgttaccgtaaacccgtaaacgtaacgttaactaacggttagttaacgttaccgtttacccgttacccccgttaacccggttttacccggaccgggttaaacggggaacccgtaaccggtacgttaaccgacttaaccgtttaacgtaaccggttaacgttacggttcgacttacggacctacgtacctacgttccttcttaccttacccg

SEQ ID NO: 182713 - DNA, 674 bp, Homo sapiens
  misc_feature: GYAE6OF02HH84P.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcacctatcacgttcgcccgggcagtacgagagttgttctgtccgtgggtgccgtggtatcagcacgaaaccgaggaaacgtacccgtaaattcctgtactctaagtaacggcgttacttaattttaacgaaggttcgggttacccttacgtaacggttcgacggtccggcgtaggtacggtagtcgtagggaactaggtaacttaccgtacctacgtaccaacctaaactaccgacgtaccgaacgtcccgtcggaccgaccggttaccctaggtaacttgttaacgtttttcgaacctttaaacgtttatttacccgtagacccttaaaacgtgttaaccgtgggtaacttccggttaacctttacccgttacccgtcccggttaccggaaccgggtacggactaccgtaacgcggtaactataacgcggtaacgttggcgtatccgaacgtcctattcggttacttccttatacccg

SEQ ID NO: 182714 - DNA, 673 bp, Homo sapiens
  misc_feature: GYAE6OF02HSX49.24.75.G09.1.454.CMB.1.raw
  modified_base (228)..(228): a, c, t, g, unknown or other
  misc_feature (228)..(228): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgaccagtcctcccttccaccctgtctgcatctgtaggagacagatcacatcacttcgccggcagtcagagttgttcncggtccgtggggtcgtaccgtggtatcagacaacgaaaaccgaagggaaacctaccccttaaattcctagactactaacgtaaggtcgttacttaattttaacgaaaggttccggggttaccttacgtaaggttcgaggccggagtaggtaggtatacgtagggaactaagtaacttcaacctctacaaactaacgtcgaacgccgtaacgtcctacgacgacgtctagtattcgttaagtttacgaactttaaacttacgttaccgtacgaacctaacgtagttacgtagtaacgttccgttaaccttacccgttacccctaccggtttaccgggaccggtaacgggaaccaacgtacgtacggtaactacgtttaacaccggtaagttcggacgttaccgacgacccgtactactttcgttaccgttacttaccgttaacccg

SEQ ID NO: 182715 - DNA, 620 bp, Homo sapiens
  misc_feature: GYAE6OF02FVR4P.24.75.G09.1.454.CMB.1.raw
  modified_base (227)..(227): a, c, t, g, unknown or other
  misc_feature (227)..(227): n is a, c, g, or t
  modified_base (400)..(400): a, c, t, g, unknown or other
  misc_feature (400)..(400): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggagacagacgtcacatcacttgccggcagtcagagtgttcngccgtgggtcgcctggtatcagcagaaaccgagggaacacccttaaattcctagtactctaagtaaggtccttacttaatttaacgaaaggttcggggttcccttacgtaaggttcgaacggtcggctaggtggtatcgtggaacagtaacttcacgtctacactaactcgancgagccctagcctaacgcctagacgttgtagtttcgaacctaactttattaccgtcgtaacctaacgtaacgttagtacgtaagttcgttaccttaccgtcccctacggttacccggcggtaaccgggccaacggtacgtacgtaacttaagttaaccgtacgtaacgtcggtcgtacgtccgacctaccttcgttacgtaccggtttctaccttacccg

SEQ ID NO: 182716 - DNA, 773 bp, Homo sapiens
  misc_feature: GYAE6OF02H4PJ3.24.75.G09.1.454.CMB.1.raw
  modified_base (158)..(158): a, c, t, g, unknown or other
  misc_feature (158)..(158): n is a, c, g, or t
tcagactactatgtcacgaccggtgctcgatttagtatagacatcagggggtcagaccagtcaggacacagcatggacatgacgggtcccgctcagctccgtcggggctcctgctcgctctcggctccgaggtccccccccccccccccccccccganaaatgtgacactcagactacgacctacgtcctccttcctacctcgtctcgctacttcgtgtaggacgacagacgtacacctactctacgttcggtaccgggacctacgtacgacgtagttcgtttcgtcgtccggttcggggtcggtcccgttaggttacgtccgaacggaccaaacggaaaaccgaacggggaaacggtaaccccttaaacttaccctacggaacttactaaacgtaacggacgttacgttaacttttaacgtaaacgggttcggggttcccttacgtaacggttcgtaggtacggacgtaggtcggtatcggtacgggactaacggtaacttacgtaactactactaaacgttaactacgaactacgacgtaccttcggacacgggtaccttcggtaattcgggtactttaacggtccttaaaacttttacgttaaacgtttcgaaccgttaaacgtagtttattaacgggcttacggtacctttacctacccgtacgttaccgacggtaacgggcctaaggtcgttacgacgttaacttaaacggtccgaacgttgtacgggaccttaggacctactgttaccgtttctacggttctaaccc

SEQ ID NO: 182717 - DNA, 978 bp, Homo sapiens
  misc_feature: GYAE6OF02F6L58.24.75.G09.1.454.CMB.1.raw
tcagactactatgtcacgaccggtgctcgatttagtatagacatcaggggttcagacccagtcaggacacagcatggacatgagggtccccgctcagctcctggggctcctgctgctctggctcccaggtgccaaatgtgacatccagatcgacccagtctccttccaccctgtctgcatctgtaggagacagagtcaccatcacgttcggcccgggccagtcagtagttgtttcgtgtccgtggggtcggtccgtggtatcgagacgaacggaaaaccgagggaaacctaccccttaaattccgtagtactacgtaagtaacggtcgttactttaagtttaacgtaaacgggtttccggggttaccctttacggtaaacggtttccgaacgggtccggtacgtaggttacggtaacgttcggtaagggggtaacctaaggtttaaacctttaccgtaaccgttccgttaaccgaaaaccttaaaccggttaccgaaacgggtaccgtaacgggtccccgttacgggacccgtaaccggttaccgtttacgggtaaacgttttacggtttaacgtttttaaccggtaaacccgttttaaaaacccgttttacgttttaaacccggtacccgttaaaccccggttaaaaccggttaaggttttaaaccgtacggggttaaacttttacccgggttaaacccttttttaaaccccccggttaaccccccggggtttaaccccgggtttaaccccgggggtaaaaccccgggggtaacccggggggttaaaccccgttaaacccggggtttaacccgggttaaccggggttaaaacccttttaaacgggtttaacccggtttaaacccggggttaaccggttttacggggtaacccggttacggtttaaccccgtacccgttaacccggtttacgtttaccccggttttacggttttaccccttacccgttttaacccccg

SEQ ID NO: 182718 - DNA, 602 bp, Homo sapiens
  misc_feature: GYAE6OF02H9E4U.24.75.G09.1.454.CMB.1.raw
  modified_base (230)..(230): a, c, t, g, unknown or other
  misc_feature (230)..(230): n is a, c, g, or t
  modified_base (272)..(272): a, c, t, g, unknown or other
  misc_feature (272)..(272): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttcgccgggcagtcagagttgttcngtccgtggtgctagttggtatcgagcaagaacgaaggaaccncccttaaattcctagatacttaagtaaggtcttattatttaacgaaggttcgggttaccctgtaaggttcaggcgcgaggtaggtatcggtaggactagtaacttcgactctacaacctaatcgacgacacgtccgtgaccgtagtccgtagtactgtttaatttcaacgtttaacttacttacgtcgaacctaagtagtagtcgtattcgtacttacccgtcccgtaccgttaccggaccgacggtaacacgtacgtacgtaactaagttaccgtaacgtacgtggttacgccgttcgaccttaccgtagttccttaccgttcttaccg

SEQ ID NO: 182719 - DNA, 653 bp, Homo sapiens
  misc_feature: GYAE6OF02HYEYO.24.75.G09.1.454.CMB.1.raw
  modified_base (273)..(273): a, c, t, g, unknown or other
  misc_feature (273)..(273): n is a, c, g, or t
  modified_base (544)..(544): a, c, t, g, unknown or other
  misc_feature (544)..(544): n is a, c, g, or t
  modified_base (563)..(563): a, c, t, g, unknown or other
  misc_feature (563)..(563): n is a, c, g, or t
  modified_base (596)..(596): a, c, t, g, unknown or other
  misc_feature (596)..(596): n is a, c, g, or t
  modified_base (612)..(612): a, c, t, g, unknown or other
  misc_feature (612)..(612): n is a, c, g, or t
  modified_base (623)..(623): a, c, t, g, unknown or other
  misc_feature (623)..(623): n is a, c, g, or t
  modified_base (629)..(629): a, c, t, g, unknown or other
  misc_feature (629)..(629): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtcgccaaatgtgacattccagatcgacccagttccttcccttccctaccctgtctcgactatctgtaggagacagatccaccatctacttcggaccggccaggtcaggtagttcgtttcgagcggtgggtcgtccgtaggtacnctagacgaacggaaaccgagggaaacccgtaccccttaagttccgtagaattacgttaacgtacggtacttacctttaaacgtttaacgtaacgggtccgggttcccttagtaacggttcgagcggtactaggtacggtactcggtacgggactaagtacgttaccacgtactcctaaacagtaccgacggaccacggtaccgtgacccgagtctaggtacttagtttacttccgaacttaacgttacttacgtacgaactaacgattagntaactcgttaaccttaccncccgtacggtcgaccgtagtaaacgccttaagntaactacgtacgtcgnggtcgcgtacncgtacnccgttagttcctctactccgtacc

SEQ ID NO: 182720 - DNA, 724 bp, Homo sapiens
  misc_feature: GYAE6OF02JQN2N.24.75.G09.1.454.CMB.1.raw
  modified_base (131)..(131): a, c, t, g, unknown or other
  misc_feature (131)..(131): n is a, c, g, or t
  modified_base (236)..(236): a, c, t, g, unknown or other
  misc_feature (236)..(236): n is a, c, g, or t
tcagactactatgtcacgaccggtgctcgatttagtatagacatcagggggtcagacccagtcaggacacagcatggacatgagggtccccgctcagctccgtggggctcctgctgctctggctccaggtnccaaatgtgacatccagatgacccagtctccttccacctgtctgcatctagtaggagacagacgtccacctatcacgttcggccgggccagtcagtagttgttcnggtccgttgggtcgtccgttggtatacgaggtcaaacggaaaccggaacgggtaaaacctaccccgttaaaattcccgtagtacgttaacgttaacgttaaacggtccgtttaactttaacgttttaaccggaaacgggttttccggggttaccccttacggtaaacggtttccgaacggtcggtacgtaggtacggtaactcgggtaagggaacctaagtaacttcgtaaccttcgtacgaaacctaagtcaacgtcacgtactcggactacgtaccgtagtacttagttactttacgactttaacgttacttacgtacgtaaccgtaattaggttacctaggttacgtccgttaaccttacccgtcccgttaacccggttaccggacgggtaacggtaccgtaacgtaccgttagtaccttaaggttaaccgtcgtaagttcggtacgtaccgtactacctaacgtcttacggtcttactacgtcc

SEQ ID NO: 182721 - DNA, 677 bp, Homo sapiens
  misc_feature: GYAE6OF02GIJBP.24.75.G09.1.454.CMB.1.raw
  modified_base (493)..(493): a, c, t, g, unknown or other
  misc_feature (493)..(493): n is a, c, g, or t
  modified_base (533)..(533): a, c, t, g, unknown or other
  misc_feature (533)..(533): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtcctccttccaccctgtctgcatctgtaggacgacagagtcaccatcacttcggccgggccagtcagtgttgtttcgtgtccgtggggtcggtccgtggtactcagacaacggaaaccgaacgggaaaccgtaccccttaaacttaccgtagtacttacgttaacgtaacggtcgttacttaacgttttaacgtaaacggttccggggttacccgtttacgtaacggtttacgaggtcggacgtaggtaggtagtacggtagggaatacggtaacttactactactacaacaactacacgcacgtctcgaccacgtcctagtattggttaactttntaacgttaactttattaccgtcgtaactaacttatacgtntacgttcgttaccctttaccgtcccctaccggttccgggaccggtaagggtaccgacgttacgacgtactaacggttaacttccggtaacgtcgggtacggtactcgtacctaccgtacttccgttcgttcccttacgtacccg

SEQ ID NO: 182722 - DNA, 615 bp, Homo sapiens
  misc_feature: GYAE6OF02GE0VQ.24.75.G09.1.454.CMB.1.raw
  modified_base (188)..(188): a, c, t, g, unknown or other
  misc_feature (188)..(188): n is a, c, g, or t
  modified_base (253)..(253): a, c, t, g, unknown or other
  misc_feature (253)..(253): n is a, c, g, or t
  modified_base (412)..(412): a, c, t, g, unknown or other
  misc_feature (412)..(412): n is a, c, g, or t
tcagactactatgtcacgaccggtgctcgatttagtatagacatcagggggtcagacccagtcaggacacagcatggacatgaggtccccgctcagctcctggggctcctgctgctctggctcccaggtgccaaatgtgacatccagatgacccagtctccttccaccctgtctgccatctgtagganacagagtcaccgatctacgttcgccgggcctagtcaggtagttgttctgcgtagggtgccgtggntccgagtcagaaccgaggaacgaccctaacttactgatcctataacgcgttactaactttacgtaaacggtcggggtaccttcaaacgggtttcacggacggtctaggttcgaagttcgaggttacgataacgttcgactcgtacacgtactacacgancgtcctagcgtaagcctcgatacgtatttcgaccgttaacttacttactacgtacctaaacgacgttatacggtactggtactccgtttaacctcccggttagttacccggtaacggacggtaccgcgtacgttacgacgttaacgtagaccgttggtaccgtcgtacgcgaaccttcggtacctcggtttctacgttacccg

SEQ ID NO: 182723 - DNA, 582 bp, Homo sapiens
  misc_feature: GYAE6OF02FGFPN.24.75.G09.1.454.CMB.1.raw
  modified_base (230)..(230): a, c, t, g, unknown or other
  misc_feature (230)..(230): n is a, c, g, or t
  modified_base (249)..(249): a, c, t, g, unknown or other
  misc_feature (249)..(249): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagtagtgtttcngccgtgggtggcctggtancagcaagaaaccgagggaaacgccccttaaattcctgatctataaggcgtacttaatttacgaaaggttcggggtacccttagaaggttcaggacggctaggtggactcgtagggacaggtaacttcactctacaactatcgagcagtcctgctagcctagactgtatttcgactaactttattacgtacgtaccaaacgtagtatgtattcgtaccttaccgtaccctaccgttcggaccgtaacgggacctacgacttcggtactagttaacgtacgtaacgttcggtacggtctacgacctaccgtacttcgtcgttacctcgtaacccg

SEQ ID NO: 182724 - DNA, 691 bp, Homo sapiens
  misc_feature: GYAE6OF02HJJRK.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatcgacccagtcctccttcccaccctgtctgcatcgtgagagacagactcacatctacgttcggccggtaccaggtcagtagttcgttcgtcgtcgtgggtcgtccgtgtatcagacgaacgaaccgtaaggaaacgacccctaattcctagactactaacgtacggtcgttacgtttactttaacgtaacgggttccgggttacccttacgtaacggttccgaggcggtcgaggtaggtacgtacggtacgggacgtaagtaacttcctaccttcacctaactaactcgacgtcgacgtccgtcggacgtacgcccgtagtagttacgttagtttacgtaaccttacttttaacgttacttaccgtaacgtaacgttacgtacttggtacttccttaccgtttaacccctaccgttacccggtccgggacccggacgggaacccgacggtacgtaccgtacgttaaccgttaacgtacccggaagttccggttacgtacgtaccgcctaacccgtgttacccgtcgtttcctaccttacccg

SEQ ID NO: 182725 - DNA, 631 bp, Homo sapiens
  misc_feature: GYAE6OF02FRW6D.24.75.G09.1.454.CMB.1.raw
  modified_base (192)..(192): a, c, t, g, unknown or other
  misc_feature (192)..(192): n is a, c, g, or t
  modified_base (372)..(372): a, c, t, g, unknown or other
  misc_feature (372)..(372): n is a, c, g, or t
  modified_base (437)..(437): a, c, t, g, unknown or other
  misc_feature (437)..(437): n is a, c, g, or t
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccatccctccctgtctgcactcgtggtggganacgagagtccacatctcttgccgaggcgagtcgagggctatttaaccttatttagtaattggtatctataccaaaaccgaggacaacgggtaccctaaaccgtccgtaggtaccaacgatcgacctataccgaagttcgggtcgaccggaccgggccccagtacgtaaggtcaggcgganacggtagagttacggtcggtactattccttccgtaccttaccacctacacgtggccggtctcgcncgtccgtggaggtgtaggtcgacctactaacgttattactacgactaaacgtattaagtacgtaacgtaatacttacgttaacttacggttttacgaccggtaaggggtaacgggaagggttcgaacgtaccgtaacgtaaacggtacggtgtacgtcgtacgtacgtacccgttagtcttacgttccttaccg

SEQ ID NO: 182726 - DNA, 662 bp, Homo sapiens
  misc_feature: GYAE6OF02GD17P.24.75.G09.1.454.CMB.1.raw
  modified_base (233)..(233): a, c, t, g, unknown or other
  misc_feature (233)..(233): n is a, c, g, or t
  modified_base (620)..(620): a, c, t, g, unknown or other
  misc_feature (620)..(620): n is a, c, g, or t
tcagactactatgtcacgaccggtgctcgatttagtatagacatcaggggttcagacccagtcaggacacagcatggacatgagggtccccgctcagctcctggggctcctgctgctctggctcccaggtgaccaaatgtgacatccagatcgacccagtcctccttccacctgtctgcatctgtaggagacagacgtcaccatcacttcggccggcagtcagagttgtttcngccgtgggtcggccgttggtactcagacaacgaaaccgacggaaacgtaccctaaagttccagtatactaagtacggtcgttacttaatttaacgaagggttccgggtacccttaggtaacgttcgacggcggctaggtggtactcggtagggactaagtacttcactctacaactaatcaggacacgtcctagcacgtcctagtagttacgttagtttcgaaccttaacgtttacgttaaccgtacgtaaccgtaaacttagtaacgttacgtacgttacgttacctttacccttaccccgttacccggttaccgggaccggtaccgggaaccgtaacgtaccgtacgaacttaacgttaacgtaacggtaacgttggtacccgtnacccgtaccaccgttagttcgttcgtttcctaccgttacccg

SEQ ID NO: 182727 - DNA, 814 bp, Homo sapiens
  misc_feature: GYAE6OF02H99PL.24.75.G09.1.454.CMB.1.raw
  modified_base (242)..(242): a, c, t, g, unknown or other
  misc_feature (242)..(242): n is a, c, g, or t
tcagactactatgtcacgaccggtgctcgatttagtatagacatcagggggtcagacccagtcaggacacagcatggacatgagggtcccgctcagctcctggggctcctgctgctctggctcccaggtcgccaaatgtgacatccagatgacccagtcctccttccacctgtcctgcatctggtacggagacaggagtacacatcgtacgttcggccggcacgtacgagtagttcgtttcncggtcggtcggggtcggtccgttaggtactacgaaggacgtaacggaaaccggtaagggtaaaccctacccgtttaaacgttccgagtaacgttacgtaacggttaacgggtccgttaacttttaacgttttaacggtaaaacgggttccggggtttacccctttaagggtaaccggtttaccgaggtaccgggtacctaagggttacggacgttacggacgggaactaagggtaacttaccgtaaccttccggttaaccaaacgtaaccttaccggaaacgtaccggttaccgtaccggtcggtaccgtaaccggtccgttacggtaaacggtttcgtttaacgtttaccgtaacttaaacgtttccgttaaaccggttaccaaacgtaacgttacgttaagtacgtacgtttaccgtaccctttaccgacccgttaccggtaccggaccgggtaccggtaacaaccggtacgttacgtaacgtaacgtttacggaacgttaacggtcgggtccggacttacccgtcgtaaccttacgtttccggttacgtttccccgttagttaccccgg

SEQ ID NO: 182728 - DNA, 775 bp, Homo sapiens
  misc_feature: GYAE6OF02HENJV.24.75.G09.1.454.CMB.1.raw
tcagactactatgtcacgaccggtgctcgatttagtatagacatcgagggggtcagacccagtcaggacacagcataggacatggacgggtccccgctcagcctccgtggggctcctgctgctctggcctcccgaggtcgacctaaagttgtacgaacctactacccgagtacgtccggaaccctacttcccttccccttaccctacccgtgttcctcgactaacttcgttaggtaaggacgacgtacggtaccgtaccaactactaccgtacggttcggacccgggtactacgtaccgtaacggttacgttcgtttaccgtcggtccggtgggtcggtacgttaggtactcgaacgaacgtaacgaaccggaaacgtaaccctacccttaactaccgtagtacttaacgtaacgtacggttaccgttaatttaacgtttacggtaacggttccggtaccttaggtacgtacaggtcgagtagcgtacgtggtacggtataacgtacctactactactaacgaactacgtacgacgtacctacgaccgtcgaaccgcgtacgtacgttagttacggtttacttacgtaaccgttaacttaccgtaacgtacgtaacgtaacgttaagtacgtacgttacgttccttaccttaccgtacccgttaccggtaccggacggtacccggtacgacgttaaccggtactagttaccgtaacgtacccgtagtaccggacttcgacctacgtactaccgttacgtccttacgttctacccg

SEQ ID NO: 182729 - DNA, 700 bp, Homo sapiens
  misc_feature: GYAE6OF02I5VT2.24.75.G09.1.454.CMB.1.raw
  modified_base (238)..(238): a, c, t, g, unknown or other
  misc_feature (238)..(238): n is a, c, g, or t
tcagactactatgtcacgaccggtgctcgatttagtatagacatcagggggtcagacccagtcaggacacagcatggacatgacgggtccccgctcagctcctgggggctcctgctgctctggctcccaggtcgccaaatgtgacactccagatgacccagtctccttccaccctgtcctgcatctgtaggagacagactcacatcacgttcggccgggcagtcagtagttgtttccnggtccgtggggtacgtccgttgggtactcgagacaacggaaaccgaaggggaaacctacccccgttaaattcccgtagtacttacgtaacgtaacgggtcgttacttaattttaacggaaaggttccggggttacccttacgtaagggtttcgagcggtcgtaagttcggattcggtcgggaactacggtaattaccgactacgtacacgtacgtacacgctaacgtccgttagactacgccgtagtacttagttactttacggacttaacttacgttactacgtaaccgacgttaagtactaggtactacgttacctaccttacccgtaaccggttccgggaacccgggtaagggtaccgaacggtacgtacggtaacttaagttaacccggtagttaacggtcggttgtaccggttaccgaccggtaccttaccgttcgtacgtttactaccgttacccg

SEQ ID NO: 182730 - DNA, 951 bp, Homo sapiens
  misc_feature: GYAE6OF02HRODR.24.75.G09.1.454.CMB.1.raw
tcagactactatgtcacgaccggtgctcgatttagtatagacatcagggtggaaggagactgggtcatctggatgtcacatttggcacctggggctcctgctgctctggctcccaggtgccaaatgtgacatccagatgacccagtctccttccaccctgtctgcatctgtaggagacagagtcaccatcacttggccgggccagtcagagttgtttctgccgtgggtcgcctggtatcagcaagaaaccgagggaaacgaccccgtaaattccgtagacttcgtaagtaacggccgttacttaactttttaacgaaaacgggttcgggggttacccctttacgtaaacgggtttccaacgggtccgggacgtaacggttgggtaacttccggttacggggaactaacggtaactttcctaaccgttccgtaccgtaaacgtaaaatccgaacggtaccgaaccggtcccgttacggaaccgtaccggtaccccgttaaggtaacttttacgggtttaacgttttttaccgggaaaccttttaaaacccgtttttaacgttttaacccggtaccggtaaacccccgtaaaaccggttaaacggtttaaacgtttaccgggttaaagtttacccggggttaaccctttttaaaccccggtttacccccccggttaaacccgggtttttaccccgggggaaccccgggttaaaccggggggggtaaaccccttaaacccgggggttaacccggttaaaccggggttaaaaccccgttaaaggttttaaaaacccggttaccggtaaaacccggtttcggggtttaaccggtaccccggtttaacgggtaccccgttaaacccgttaccggtttaacgtttcccggttttaacccttacccgttacccgttttacccccgtttaccccccggttacgttacccgtttaacccgg

SEQ ID NO: 182731 - DNA, 739 bp, Homo sapiens
  misc_feature: GYAE6OF02F3YSA.24.75.G09.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagactactatgtcacgaccggtgctcgatttagtatagacatcagggggtcagacccagtcaggacacagcatggacatgaggtccccgctcagctcctggggctcctgctgctctggctcccaggtgccagatgtgccatccagatcgacccagtctccatccctccctgtctgcattctggtggganacagtagtccacatcacttcggccggnaacggtcgagggctaagtacgagtagtatttaggcttaggtatacgtagaccgaaggaaaccgaagggaaccctaccccgtaaggttccctagacttacgtacgtcgtcgtcgaccgttaccgttaacccgttaaacggtaacgggttccgggtaccctaacgtacgttaacggtacgaggtcggacgttagtgtactagtcggactactaagttaccttactaccttccacgtaaccaactgacgtcgtccgtaccgtgaccgttacgcgtaaacggtacgtaacttcggtttaaccgttaaactttacgttaaccgttacgtaccttaaacggaacgtttaaccgtaaaccgttttaaccgtaaccccgggtttaaggttacccggttaacccggtaaacggttaaccgggtaacccgttaagggttaaaccggaaaccggttaacgggtaacgttaaaccgggttcggtaagtcccgttaacgacttaccgttacgtagtttacccgtcgtttaaccc

SEQ ID NO: 182732 - DNA, 708 bp, Homo sapiens
  misc_feature: GYAE6OF02IM9K3.24.75.G09.1.454.CMB.1.raw
  modified_base (644)..(644): a, c, t, g, unknown or other
  misc_feature (644)..(644): n is a, c, g, or t
tcagactactatgtcacgaccggtgctcgatttagtatagacatcaggggggtcagacccagtcagggacacagcatgggacatggagggtccccgctcagctcctgggggctcctgctgctctggctcccagggtcgccaaaatgtgacactccagatcgacccagtcctaccttcccaccctgtctgcatcgtgtaggacgacgagagtccacatcctacgttcggcccgggtaccaggtacgtaggtagttcgtttctcggaccgttgggggtcggtccgttggtactacgacgacgaacggaaaaccgaacgggtaaaccgtaaccccgttaaacgttcctagtaactacgttaagtaacggtcgttactttaactttaacggtaaacgggttcggggttaccttaacggtaacggtttacggaacggtcggacgtagggtcggtacttcggtacgggtaacgtaagtaacttcgtacgtctacgaactactcaacgcgacgtccgtagacgtacgtctagagtttactacgtttacgactttaaactttacttaaccgtcgaaacaaacgttaagttacaggttatacggtccttaacccgtacctaccgttcggaaccgacgggactaacgtaaccgngttaacgaactttacgaacgtacgttgggactacgtcgaccagtaccttcgtacttcactaccg

SEQ ID NO: 182733 - DNA, 703 bp, Homo sapiens
  misc_feature: GYAE6OF02FRE1C.24.75.G09.1.454.CMB.1.raw
tcagactactatgtcacgaccggtgctcgatttagtatagacatcagggggtcagacccagtcaggacacagcatggacatgacgggtccccgctcagctccgtggggctcctgctgctcgtggcctacccaggtcgaccaaaagtgtcgacactcccgagtatcgaccccagtcctcccttacccacctgtctgcatcgtgtaaggagacagacgtaccaccattccacgttcggacccgggtacctacgtcgaaggtacgttcgtttccgtcggtccggttgggcgtccgtggtatcgagaccaagtaaccggaagggaacctaccccgttaatcccgagtacgtactaaggtaacgtccgttactttaagttaaacggaggttccggttacccgttacgtaagggttcaacggtcgacgttacggtgacgttcggtacgggaactacggttaactccgtactacgtacaactacgtcgactacgtacgcgtacgactacgtcgtagtagttagttattaacgtactaaacctttggttacctaccgtaactacgtagtattgtaacttcgttacccgttctacccgtcccggtacgaccgggaccggtacgaaccgtcgtaacggacttacggtaacgtcggtaagtggtaaccgtgtacccgacgttccttaagtttccgtccttacttcccgttaccc

SEQ ID NO: 182734 - DNA, 790 bp, Homo sapiens
  misc_feature: GYAE6OF02I94DG.24.75.G09.1.454.CMB.1.raw
  modified_base (302)..(302): a, c, t, g, unknown or other
  misc_feature (302)..(302): n is a, c, g, or t
  modified_base (439)..(439): a, c, t, g, unknown or other
  misc_feature (439)..(439): n is a, c, g, or t
tcagactactatgtcacgaccggtgctcgatttagtatagacatcagggggtcagacccagtcaggacacagcatggacatgagggtccccgctcagctccgtggggctcctgctgctctggctcccgaggtcgaccaaagtgtagacactaccagactcgacccgtattcctccctttcccacccgttgtctgaccattcgtaggtaggagacagtagtaccaccatcgtacgttcgggacccggaccagtaccagtacgtttccgttcgtcgtccgttaggggtcgtccgttgggttacncgagtacgaacggaaaccgaacgggtaacctaacccttaaacttcctagtaactacgtaacgtacgggtactacgtttaactttaacggtaacgggttaccgggttaccttaggtaacgtacgaggtaccgggtagnggtacgtagtcggtaaggacgtaacgttactactactacgtacctaaactagacgtacgacctacgtgtaccgacgtaccgtcgtagtacgttgtttacgtactaacttacttaaccgtacgttaccaaacgtacgtaacgttacgtagttacgttaccgttaccttaaccccgtcccggttaaccggtacccggaaacggggtaacccaccgtaaccgggttaggtaaccgttaaccgtttaacggtttaaccgaacggttttagggtaacgggtcccgtttacccgttaaccggacccttaacccgtttaccggttaacgttttacccgtacgttacccgttaaccccg

SEQ ID NO: 182735 - DNA, 642 bp, Homo sapiens
  misc_feature: GYAE6OF02FUZ2N.24.75.G09.1.454.CMB.1.raw
tcagactactatgtcacgaccggtgctcgatttagtatagacatcagggggtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatctctgccaggcgagtcgaggcaattaactacttgtaaattggtatcatacaaaaacaggtacaacgggaccctaaactcctaggtaccaagatgacactaccaagtccgggtacgccgacggggtacccctagtacgaaggttaccaggacggacgtaagtagtactcggtagggactactttctacgtaccttaccgacctacgttaccgacgtcggtaccgtcgactaaccggtcccgtaggtaacggtagttcggttgggacctactaattaacgttacgttagtactaaacgtatacgtacgaacggtatacgttacgttaacttacgtttagggacccggtaaagggaacggtacgggtaggtaaccgtctaaaccgaaacggtaagttcggtcggtacgtaggacccttatccgttcttacgttacttcctaaccg

SEQ ID NO: 182736 - DNA, 333 bp, Homo sapiens
  misc_feature: GYAE6OF01BYT6E.45.73.G07.1.454.CMB.1.raw
  modified_base (329)..(333): a, c, t, g, unknown or other
  misc_feature (329)..(333): n is a, c, g, or t
tcagacgcgatcgacacgaccggtgctcgatttagctctacgctcaggggccaagaggcaagtctttctgcagatgaacagcctgggggaagaggacacggccgtctactactgtgcgggtagaaggtgggattatagtggttatccctactttgaatattggggccagggaaccctggtcaccgtctcctcagcttccaccaagggcccatcggtcttccccctggcgccctgctccaggagcacctctgggggcacagcggccctgggctgcctggtcaaggactacttcctcgatcgcgtctgagcgggctggcaaggcgcatagnnnnn

SEQ ID NO: 182737 - DNA, 788 bp, Homo sapiens
  misc_feature: GYAE6OF01BWCIS.45.73.G07.1.454.CMB.1.raw
tcagacgcgatcgacacgaccggtgctcgatttagctctacgctcaggggagctctgggagaggagccccagccccagaattcgcaggagtttccattcggtgatcagcactgaacacagaggactcaccatggtagtttgggctgagtcgttgggttttccttgttgtcttattaagtaaaaggtgtccacggtcgaggcgcggcgtgggtggagtcgggtgggggggtacttgggtacgaagtccgtgggagacgtccctggacgactcctcctgtgcacgcctcgtggtattctagtttcagcgtactcctaacaataaacgtggactccgccgtacgggttccgggacggggggggtcctcggtagggtcggtcgttggtactaataactactcgtaacgtccaaccgaacccgtaggtcgacccgtaacctaacttaataaccttacttacgtttacggtaaccttcgttagggtaggggaacgggggtcctaacgtttccgaacctacgttcccgtaccggaacgggaaccaaccggaccgaaagggtacggactaaacggtttcctttacgacgacgaaggtacgtaacggtaaaccgacgggtaccgggtaagggggggaaacgacggggaacccggtaaccggggtcccgttaaccgtaaccgttaaccggtgggttacgggtacgggggttaaaggtaaggggggttaggttaaacggtttaggttaacgggtttacgggtttaaccgttaccccgtttaaggtttaggtaaaacggg

SEQ ID NO: 182738 - DNA, 532 bp, Homo sapiens
  misc_feature: GYAE6OF01BW5Z6.45.73.G07.1.454.CMB.1.raw
  modified_base (377)..(377): a, c, t, g, unknown or other
  misc_feature (377)..(377): n is a, c, g, or t
  modified_base (430)..(430): a, c, t, g, unknown or other
  misc_feature (430)..(430): n is a, c, g, or t
  modified_base (457)..(457): a, c, t, g, unknown or other
  misc_feature (457)..(457): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtcgtgggggggacttggtcaagcctggagagtccctgagactctcctgtgcagcctctggattcagtttcagcgactcctacataaactggatccgccaggttccgaggggggggcctcggagtggctgtcatacatcagtcacaccagtgcaccatatactatcttgactntgtgagggccgattcaccatctccgaggacaacgccaagagacaagtctttcngacagatagaacagccgtagggggaanaggacgacggccgtctactacgtggtggcgggtaggaagggtggattagtgttaggtatcccttagttgtaaacg

SEQ ID NO: 182739 - DNA, 658 bp, Homo sapiens
  misc_feature: GYAE6OF01CHYIX.45.73.G07.1.454.CMB.1.raw
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtcgtgggggggacttggtcaagcctggagacgtcccgtgagactctcctggtgcacgccttcgtggtattctagttttcagtccgacctcctaacaataaactggaactccggaccgtacggggttccggggacggggggggtccctcggaggtcgggtctggttacaattacatcgagtccaacaaccgagtcgaccgaacctattactaactacttctagacttcgtgtgggacggggacctattccactacgtcctacgacgggaaccaacgaccgaaaggacggactaacgttcctttacgtcgactacggtaactaggaacgacgggtaccggtaggggggtaaacacgggaccgaccgggtccgtacgttaccgtaacgtgggtcgggtacggggtaaggtacgggtaggtattaggtagttcgttactacccgttagttagtaacg

SEQ ID NO: 182740 - DNA, 578 bp, Homo sapiens
  misc_feature: GYAE6OF01EOCQT.45.73.G07.1.454.CMB.1.raw
  modified_base (404)..(404): a, c, t, g, unknown or other
  misc_feature (404)..(404): n is a, c, g, or t
  modified_base (454)..(454): a, c, t, g, unknown or other
  misc_feature (454)..(454): n is a, c, g, or t
  modified_base (470)..(470): a, c, t, g, unknown or other
  misc_feature (470)..(470): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggatttttgggctgagcttgggttttccttgttgctattataaaaggtgtccacggtcaggcgcggctggtggagtcgtgggggggacttgggtcaaggcctggagagtccctgacgactctcctgtgcgagcctctggattcagtttcagcgactctacataactggatccgccaggttccgagggggggcctcgaggtggctgtcatacatcagtcacacagtgcgaccagtatactatcttgactctgtgagggtccgattcaccatcnccgtagggaccaacggccaaggacgacaagttcttctcgcagatagaacngtaccgtagggggaanacgggacgccggcccgtacgtaccgtacgtggtcggtaggggtaggaagggttagggagtttaagtacgggttaggtttaacgttcccctttaagtttgttaaacggg

SEQ ID NO: 182741 - DNA, 831 bp, Homo sapiens
  misc_feature: GYAE6OF01DJ6IW.45.73.G07.1.454.CMB.1.raw
  modified_base (274)..(274): a, c, t, g, unknown or other
  misc_feature (274)..(274): n is a, c, g, or t
tcagacgcgatcgacacgaccggtgctcgatttagctctacgctcaggggagctctgggagaggacgccccacgccccagaattcgcaggagtttccattcggtgatcagcactgaacacagaggactacaccatggtagttttggctgagtcgttcgggtttttccttggttcgtacttaagttaagtaaaaggttcgtaccgacggtcgaggcgcggcgtggtaggaggtcgggtggggggacttggtcaagccgtaggacgacgttcccgngaacgtcctctccgtgtcgcacgtccctcgtaggtacttcgtagtttcacgccgtaccttacctaactaacgtaaacgtcggacgtcccggtaccggtacggggttccggggaccgggggggtacctgggtacggtcggtacgtcggtactacgtaacgtactccggtaactaccaacgacccggtacggtccgtaacccggtaaccctaacgttaactttaacctcctttacgtaccgttaccttcgggttacgggttaaccgggggtaacgggtacccttaaccgttaaccgaacccgtaaacccgttaccgaacccggtaaaccgggaaccaaacccgggtaacccgaaaggggtaacgaacccgttacgttttacccgttacggacgtaccgtaacgaagtacgggtaaccggacgggttacgggtaacgggggaacgacggaacccgtaccggtaccgttacgtaccgtagttcgggtacggtagggtaagggttaacgggtaggttacgttaggtacgggtttacttacggttacctttagtcggtaacgg

SEQ ID NO: 182742 - DNA, 743 bp, Homo sapiens
  misc_feature: GYAE6OF01D7K6G.45.73.G07.1.454.CMB.1.raw
  modified_base (586)..(586): a, c, t, g, unknown or other
  misc_feature (586)..(586): n is a, c, g, or t
  modified_base (596)..(596): a, c, t, g, unknown or other
  misc_feature (596)..(596): n is a, c, g, or t
  modified_base (697)..(697): a, c, t, g, unknown or other
  misc_feature (697)..(697): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggtagttttggctgagcttgggttttcctgttgctattataaaggtgtccacggtcaggcgcggcgtggtggaggtcggtggggggtacttgggtacaagccgtaggacgtacgtcccgtagacgtaccttcctccgtggtcgccgtagtcccttcgtggtactttcgtacgtttcgagtccggtaacttcctaaactaacgtaaaaccgtggtaccgtcccggaccggttaacggggttccggggacgggggggtccctcgggtaggtcggtacgtcggtactacgtacctacgtaccgtacgtaccgacctaaccgtaggcgtaccgtaacagttaactacgttactcttacgtactgttcggtaggacggtccttacgtacctaccgacgtttacccaccgggaagtaccgtaacccggacgtaaggaccgtaccgttaattcccgtttanacgtagaacngtaacggacgacgggtacggttaaggggaaccgacggacgtacccgggtcgtacttaccggtaggtacggtacgggtaggggttaacgtagggttacgttnttaacggtgtttaccgttaacctttaccgttagttagtaaaccggg

SEQ ID NO: 182743 - DNA, 926 bp, Homo sapiens
  misc_feature: GYAE6OF01ET2NL.45.73.G07.1.454.CMB.1.raw
tcagacgcgatcgacacgaccggtgctcgatttagctctacgctcaggggagctctgggagaggagccccagccccagaattcgcaggagtttccattcggtgatcagcactagaacacagaggactcaccatggagtttttgggcttggagtcttgggtttttccttgttgtctattaataaaaggtgtaccgacggtcaggcgcggtcgtgggtgggaggttcggtgggggggtacttggtcgaacgtccgtgggacgtacgtccctggacgacctctccgtgtcgcacgccttcgtggtattcgtagttttacgacggtaccgtaccttacctaaactaaacgttaaaaccgttcgggtacgtccccggtaccggttacgggggttaccccgggggaacggggggggggtccccttacgggtacgggtcgggtcgttcggttactaacgttaaccaacgttccgaacggttcccaaacccgtaaccgtacggtaccgtaacccgtaaacccttaaacggttaactttaaaccgtttactttaccgtttacgtaccggtttcggtttacggggtaacgggggtacgggggtaaccccgttaacggttacccctaaccccgttaacgttcccccgtaacccggaaaccggggtaaacctaaccccggaacggtaaacgggaacggtacccgttaacgggtttccttttacgtaccggaacgtaggtaacctaaccgggaaacgtcgggtaacggggtacgggggaaacgtaaccggggaccgtacccgggtaccgtttaaccgtaaccggttaacggtcggtacggggtaacggggttaaacgggtaagggggtttacggtagtttaaaggttaccggtttagggttttaaacccgtttaccgtttaagttaacggttaaacggg

SEQ ID NO: 182744 - DNA, 521 bp, Homo sapiens
  misc_feature: GYAE6OF02FRHNN.45.73.G07.1.454.CMB.1.raw
  modified_base (424)..(424): a, c, t, g, unknown or other
  misc_feature (424)..(424): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtctggggggacttggtcaagcctggagagtccctgagactctcctgtgcagcctctggattcagtttcagcgactcctacataaactggatccgccaggttccagggggggcctcggagtggctgtcatacatcagtcacaccagtgcgaccatatactatcttgactctgtgagggccattcaccatctccagggacaacgccaagagcaagtcttcngcagatgaacagcctgggggaagaggacgacggccgtctactacgtgtggcgggtagaaggttgggattagtaggttggttatcccttattgtaacg

SEQ ID NO: 182745 - DNA, 595 bp, Homo sapiens
  misc_feature: GYAE6OF02I1SAA.45.73.G07.1.454.CMB.1.raw
  modified_base (328)..(328): a, c, t, g, unknown or other
  misc_feature (328)..(328): n is a, c, g, or t
tcagacgcgatcgacacgaccggtgctcgatttagctctacgctcagggggagctctgggagaggagccccagccccagaattcgcaggagtttccattcggtgatcagcactgaacacagaggactcaccatggattttgggctgagctgggtttccttgttgctattataaaaggtgtccacggtcaggcgcggctggtggagtctgggggggacttggtcaagcctggagagtccctgagactctcctgtgcagcctcgtggattcagtttcagcgactctacataactgatccgcaggtccgagggggggcctcgagtggcgtntcatacatcagtccacaccgagtcgacgacccataacgtactatcttcgactcgtgtaggacgggctacgttcacctatcccgtcgaagggacaaccgaccgaaaggagaccgtaagttcctttacgtcgacacgattacggaacgaggtaccggtagggggaacgtaaggaccgtacggaccgtctacgtacggttcggtggacgggtaaggtaacggtgggttaattaggttacggttaggttacctaccgttacttggtaaacg

SEQ ID NO: 182746 - DNA, 544 bp, Homo sapiens
  misc_feature: GYAE6OF02H75LP.45.73.G07.1.454.CMB.1.raw
  modified_base (375)..(375): a, c, t, g, unknown or other
  misc_feature (375)..(375): n is a, c, g, or t
  modified_base (420)..(420): a, c, t, g, unknown or other
  misc_feature (420)..(420): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtctgggggggacttggtcaagcctggagagtccctgagactctcctgtgcagcctctggattcagtttcagcgactcctacataaactggatccgccaggttccgagggggggcctcggaggtggctgtcatacatcagtcacaccagtgcgacatatctatcttgactntgtgagggccattcacatctcaggacacgcaagagcaagtcttcngcagatagaacacgccgtagggggaagcggacgaccgggtccgtctactacgtggtggacgggttaggaagggttaggagtttaaggtaggttaggttacttacccgtttacttaggttaacgg

SEQ ID NO: 182747 - DNA, 544 bp, Homo sapiens
  misc_feature: GYAE6OF02GJUU1.45.73.G07.1.454.CMB.1.raw
  modified_base (383)..(383): a, c, t, g, unknown or other
  misc_feature (383)..(383): n is a, c, g, or t
  modified_base (435)..(435): a, c, t, g, unknown or other
  misc_feature (435)..(435): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtcgtgggggggacttggtcaagcctggagagtccctgagactctcctgtgcagcctctggattcagtttcagcgactcctacataaactggatccgccaggttccgagggggggcctcggagtggctgtcatacatcagtcacaccagtgcgaccatatactatcttgactctgtggngggccgattccaccatcctcgagggaccaacgccaagacgacaagtctttcngcagatagacagccgtagggggaagaggacgacgggccgtacgtactacgtggtggacgggtaggaagggttggattagtaggttggttactcccgttagttagtaacg

SEQ ID NO: 182748 - DNA, 335 bp, Homo sapiens
  misc_feature: GYAE6OF02F4XYT.45.73.G07.1.454.CMB.1.raw
  modified_base (326)..(335): a, c, t, g, unknown or other
  misc_feature (326)..(335): n is a, c, g, or t
tcagacgcgatcgacacgaccggtgctcgatttagctctacgctcaggggccaagaggcaagtctttctgcagatgaacagcctgggggaagaggacacggccgtctactactgtgcgggtagaaggtgggattatagtggttatccctactttgaatattggggccagggaaccctggtcaccgtctcctcagcttccaccaagggcccatcggtcttcccctggcgccctgctccaggagcacctctggggcacagcggccctgggctgcctggtcaggactacttcctcgatcgcgtctgagcggctggcaaggcgctatagnnnnnnnnnn

SEQ ID NO: 182749 - DNA, 861 bp, Homo sapiens
  misc_feature: GYAE6OF02JQPOZ.45.73.G07.1.454.CMB.1.raw
tcagacgcgatcgacacgaccggtgctcgatttagctctacgctcaggggagctctgggagaggagccccagccccagaacttcgcaggagtttccattcggtgactcagcactgaacacagaggactcaccatggattttgggcttgagctgggttttccttgttgctattagtaaaggtgtcacggtcaggtcgcggctggtggagtcgaggggggtacttgggtcaaggccgtggagacgtcccgtggacgactccgtccttggtcgcgtagccttacgtggtatccgtagtttcagcgtactcctactataactggtactccgacctaggttccgaggggggctcggacggtgtacgtgtacgattaccagtcacgtagaccgactagtccggacgacgaactacttacctaattccttagtaaccgtcgtttacggacgggtacggggtccgtaagttcccgtaacccgacgtttacccaccgtaacggggtaaacccaacccggtacccgtaaaaggtcccgggtaaactaacgggtttaccctttcccggtaacggtacccgttaaacggtaacgtaccgggtaaaaccctaaaggggtacccccggggttaaaggggggtaaaacccgggttaacggggggaaaaccctaaccccgggggggtttacccgttaaaaccggtttacccccgtttaacgggccgggggttttaaaacccgggtcgggggggtttaaaaccggtaaaccgggggggtttacggggtttaacccggtttaaaggggttaaccgggttttaaaccggttttaacccggtacccccggttttttaaccgggtttaaaccgtaaccgggg

SEQ ID NO: 182750 - DNA, 592 bp, Homo sapiens
  misc_feature: GYAE6OF02HK50T.45.73.G07.1.454.CMB.1.raw
  modified_base (401)..(401): a, c, t, g, unknown or other
  misc_feature (401)..(401): n is a, c, g, or t
  modified_base (433)..(433): a, c, t, g, unknown or other
  misc_feature (433)..(433): n is a, c, g, or t
tcagacgcgatcgacacgaccggtgctcgatttagctctacgctcagggggagctctgggagaggagccccagccccagaattcgcaggagtttccattcggtgatcagcactgaacaaacagaggactcaccatggattttgggctgagctgggttttcctgttgctattataaaaggtgtccacggtcaggcgcggctggtggagtcgtgggggggacttggtcaagcctgggagacgtccctgagactcctcctgtgcagcctctggattcagttttcagcgactcctacataaactggatccgccaggttccgagggggggcctcggagtggctgtcatacatcagtcacaccagtcgcgaccatactactatctgactctgtgagggccgatcacntctcaggacaacgccaagagacaagttcttcngcagatagaacgagaccgtagggggaaagacggtaacgaccgggaccgttacctaccgttacgtacggtacggtaccggggttaaggaacggggttaggggtaatttaacggttaaggttacggtttaaccgttacccgtttacgtttaagttaaacgg

SEQ ID NO: 182751 - DNA, 760 bp, Homo sapiens
  misc_feature: GYAE6OF02HE3B2.45.73.G07.1.454.CMB.1.raw
  modified_base (262)..(262): a, c, t, g, unknown or other
  misc_feature (262)..(262): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagcttgggttttccttgttgctattataaaaggtgtaccacggtcaggcgcggctggtggagtcgtgggggggacttggtcaagccgtggagacgtccctgacgacttctcctgtcncagcctcgtgacttctagtttcagcgacttcctaactaataaacgtggtactcccgaccgtacgggttccgggaacgggggggtccctacggaggttcgggtacttcgtactaacgtacaactaccgtagtaccaacgaaccgtagtcgaccgtaactaagtaactacttagtccttagaccgttacgtggtacggggacgggtaccgtaattacccgaacctaactcccgtaacgaaacggggaacgtaaacccgaccgaaagggtaacgtaaccgttaaacggtttcctttaacgtcgtaaccgtaaggtactaaaccggaaccgtaccgggaccgggtaacgggggaaacgaccgggtaaccgaccgggtaacccgttaccgttaaccgttacggtacgggtagggtaaccggggttaaggaacggggtttaggtaacgtttaagttaacgggtttccgttaccggtttaccccgtttaagttacgttaaacggg

SEQ ID NO: 182752 - DNA, 557 bp, Homo sapiens
  misc_feature: GYAE6OF02GQ0HG.45.73.G07.1.454.CMB.1.raw
  modified_base (406)..(406): a, c, t, g, unknown or other
  misc_feature (406)..(406): n is a, c, g, or t
  modified_base (429)..(429): a, c, t, g, unknown or other
  misc_feature (429)..(429): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
tcagacgcgatcgacacgaccggtgctcgatttagctctacgctcaggggagctctgggagaggagccccagccccagaattcgcaggagtttccattcggtgatcagcactgaacacagaggactcaccatggattttgggctgagctgggttttccttgttgctattataaaaggtgtccacggtcaggcgcggctggtggagtctgggggggtacttggtcaagcctggagagtccctgagactctcctgtgcagcctctggattctagtttcagcgactcctacataaactggactccgccgtaggtccgagggggggcctcggaggtggcgtgtcatacatcagtcaacacagtcgcgaccatactactctcttagactctgtggagggtccgattcactntctaccgaggacaacgccaaggngacaacgttcttcgtncanagtacgaaccgcgtacggacggggaagacggacgacgggtcctctacgtacgtggtcggacgggtagacggtggagttagtggtacggttactccgttagtagtaacgg

SEQ ID NO: 182753 - DNA, 257 bp, Homo sapiens
  misc_feature: GYAE6OF01BQG76.1.86.H09.1.454.CMB.1.raw
  modified_base (255)..(257): a, c, t, g, unknown or other
  misc_feature (255)..(257): n is a, c, g, or t
tcagacgagtgcgtcacgaccggtgctcgatttagtgctatagactcgcgggtatggaacagatttaccctcacaatttataacatagagtctgaggatgctgcatattagttctgtctacaacatgatcatttccctctgcacttttggccaggggaccaagctggagatcaaaagaactgtggctgcaccatctgtcttcatcttcccgccctcctcacgcactcgtctgagcgggctggcaaggcgcatagnnn

SEQ ID NO: 182754 - DNA, 280 bp, Homo sapiens
  misc_feature: GYAE6OF02IIVF1.1.86.H09.1.454.CMB.1.raw
  modified_base (247)..(247): a, c, t, g, unknown or other
  misc_feature (247)..(247): n is a, c, g, or t
  modified_base (260)..(260): a, c, t, g, unknown or other
  misc_feature (260)..(260): n is a, c, g, or t
  modified_base (265)..(280): a, c, t, g, unknown or other
  misc_feature (265)..(280): n is a, c, g, or t
tcagacgagtgcgtcacgaccggtgctcgatttagtgctatagactcgcgggtcagggacagatttcacactgaaaatcagccgggtggaggctgaggatgttggggtttattactgcatgacaaagtatacagtcttccctcctccgcccaaagggaccaaggtggaaatccaaaacgaactgtggctgaccaccatctgtcttcactccttcccgcccttcctacacgcactcgtctgagccggntcggcaaggccgnatagnnnnnnnnnnnnnnnn

SEQ ID NO: 182755 - DNA, 631 bp, Homo sapiens
  misc_feature: GYAE6OF01DJL2O.52.73.G07.1.454.CMB.1.raw
  modified_base (347)..(347): a, c, t, g, unknown or other
  misc_feature (347)..(347): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgaggggtcgatgacgtggccattcttgcctaaagcattgagtttactgcaaggtcagaaaagcatgcaaagccctacagaatggctagcaaaagngactacaaacaaaacaatttagaaactttataaggaataggggaagactaagaagaaactacaaaacatacaaagtaattttaaataacgtactttacttaggtacttaccttgtactaataaatttatacgtaggtaattaagactaatgtcttagttttctagttcttgttacccctaaactattcgtaccccttggttacgtaatttaagtccccgtaacaaaaccaaaacctaaccaaacccccgaaaggggtacctaaaaggttaacctttttaaacgg

SEQ ID NO: 182756 - DNA, 646 bp, Homo sapiens
  misc_feature: GYAE6OF01CH4JR.52.73.G07.1.454.CMB.1.raw
  modified_base (534)..(534): a, c, t, g, unknown or other
  misc_feature (534)..(534): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagcggacggaggctttccttgactcagccgctgcctggtcttcttcagacctgttctgaattctaaactcgtggagggggtcgatgacgtggccattcttgacctaaagctattgagtttactgcaaggtcaagaaagcatgacaaagccctacagaatggctgactaaagacgactaccaaactaaaactaatttaagaaacttttaagtaaacgggaagttaaggggggaaatacgtaaagggaaacgaaactaacaaaactaataacgtaaagttaattttaaaactacgttacgtttacttacggttccttccttagtaccttaataactttattacgtggtaatacgtntagttgtctttgttttctgttcttacgtaccctaatctcgtaccttaggttctacttacgtcccgaactaaacaactacccaaacccgtagggactacgttaacgtttaacg

SEQ ID NO: 182757 - DNA, 626 bp, Homo sapiens
  misc_feature: GYAE6OF01CYUF5.52.73.G07.1.454.CMB.1.raw
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatccccagcacagtcctggaagaggcacaggggaaataaagcggacggaggcttcctgactcagccgctgcctggtcttcttcagacctgttctgaattctaaactctggagggggtcgatgacgtggcctattcttgacctaaagctattgagtttacngacaaggtcaagaaaagcatgacaaacgccctanagaatggactagacaaagcgactaaccaaaactaaaactaatttaacgtaaacttttaagtaaaggtaaagtagggggtaaatacgtaaggaaagaaactacaaaactatacaaagttaatttaaactacgtactttcgttaggtccttaccttagtacttaataacttatcgtaggtataagctaagtcgtcttagtttctgttcttcgtacccttaactctcgtacccttgtacgtatttacaccgtacaaacacctaccaacccgaaggtaccaagtaactttaacg

SEQ ID NO: 182758 - DNA, 776 bp, Homo sapiens
  misc_feature: GYAE6OF01CZ65M.52.73.G07.1.454.CMB.1.raw
  modified_base (204)..(204): a, c, t, g, unknown or other
  misc_feature (204)..(204): n is a, c, g, or t
  modified_base (302)..(302): a, c, t, g, unknown or other
  misc_feature (302)..(302): n is a, c, g, or t
  modified_base (336)..(336): a, c, t, g, unknown or other
  misc_feature (336)..(336): n is a, c, g, or t
tcagcgcagtacgacacgaccggtgctcgatttagctctacgctcagggcacgaccggtgctcgatttagctctacgctcagggcctgctctgcagggaggtttagcccagcccagccaaagtaacccccgggagcctgttatcccagcacagtcctggaagaggcacgaggggaaataaaagcggacgaggctttcctgactnagccgctgcctggtcttctcagtacctgttctgaattctaaactctggaggggtcgatgacgtggcctatttcttgacctaaagctattgagtttacngacaaggtcaagaaaagcatagacaaagccctanaagaatcggactagaacaagtacgactaaccgaaaactaaaactaaatttaagtaaaactttaagtaaaaggtaagtaaggggaaagtaacgtaaagggaaaacgtaaactaacgaaaactataaacgtaaagtaaacgttttaaagtaaccgttactttacgtttacggttaccttacccgtttagtaccttaaattaaactttaagtaccggttaagggtaacttaaggtaccttaaggttccgttacgttttagttttaccttagtttacccgttaccggttaacccttaaacgttaacgttccggttaccccgtttagtaccgggttaaactttacccggttaacccgtaaaccccgtaaaaaccgtaaaccctaaaccccggtaaacccggaaacggggtaacccttaaacggtttaaacccgtttttaaacccg

SEQ ID NO: 182759 - DNA, 619 bp, Homo sapiens
  misc_feature: GYAE6OF01A19ZR.52.73.G07.1.454.CMB.1.raw
  modified_base (300)..(300): a, c, t, g, unknown or other
  misc_feature (300)..(300): n is a, c, g, or t
  modified_base (332)..(332): a, c, t, g, unknown or other
  misc_feature (332)..(332): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaataaaagcggacgaggctttccttgactcagccgctgcctggtcttcttcagacctgttctgaattctaaactctggagggggtcgatgacgtggccatttcttgcctaaagcattgagtttacnggcaaggtcaaggaaagcatgacaacgccctnagatggctgacaaagacgacctacaaacaaaactaatttacgaaactttagtaaaggaagtaagggggaaatacgtaagggaaacgaaactacaaactaagtacaaagtaattttaaatacgtacttacgttgtacttaccttagtcttatattatcgtagggtactaagctatgtcttgtttactgttacttcgtcccttaacgtcttcgacccttgtacgttattaccgtcccgtaacaaacctaacccgtaccaacccgaacggcctaagttaacctttaaccg

SEQ ID NO: 182760 - DNA, 737 bp, Homo sapiens
  misc_feature: GYAE6OF01AUXZ5.52.73.G07.1.454.CMB.1.raw
tcagcgcagtacgacacgaccggtgctcgatttagctctacgctcagggcacgaccggtgctcgatttagctctacgctcgagggcctgctctgcgaggggtaggttttacgcccacgccccagacccaaacggtaacccccgggagcctgttactcccagcacagtcctggaagaggcacgaaggggaaataaagcggacggaggtctttccttgactcacgccgctgcctggtcttcttcacgtaccttgttctagtaacttactaaactcgtaggagggggtcggatggacgtggcctatttcttgacctaaagctatttgtagtttactgacgaaggtacaaggaaaagcagtcgacaaacgtccctagaagatggactagaacaagcgactaaccaaactaaaactaatttaagtaacttttaagtaaaggtaaggtaagggggaaatacggtaaaggaaacgtaaactaacgaaaactataacgtaaagttaattttaaacgtacgtactttacgttacggttaccttaccgttagtacttaatttaattacgtacggttagggtaactagtacttagtcgtttacgtttgttttacgtcgttacgttaccgttacccttaagtacgttccgtaccctttggttagttaaccttaccggtacccaaacctaaacccgaacccgaaccctaacccggtaaacgggtccttaaacggtttaactttaaacccg

SEQ ID NO: 182761 - DNA, 691 bp, Homo sapiens
  misc_feature: GYAE6OF01DE1YD.52.73.G07.1.454.CMB.1.raw
  modified_base (323)..(323): a, c, t, g, unknown or other
  misc_feature (323)..(323): n is a, c, g, or t
  modified_base (445)..(445): a, c, t, g, unknown or other
  misc_feature (445)..(445): n is a, c, g, or t
tcagcgcagtacgacacgaccggtgctcgatttagctctacgctcagggcacgaccggtgctcgatttagctctacgctcagggcctgctctgcagggaggttttagcccagcccagccaaacgtaacccccgggagcctgttatcccagcacagtcctggaagaggcacgaaggggaaataaagcggacggagctttcctgactcagccgctgcctggtcttcttcagaccttgttctagtaattacctaaactcgtaggagggggttcgaattcggaacgtcggcctaatttcctttagacctaaagctattgagtttacngactaagggtacaagaaaagcaagtacgaccaaacgtccctacgaagtaactggactagacaaagcgactaaccaaaacgaaaactaatttaagtaaactttaagtaaggaagtaggggaanacgtaaggaaataaactacaaaactataacaaagttaatttaaagtactacgttacttaggtacttccttatacttaatagttatacgtaggtaatagctatcgtactttgtttactgttaccttcgtaacctaactgttacccgtccttaggttaacgtactttacctaccgtaaacctaaaacctaaacccgtaacccgtaaacccggtaacggtaaccgtaaacgtttaaccgttttaaaccg

SEQ ID NO: 182762 - DNA, 741 bp, Homo sapiens
  misc_feature: GYAE6OF01EE80E.52.73.G07.1.454.CMB.1.raw
  modified_base (162)..(162): a, c, t, g, unknown or other
  misc_feature (162)..(162): n is a, c, g, or t
  modified_base (316)..(316): a, c, t, g, unknown or other
  misc_feature (316)..(316): n is a, c, g, or t
tcagcgcagtacgacacgaccggtgctcgatttagctctacgctcagggcacgaccggtgctcgatttagctctacgctcagggcctgctctgcaggaggttttagcccagcccagccaaacgtaccccgggagcctgttatcccagcacagtcctggaagnggcacgaggggaaataaaaggcggaacggaggtctttcctgactcagccgctgcctggtcttcttcagtaccttgttctgtaacttctaaactcgtggaggggtcgagtcgacgtggcctatttcgttagacctaaagctagttgtagtttacngaccgtaaggtcaaaggtaaacgctatcggaaccaaacgtccctagaagaaacgtggacctagaacaaacggcaacctaaccaaaactaaaacgttaatttaaacgtaaacgttttaagttaaacggaaagtaagggggaaactacggtaaaagggaaactaaaacctaacgaaaactattaactaaagttaatttttaaaacgcgttactttacgttaggtccctttacgttagtaccttaaagttaacgttacgtcgtaagggtaacttaaggcctaatttcgtacgtttgttttaccgtcttacttaccgttaccctaaagtcgttccgacccgtttagtacgttaactttaccgaacccgaaacaaaccctaacctacccgaaacccggtaaggtacctaagttaaccgtttttaaacccg

SEQ ID NO: 182763 - DNA, 795 bp, Homo sapiens
  misc_feature: GYAE6OF01EYVE8.52.73.G07.1.454.CMB.1.raw
tcagcgcagtacgacacgaccggtgctcgatttagctctacgctcagggcacgaccggtgctcgatttagctctacgctcagggcatgctctgcagggaggttttagcccagcccagccaaaggtaacccccgggagcctgttactcccagcacagtcctggaagaggcacgaaggggaaataaaggcggacggaggtctttcctgactcagccgctgtccgtgttcttcttcacgtaccttgttctagtaactttactaaacgtcgtagggtagggggttcgagttcggacggtcggtaccttatttccgtttacggaccttaaaggtccttagttaggttacgtttacgtaggtaccgtaagggtacaaaggtaaaacgctaagtacgaaccgtaaacgcccctaagaacggtaagtcggactaggaaccgtaaagaccgtacctaaaccgaaaactaaaaacttacgttttaaacgtaaacgttttaaaggtaaagggaacgggtaaagggggaaataacggtaaacggaaactaaaacctaacaaaactaagtaacgtaagtttaaagtttaaacgtaccgttactttacgttaccgttacgtttacgttattacttaattaatttacgtacggtaggtaataacgtacttagttcgtttacgtttagtttccgtcgttacgttaccgtaccttaacgtacctccgtttccgtagttactaacgttactaacccggtaacctaaaacccgacctaacccggaaccgtaacggttaacgtaacgtttaaccg

SEQ ID NO: 182764 - DNA, 768 bp, Homo sapiens
  misc_feature: GYAE6OF01AWT4D.52.73.G07.1.454.CMB.1.raw
  modified_base (328)..(328): a, c, t, g, unknown or other
  misc_feature (328)..(328): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgattctaactctgaggggtcgatgacgtggccattcttgcctaaagctattgagtttactgcaaggtcagaaaagcatgcaaagccctanagaatggctgacaaagcgactaccaaacaaaactaatttaacgaaacttttaagtaaaggtaagtaaggggggaaagtacgtaaaggaaacgaaaaccgttaacaaaactaataaccgtaaagttaatttttaaaacgtaaccggttaccttttacgtttacgggttacctttacccgtttagtaacctttaattaaacttttacgttacgttaggggtaaacttaaaggtcctaagttacggttaccttttaggttttttacctacgggttttaccctttacggtttaacccccttaaacgttaccgtttaccgtacccccgtttaggttacgtttaacgtttaacccgtaccccggtaacctaaaaaccctaacccgtaaacccgtaacccccgtaaaggggtacccttaaaccggtttaaaccgtttttaaacccgg

SEQ ID NO: 182765 - DNA, 669 bp, Homo sapiens
  misc_feature: GYAE6OF01B01T2.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagcggacggaggctttccttgactcagccgctgcctggtcttcttcagacctgtctgaattactaactcgtggagggggtcgatgacgtggccattctttgacctaaagctattgtagtttactgacaaggtcaagaaagcatgacaacgcctacagatggctagacaagcgactaccaaataaactaatttaagtaactttaagtaaaggaagtaagggggaatacgtaaggaaagaaactacaaacgtataacgtaaagttaactttaaatacgttacttacgttacggttaccttaccttagtaccttaagtttaactttagttacgttaagggtaacttaaggtcctagtttacgtcgtttgtttttacttcgttacctacgttaccctaactcgttccgtacccttaggtacttacttacgtacccgtaacaaaaccctaaccaacccgaacccgaaggtacctaagttaaccgttttaaaccg

SEQ ID NO: 182766 - DNA, 162 bp, Homo sapiens
  misc_feature: GYAE6OF01AMZ86.52.73.G07.1.454.CMB.1.raw
  modified_base (162)..(162): a, c, t, g, unknown or other
  misc_feature (162)..(162): n is a, c, g, or t
tcagcgcagtacgacacgaccggtgctcgatttagctctacgctcagggcacgaccggtgctcgatttagtcacgcgagaaagggaagggggctggccctagcgtgttcctgttcccaccctcctctatacgatcgctgagcgggctggcaaggcgcatagn

SEQ ID NO: 182767 - DNA, 707 bp, Homo sapiens
  misc_feature: GYAE6OF01AQKD8.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagcggacgaggctttcctgactcagccgctgcctggtcttcttcagacctgttctgaattctaaactcgtggagggggtcgatggacgtggcctattcttgacctaaagctattgagtttactgactaaggtcaagaaaagcatgactaaacgccctacgaagaagtggacctaggacaaagtacgacctaccaaaacaaaacttaatttaacgaaacgtttaagtaaaggtaagttaagggggaaatacgtaaaggaaagtaaacgtaacaaaactagtaaactaaagttaattttaaataccgtattcgttagtaccttcttagtacttaattaatttactcgttagggaattaacggctaagtgttacgtttgttttaccgtattccgttacgtaaccccttaatacgttaccgtcccgtttaggtacgttaacttacccgttaccgaaaccctaaaacccgaaccgttaaacccgaaccccggttaaaagggtaccttaaacgttaaaccgtttttaaacccg

SEQ ID NO: 182768 - DNA, 166 bp, Homo sapiens
  misc_feature: GYAE6OF01AHPX9.52.73.G07.1.454.CMB.1.raw
  modified_base (158)..(166): a, c, t, g, unknown or other
  misc_feature (158)..(166): n is a, c, g, or t
tcagcgcagtacgacacgaccggtgctcgatttagctctacgctcagggcacgaccggtgctcgatttagtcacgcgagaaagggaagggctggccctgacgtgtttctgttcccaccctcctctatacgatcgctgagcgggctggcaggcgcatgnnnnnnnnn

SEQ ID NO: 182769 - DNA, 805 bp, Homo sapiens
  misc_feature: GYAE6OF01DIUOH.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaagggaaataaagcggacggaggctttcctgactcacgccgctgccgtggtcctttcttcacgtacccgttgttctagtaactttacctaaacttcgtagggtacgggggtcgagtggacggtcggacctatttcgttacgacctaaagcctagtttgtacgtttactgacgtaaggtacaaagaaaacgcagtacgaaccgtaaacgtccctagaagtaagtcggtactaacggaacaaacggacgtaccctaaacccgaaaaactaaaaaaccgttaagttttaaacggtaaaactttttaaaggtaaaacgggtaaacgggtaagggggtaaaactacggttaaaagggaaaccgtaaaactaaccaaaaagtactaacgttaaaagttaacgttttaaaactacggttacctttagtttacggtacctttaccgttagtaactttaaagttaatttacgttacgtaagggaacttacgacttagttacgttacgttttgtttaccgtacgttacgttacccgtaccttaaccgtagtcccgttaccgttagttaacgtactttacgtacccgaactaaacccaaccgacccgtaaacccggaggtaacctaagttttaaccgtttaaaccg

SEQ ID NO: 182770 - DNA, 877 bp, Homo sapiens
  misc_feature: GYAE6OF01B8QF9.52.73.G07.1.454.CMB.1.raw
tcagcgcagtacgacacgaccggtgctcgatttagctctacgctcagggcacgaccggtgctcgatttagctctacgctcagggcctgctctgcgagggaggttttagcccagcccagaccaaacggtaacccccggggagcctgttatcccagcacagtcctaggaagaggcacgaaggggaaataaagcggacggaggtctttccttgactcagccgctgcctggtcttcttcacgtaccttgttctagtaacttactaaactcgtagggagggggtcgagtggacgtcggtcctagtttcttacgacctaaagctaagtttgtacgtttactgacgaaggtacgaaagaaaagctagtacgaaccgaacgtcctacgaagtaagttcgggactaggaaaccgaaaacggtcgtaaccctaaaccgaaaaacttaaaaacgttaaacgttttaaacgttaaaaacgtttttaaaacgggtaaaaggggtaaagggtaaaggggggtaaacgtaaacggttaaaaacgggaaaacgtaaaaccttaaacgaaaaaccttaagttaaaaccgttaaaaagttaactttttaaaacgtacccgtttaccgttttaacggtttaccggtttacccttttacggtttaagtttaaacgttaaacgttttaaacgttacgttaaccggtttaagggtaaattaaggttaccttaagttcggtttactttttaccggtttacttccgtttaacttaccccgttaaccgttaacttaccggttccgtacccgtttgttaacgttaaccttacccgtaaacccgtaaacaaaaccgtacccgaaccgtaccggtaaaacggtctaaaacgttttacttaaaccg

SEQ ID NO: 182771 - DNA, 683 bp, Homo sapiens
  misc_feature: GYAE6OF01BLETT.52.73.G07.1.454.CMB.1.raw
  modified_base (309)..(309): a, c, t, g, unknown or other
  misc_feature (309)..(309): n is a, c, g, or t
  modified_base (441)..(441): a, c, t, g, unknown or other
  misc_feature (441)..(441): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtacccccgggagcctgttatcccagcacagtcctggaagaggcacgaggggaaataaaagcggacggaggctttcctgactcagccgctgcctggtcttcttcagacctgttctgaattctaaactctggagggggtcgatggacgtggcctagtttcttcgacctaaagctattggtagtttacngacaaggtcaaggaaaagcaatgacaaacgccctacaagtaatgggactaggaacaaacgacgacctaaccaaaacaaaactaatttaagtaaactttaagtaaggaagtagggggaatacgtaagggaaanaactaacgaaacataacgtaaataatttaaacgtcctacgtttcttacggttaccttccttagtaacttattaacttatcgttaggaattagcgtagtgttcgtttgttttacgttcgttaccgttacgttaccctaacgtcttaccggtacccgtttagtacgttattaaccgtccccaaactaaaccctaaccgtaaccctaacccggtacgaacgtaacgtttaaccgttttaaacccg

SEQ ID NO: 182772 - DNA, 756 bp, Homo sapiens
  misc_feature: GYAE6OF01EYQKH.52.73.G07.1.454.CMB.1.raw
  modified_base (302)..(302): a, c, t, g, unknown or other
  misc_feature (302)..(302): n is a, c, g, or t
  modified_base (335)..(335): a, c, t, g, unknown or other
  misc_feature (335)..(335): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgaggggtcgatgacgtggcctattcttgacctaaagctattgagtttacngacaaggtcaagaaagcagtgacaaagccctanagaatggactgacaagacgactaccaaacaaactaagtttaacgtaaactttaagtaaacggaagttaagggggaaatacggtaaaggaaaacgtaaactaacgaaaactattaacaaagttaattttaaagtacgttactttcgttaggttaccttacctttagtacctttaagttaaacttagttacgttaacggggtaattaacggtccttaagttacggttacgttttacgtttttaccttacggtttccttaaccggtttacccctaaacgttacgtttaccggttaccccctttaggttaccgttaagttttaacccgtaccccgtaaacctaaaaacccctaaaccccgtaaccccggtaaaccccggtaaaccggggtaaccttaaacggtttaaacccgttttttaaaccgg

SEQ ID NO: 182773 - DNA, 823 bp, Homo sapiens
  misc_feature: GYAE6OF01BMMOS.52.73.G07.1.454.CMB.1.raw
  modified_base (352)..(352): a, c, t, g, unknown or other
  misc_feature (352)..(352): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaggggaaataaaagcggacggaggctttccttgactcagccgctgcctggttccttcttcagaccttgttctgaattctaaactcgtggaggggtcgatgacgtggcctattcttgacctaaagctatttgtagtttactgacctaaggtacaaggaaaacgcagtagacaaacggccctanagaagtcggctacggacaaacggacacctaaccaaaactaaaacgtatttaaacgtaaacttttaaagtaaagggtaaggtaacgggggaaataacggttaagggaaactaaactaaccaaaactaactaacctaaagttaaacttttaaaacgtacgttaccttttacgttacggttaccttaccgtttaggtaacctttaagttaaactttacgttacggttagggtaaacttaacggtacctaagtttccggttaccgtttttacggtttttaccttacggtttacccttaccggtttaaacccccgtaaacttaccggttacccggttacccgttttacggttaacgttaacgttttaaaccgtaacccccggtaaacctaaaaacccccgtaaaccccgtaaacccggtaaacccccggtaaacgggggtaacccttaaaacggtttaaacccgtttttaaacccg

SEQ ID NO: 182774 - DNA, 804 bp, Homo sapiens
  misc_feature: GYAE6OF01DFEOU.52.73.G07.1.454.CMB.1.raw
  modified_base (308)..(308): a, c, t, g, unknown or other
  misc_feature (308)..(308): n is a, c, g, or t
  modified_base (322)..(322): a, c, t, g, unknown or other
  misc_feature (322)..(322): n is a, c, g, or t
tcagcgcagtacgacacgaccggtgctcgatttagctctacgctcagggcacgaccggtgctcgatttagctctacgctcagggcctgctctgcaggggaggttttagcccagcccagaccaaacgtaacccccgggagcctgttatcccagcacagtcctggaagaggcacgaaggggaaataaaggcggacggaggtctttcctgactcagccgctgcctggtctttcttcacgtaccttgttactagtaattacctaactcgtagggtaggggtcgatcggacgtgcctatttctagacctaagntagttgtatttacnggactaaggtacaagaaagtcatacgactaacgccctagaagtatggctagaacaagtcgactaaccaaaataaactaatttaacgtaaactttaaggtaaaggtaacggtaaggggtaactaacggttaaaggaaaacaaacttaacgaaaactgttaaacgtaaaagtttaactttaaacgtacggtttaccttttacgtaacggtttcccttaaccgttacgtaactttaaattaaccgttttaagtacggttaagggtaaacttaaacgggtcttacgtttaggttttaccgttttacgttttacgttaccgtttaaccgttacccgtttaaacccttaaaccggttcgttaccccggttacgttacggtttaacttaacccgttaaacgtacccccggtaaacttaaaacccgaccccgtaaaccggtaaacccccgggtaggttaaacccttaaaggttttacccttttaaaaccg

SEQ ID NO: 182775 - DNA, 925 bp, Homo sapiens
  misc_feature: GYAE6OF01E5J16.52.73.G07.1.454.CMB.1.raw
  modified_base (167)..(167): a, c, t, g, unknown or other
  misc_feature (167)..(167): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagcgcagtacgacacgaccggtgctcgatttagctctacgctcagggcacgaccggtgctcgatttagctctacgctcagggccctgctctgcgagggtaggttttagcccagcccagccaaagtaacccccgggagcctgttatcccagcacagtcctggaagnggcacgaaggggaaataaagcggacggaggtctttcctgactcagccgctgccgtggtcttctcagtaccttgttctagtaacttcctaaactcgtagggagggggtcgagtcggacggtgcctatttcgttgacctaagctagtttagtacgttacgngtaccaaggtcaaggaaancgtagacgaccgaaacgtccctagaagtaacgtggtaccgtaaggaacgaaaacggtacgaaccctaaaaccccgtaaaaacgtaaaaactttaaacgttttaaaacggtttaaaaacgtttttaaaggttaaaacgggggtaaaaggggttaaacggggggtaaacgtaaaccggttaaaagggtaaaaaccgtaaaacccgttaaacgaaaaaccgttaacgttaaaaccgttaaagtttaaaaccttttaaaacgttacccggtttaacgtttaccggttttacggttaccctttaccggtttaacttacgtttaaatttaaacgtttacgtaacggttacgggtaaattaaccgtgttaacgttcggtttaccgttttacggttttcctttaccgtttcccgtaacccggttaaacccttaaccgttaaccggttcccgttacccggtttacggttacgttaaccttaaccccggtaaccccgtaaaccctaaaaaacccgaaccccgtaaaacccggtaaacccccgggtaaagggtaaccccgttaaacgttttaaacccgtttttaaaacccg

SEQ ID NO: 182776 - DNA, 1095 bp, Homo sapiens
  misc_feature: GYAE6OF01DV5JR.52.73.G07.1.454.CMB.1.raw
tcagcgcagtacgacacgaccggtgctcgatttagctctacgctcagggcacgaccggtgctcgatttagctctacgctcagggcctgctctgcgagggtaggttttacgcccacgcccacgacccgaaaaccggtaaccccccggggacgtcccgttagttactccccgagccaacgacggtaccgtagggaaggacgggaccgaacggaaaggggaaaaagtaaaaagggaccggggaacggggtaacgggttccttttacccgtttacggtaccgtaccgacggtcccggtcgttcggtcccggtttcgggttcccttttccttaccgtaacggttacccgtttcggtttaccttaagttaaacttttaaccgttaaaacgttccggtaggggtacggggggttaccggtaaggtacgggtaacggttcggtacctttacgtttaccgtttaccgaacccgttaaaagtcgttaagtttaggttaaccggttttacgacgggtacgtaaacgggtaaccgaaaaggtaaaacggtcgtaagtaaccgaaccgtaaaccggtaccctaagaaaggtaaacggttcggaacgtaacgaaacgaaaacggtacctaaccttaaaaccgaaaaaacttaaaacgttaaacggttttaaaacgtaaaacgttttaaagggtaaacgggaaaacgggtttaaacgggggaaaacttaacggtaaaacggttaaaaaaccgtaaacctaaaacctaaaacgtattaaaaacggttaaacgttttaaaacgtttaagtaaacccgttttaccggttttaccggtttacgttaccccgtttaacgtttaacgttaacctttaaaagttttacttaaacggttcgggtaaagggtttaactacgtttcgttaacgtttacggtttacgttttttaccgttacgttcgtttacccgttaccgttaaaccccttagttaccgttacccgtaccggtttaagtacccgtttaaccttacggtaaacccaaaacccgtaaaccctacccggtaaacccgtaaacccgggtaacgttaacccttaaacgttttacctttaaaacccg

SEQ ID NO: 182777 - DNA, 752 bp, Homo sapiens
  misc_feature: GYAE6OF01C9PTH.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaaggggaaataaagcggacggaggctttcctgactcagccgctgcctggtcttctcagtacctgttctagaattctaaactctagaggagggtcgatggacgtggacctattctttacgaccttaaaggctagttgtaacgtttactggactaaagggtccaaaggaaacgcaagtacggaccaaacggtcccctagaagaacgtcggactaggacaaaagcgacctaaccgaaaactaaactattttaagtaaactttaagttaaacgggagttaagggggaactacgttaaaaggaacgtaactaacgaaaactagtaactaaagttaacttttaaaagtaccgttactttacgttacggttaccttaccgtttagtaacctttaatttaacgtttaacttacgggtttaagggtaacttaaacggtccttaagttcggtttctttacggtttttcgtacgtttaccgttcgttaaccccttaaagccgtttccgtacccgttaggttagttaacctttacgtaacccgtaacaaaacgacccgtaaacccaccggtaaaggccgtaaagtttaaacccg

SEQ ID NO: 182778 - DNA, 1043 bp, Homo sapiens
  misc_feature: GYAE6OF01A3MWJ.52.73.G07.1.454.CMB.1.raw
  modified_base (355)..(355): a, c, t, g, unknown or other
  misc_feature (355)..(355): n is a, c, g, or t
tcagcgcagtacgacacgaccggtgctcgatttagctctacgctcagggcacgaccggtgctcgatttagctctacgctcagggcctgctctgcagggaggttttagcccagcccagccaaacgtaacccccgggagcctgttactcccagcacagtcctggaagaggcacgaggggaaataaaaggcggacggaggtctttcctgactcagccgctcgccgtggtcttcttcacgtaccttgttctagtaacttacctaaacgtcgtgggtacgggggtcgtagtcggtacggtcggtacctagttttcgtttacgacccgttaaaagtcctaagtttcggtaacgttttacgnggtaaccgtaacggggttaccaaaggtaaaacgcgttaacgtacggtaacgtaaaaccgtccccgtttaagaaacgggtaacgttcgggtaccttaacgggaaacgttaaaaccggaccgtaaaccctaaaccgtaaaaaaacctaaaacctttaacggtttaaactaaaaccgttttaaaggtaaaagggtaaacgggtaaaggggggtaaactaaacggtaaaacgggtaaaaagttaaacctaaaaccgtaaaactaacgttaaaacgttaaaacgtttaaacgttttaaacgtaaccgtttacccgttttacggtttacggtttaccctttaaccgtttacggtttaaactttaacttttaaacgtttaccgtttacgggttaaacgggttaaacctttaaacgggtccttttaaacggttttcgggtaacccgtttttttacggttttaacccgtttcgtttacccgttttaaccccgggttaaaccccttaagggttaacccctttacccgggtttacccgttttaacgggttaaaccttttacccgtttaaacccggttacccggaaaaaacccccgttaaaaacccgtaacccccgttaaaaccccggtaaaaccccgggttaaaagggttaaccccgttttaaaacccgggtttttaaaccccgtttttaaaaacccgg

SEQ ID NO: 182779 - DNA, 894 bp, Homo sapiens
  misc_feature: GYAE6OF01EA0W5.52.73.G07.1.454.CMB.1.raw
  modified_base (138)..(138): a, c, t, g, unknown or other
  misc_feature (138)..(138): n is a, c, g, or t
  modified_base (336)..(336): a, c, t, g, unknown or other
  misc_feature (336)..(336): n is a, c, g, or t
tcagcgcagtacgacacgaccggtgctcgatttagctctacgctcagggcacgaccggtgctcgatttagctctacgctcagggcctgctctgcagggaggttttagcccagcccagaccaaacgtaacccccgggancctgttactcccagcacagtcctggaagaggcacgagggaaataaaggcggacggaggtctttctgactcagccgctcgcctggtcttctcacgtacctgttctagtaacttacctaacgtcgtgggtacggggtcgtagtcgtacgtggtaccttagtttcttacggacctaaagtctaagtttgtaacgtttacgngacgtaagtacgaagaaacggtctaagttacgaccaaaccgtcccgtaagtaaggtaacgtcggtaccgtaaagaacccggaaagtaccgtaacccttaaacccgaaaaaactaaaaacgtttaagttttaaaccggtttaaaacgttttaaaaggggtaaacggggtaaggggtaaacggggtaaactacgggtaaaaacggtaaaacgtaaacctaaacgtaaaacggttaacgttaaacgttaaagtttaaaccgtttttaaacgacccggtttaccttttacgggttaccggtttaccttacccgtttaagttaactttaacgttaacgttacgttacggttaagggtaacttaacgctttaacgggtccttttacgggtttttacttccgttcgtttaccgtaacccttaccgttaacttaccgggttcccgttacggttaagttttcgttaaaacctttccccggtaaacccaaaacccgtaaccttaaaccccggacccgttaaacgggtaccggttaaccggttaaaaccgttttccgttttaaaacccg

SEQ ID NO: 182780 - DNA, 820 bp, Homo sapiens
  misc_feature: GYAE6OF01BNUOR.52.73.G07.1.454.CMB.1.raw
  modified_base (359)..(359): a, c, t, g, unknown or other
  misc_feature (359)..(359): n is a, c, g, or t
tcagcgcagtacgacacgaccggtgctcgatttagctctacgctcagggcacgaccggtgctcgatttagctctacgctcagggcctgctctgcagggtaggttttagcccagcccagccaaaggtaacccccgggagcctgttactcccagcacagtcctggaagaggcacgaaggggaaataaaaggcggaacggaggctttcttgactcgacgccgctgcctggtcttcttcacgtaccttgttctgtaacttactaacttcgtaggagggggtcggtatcggacgtggccctattcttagacctaagctagtgtattactgactaaggtacaagaaagctatagacaacgcctanagacgtggactagacgaagcgtaccaaccgtaaaataaacgtaaagtttaacgtaaaacgttttaaaggtaaaagggaacggttaaggggaaacgtaacgttaaaacggaaaacgtaactaaaaccgtaaacgtaacgttaaacgttaaaaggtttaaacgttttaaacgtaccgtttaccgtttacgtttaacgttacccgtttacttaacgtaacttttaaactaagttttaccgttaacggttacgggtaaatcgtaaccgtacggtttacgttatttttaccggtttagttccttaccgtttaccgtaaccccttaagtcccgttacgtacccggtttaagtccggtttaaacttacccggttaaaccgaaccccgttaaaacccgaaaaccgttacccccggaaaccggttaaacccggggtacctttaaaaccggtttaaactttttaaacccgg

SEQ ID NO: 182781 - DNA, 786 bp, Homo sapiens
  misc_feature: GYAE6OF01DGV9R.52.73.G07.1.454.CMB.1.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
tcagcgcagtacgacacgaccggtgctcgatttagctctacgctcagggcacgaccggtgctcgatttagctctacgctcagggcctgctctgcagggtaggttttagcccagcccagaccaaacggtaacccccgggagacttgtactccccagacacaactccgtaggaagaggacaacgaaggggaaataaagcggacggagtctttcctgactcngccnctgcctgtccttctcacgtaccttgttctagtaacttcctaaactcgtagggtaggggtcgattcggacgtcggtacctagtttccttggaccctaaagtctattggtactttacagacgtaaggtacaagaaagctatacgaaccaacgtcccagaagtagtcggtacagagtaacgacgtacctaaaccaaaaacgtaaaacttaagtttaacgtaaacgtttaaaggtaaaacgggaaggtaacgggggtaaataccgggtaaaaggtaaaacaaacgttaacgaaaaacgtacgttaaagtaaagtttaaacttttaaacgacccgtttactttacggtttaccgtacgtttaccttaggtaaacctttaaagttaacgtttaacgtacggtttaagggtaattaacggtaaccttagttacccgtttagttttaccgttttcgtacgtttcccgtaccttacccgtaatccgttacgtcctttaaggtcttaccttactccgaaacccaaacaccgtaacccgaaccgtaagggtaccttaaacggttactttaaacc

SEQ ID NO: 182782 - DNA, 159 bp, Homo sapiens
  misc_feature: GYAE6OF02H65WZ.52.73.G07.1.454.CMB.1.raw
  modified_base (157)..(159): a, c, t, g, unknown or other
  misc_feature (157)..(159): n is a, c, g, or t
tcagcgcagtacgacacgaccggtgctcgatttagctctacgctcagggcacgaccggtgctcgatttagtcacgcgagaagggaagggctggccctgacgtgttctgttccaccctcctctatacgatcgctgagcgggctggcaaggcgcatagnnn

SEQ ID NO: 182783 - DNA, 567 bp, Homo sapiens
  misc_feature: GYAE6OF02H3PX0.52.73.G07.1.454.CMB.1.raw
  modified_base (347)..(347): a, c, t, g, unknown or other
  misc_feature (347)..(347): n is a, c, g, or t
  modified_base (389)..(389): a, c, t, g, unknown or other
  misc_feature (389)..(389): n is a, c, g, or t
  modified_base (429)..(429): a, c, t, g, unknown or other
  misc_feature (429)..(429): n is a, c, g, or t
  modified_base (502)..(502): a, c, t, g, unknown or other
  misc_feature (502)..(502): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgaggggtcgatgacgtggccattcttgccttaaagcattgagtttactgcaaggtcaagaaagcatgcaaagccctacagaatggctagcaaagngctaccaacaaaacattagaactttataaggaataggggaancgtaaggaagaaactacaaacatacaaagtaattttaaanacgtctttacttggtctacttgacttataattatctaggtataagcatgtcttgtttctgttctgtccctaantacgcccttagtctacttactccgtacaaacgtaacacaacccgaagggactagtaacttttacg

SEQ ID NO: 182784 - DNA, 130 bp, Homo sapiens
  misc_feature: GYAE6OF02GZXPK.52.73.G07.1.454.CMB.1.raw
  modified_base (129)..(130): a, c, t, g, unknown or other
  misc_feature (129)..(130): n is a, c, g, or t
tcagcgcagtacgacacgaccggtgctcgatttagctctacgctctaagggaaagggggctggccctagcgtgttcctgttcccgccctcctctatacgatcgctgagcgggctggcaaggcgcatagnn

SEQ ID NO: 182785 - DNA, 578 bp, Homo sapiens
  misc_feature: GYAE6OF02JXO4H.52.73.G07.1.454.CMB.1.raw
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (372)..(372): a, c, t, g, unknown or other
  misc_feature (372)..(372): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttcctgactcagccgctgcctggtcttcttcagacctgttctgaattctaaactctgaggggtcgatgacgtggccattcttgcctaaagcattgagtttactgctaaggtcagaaaagcatgcaaagcctnagaatggctagacaaagngctacaacaaacatttagaactttaanaagaatagggganactaaggaanaaactcaaacatacaagtaatttaaatacgattacgttaggtactaccgttagtacttaagttaacttaatctagggattaagcgtatggtactttagtttcttagtccttagtaccctaactatcgtccttagtactattactccgtacaaactacacaaccaggtacctagtactttaacg

SEQ ID NO: 182786 - DNA, 637 bp, Homo sapiens
  misc_feature: GYAE6OF02G6H0Q.52.73.G07.1.454.CMB.1.raw
  modified_base (330)..(330): a, c, t, g, unknown or other
  misc_feature (330)..(330): n is a, c, g, or t
  modified_base (396)..(396): a, c, t, g, unknown or other
  misc_feature (396)..(396): n is a, c, g, or t
  modified_base (407)..(407): a, c, t, g, unknown or other
  misc_feature (407)..(407): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgaattctaaactctgaggggtcgatgacgtggccattcttgcctaaagcattgagtttactgcaaggtcaagaaagcatgacaaagccctanagatggctgacaaagagactaccaaacaaactaatttaagaactttaataaggaataagggggaanacgtaaggaanaaactacaaaacatacaaagtaatttaaatacgtacttacttaggtactacttagtacttaattaatttattacgttagggtaattaaagtctaagttgtactttgttttcttcgttcttcgtacccttaactacgttacgtcccgttaggttacgttaactttaactacccgtaacaaacctaaccaaccgtaacccgaacgggtacctaacggttaaccttttaaccg

SEQ ID NO: 182787 - DNA, 115 bp, Homo sapiens
  misc_feature: GYAE6OF02G5GNP.52.73.G07.1.454.CMB.1.raw
  modified_base (113)..(115): a, c, t, g, unknown or other
  misc_feature (113)..(115): n is a, c, g, or t
tcagcgcagtacgacacgaccggtgctcgatttagctctacgctcagggcacgaccggtgctcgatttagtcacgcgagaaagggagaggcggctggacgaaggccgcatagnnn

SEQ ID NO: 182788 - DNA, 762 bp, Homo sapiens
  misc_feature: GYAE6OF02H3GCQ.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaccccgggagcctgttatcccagcacagtcctgggaagaggcacgaggggaaataaagcggacggaggctttacctgactcagccgctgcctggtcttcttcagacctgttctgaattctaaactctgaggggtcgatggacgtggccattctttgccttaaagcattgagtttactgacaaggtcagaaaagcatgacaaacgccctacaagaatggactagacaaagagctaccaaacaaaactatttaacgaaactttaagttaaaaggaagttaagggggaagtacgtaaagggaaagtaaaaccgtaacgaaaaacaacttaacgtaaaaggttaaatttttaaaaagtaccggttactttaccgtttacgggttaccttaccgttttagaacctttaaacttaaagttttaagttaccggttaaggggtaaattaaacggtacctaagttacgttaccgttttggtttttacgttcgtttaaccttacggttaacccccgttaaattacgttaccggtaccccttagggttacgttaacttttaaccgttacccgaacccgtaaaaactaacccgaacccgtaaacccccgtaaaggggtacctaaaccgggttaacttttttaaacccggg

SEQ ID NO: 182789 - DNA, 169 bp, Homo sapiens
  misc_feature: GYAE6OF02IWNNX.52.73.G07.1.454.CMB.1.raw
  modified_base (111)..(111): a, c, t, g, unknown or other
  misc_feature (111)..(111): n is a, c, g, or t
  modified_base (155)..(155): a, c, t, g, unknown or other
  misc_feature (155)..(155): n is a, c, g, or t
  modified_base (159)..(169): a, c, t, g, unknown or other
  misc_feature (159)..(169): n is a, c, g, or t
tcagcgcagtacgacacgaccggtgctcgatttagctctacgctcagggcacgaccggtgctcgatttagtcacgcgagaaagggaaaggggctggccctgacgtgtttcngttcccacctcctctatacgatcgctgagcgggctggcaaggcnatgnnnnnnnnnnn

SEQ ID NO: 182790 - DNA, 626 bp, Homo sapiens
  misc_feature: GYAE6OF02JG0YC.52.73.G07.1.454.CMB.1.raw
  modified_base (296)..(296): a, c, t, g, unknown or other
  misc_feature (296)..(296): n is a, c, g, or t
  modified_base (326)..(326): a, c, t, g, unknown or other
  misc_feature (326)..(326): n is a, c, g, or t
  modified_base (344)..(344): a, c, t, g, unknown or other
  misc_feature (344)..(344): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagcggacggaggctttcctgactcagccgctgcctggtcttcttcagacctgttctgaattctaaactctgaggggtcgatgacgtgccattcttgcctaaagcattgagtttacngctaaggtcagaaagcatgacaaagccctnagaatggctgacaaagcnctaccaaacaaactatttagaactttaagtaaggaagtaggggaanacgtaaggaanaaactacaaaactatacaaagtaatttaaatacgtactttacgttagtcttaccttgtacttaataactttacgtctagggattaacgctatcgtcttagttttcgtagttaccttacgtacccttaatacgttcgtacccgttgttacgtaatttaaccgtcccgtaactaaaccgaacctaaccgaaccccgtaagggtacctaacggttaaccttttaacgg

SEQ ID NO: 182791 - DNA, 632 bp, Homo sapiens
  misc_feature: GYAE6OF02I0W5U.52.73.G07.1.454.CMB.1.raw
  modified_base (354)..(354): a, c, t, g, unknown or other
  misc_feature (354)..(354): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagacctgttctgtaattctaaactcgtgaggggtcgatgacgtggccattcttgacctaaagctattgtagtttactgcaaggtacagaaaagcagtgacaaacgccctcaagatggctgacaaagngactaccaaacaaaacgtaatttaagaactttaagtaaacggaaagtaagggggaaatacgtaagggaaacgaaactacaaaactataacaaagtaattttaaanacgtacttnttaggtcttaccttgtactaattaacttatacgtggtaatagctattgtacttagtttctgttctacgtacctaactcttacgtccttggtaacgttattaactacccggtaactaaaccgaaccaaccgaacccgtaacgggactaacgttaacttttaaccg

SEQ ID NO: 182792 - DNA, 656 bp, Homo sapiens
  misc_feature: GYAE6OF02J2SRF.52.73.G07.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (314)..(314): a, c, t, g, unknown or other
  misc_feature (314)..(314): n is a, c, g, or t
tcagcgcagtacgacacgaccggtgctcgatttagctctacgctcagggcacgaccggtgctcgatttagtacacgtgattagggattgggggagtcagtcccaaccaggacacagcatggacatgagggtaccctgctcagctcctggggctcctgctgctctggctctcaggtgccagatgtgacatccagatgacccagtctccatcctccctgtctgcatcngtagganacagagtcaccttcacttgccggcgagtcaggactattacgacaactattaaattggtatcagctaagaaccagggaaacncccctaaactcctgaactctaacgactgacactaccaagttttcggacgtacgaccggggttacccagtaccgtaacgttaccgtaacgtacggaagttacgggagttaccggtacgggtaacctaacgttaactttttaacccgttactaacctacttaccgtaacgcccggtacgtacggacgaacggtcctagtaacgttacgttttacggaacctaaactaacggttactttaacctggttaaccaacgtaacttagtaaggtaactacgttacccttaccccttacgtaccgtttacgggaccggtaaccgggtaccgtaacgggtcggtaaaccgg

SEQ ID NO: 182793 - DNA, 767 bp, Homo sapiens
  misc_feature: GYAE6OF02IVU7G.52.73.G07.1.454.CMB.1.raw
tcagcgcagtacgacacgaccggtgctcgatttagctctacgctcagggcacgaccggtgctcgatttagctctacgctcagggcctgctctgcagggaggtttagcccagcccagccaaagtacccccgggagcctgttatcccagcacagtcctggaagaggcacgaggggaaataaagcggacggaggctttcctgactcagccgctgcctggtcttctcagacctgttctgaattctaactctggaggggtcgatggacgtggcctattctttgacctaaagctattgtagtttactgacgaaggttcaaaggaaaacgtcaagtcgaaccaaacgtcccctaagaacgtaatcgggacttacggacaaaaggacgaccctaacccaaaaactaaaactaagttttaacgtaaaactttttaaaggtaaaagggtaaaggtaaggggggtaaactaacgggttaaaacgggaaaacgtaaaccgttaacaaaaacgtataaccgtaaaagttaactttttaaaacgtacgttactttacgttacggtacctttacgttagttaacttaagttaacttagttacgttagggtaacttaacgtacgtattacggttcttttacgttttcgttacgttccttacgttacccctaattacgttacgtacccgtttaggttacgttaacgtttaactaacccgtaaccttaaaccaacccgtaaccgtaaccccggaaggtaaccgttaacgttaacccgttttaacg

SEQ ID NO: 182794 - DNA, 796 bp, Homo sapiens
  misc_feature: GYAE6OF02IXUN9.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagtggacggaggctttccttgactcgagccgctgcctggtcttcttcagtacctgttctgtaattctaactctggaggggtcgatgacggtcggcctattctttgaccgtaaagcctagttcgtagttttactggtacaacggtcaagtaaaagctaagtacgacaaacgtccctactaggaatggtctagacgaaagacgtactaacccgaaacctaaaaataacttttaacggaaactttaacgttaaaggtaaagtaacgggggaatacgtaaggaaacgtaaactaacaaacgtaataacaaagttaaacttttaaagtacgtacgtttacgttacggttaccttaccgtttacgttactttaactttaaactttacggttacgttacgggtaagttaaacgtacgttaactttacggttacctttttaacggtttttcctttaacggtttacctttacccggttaaacccgttaaccgtacgttaccggttacccgttaggtttaccttaacgttttaccgtaacccgtaaacccgttaaaaccgtaaacccgtaaccccgtaaaccggtaacggggtaaccttaaccggttaaccgtttttaaaacccgg

SEQ ID NO: 182795 - DNA, 739 bp, Homo sapiens
  misc_feature: GYAE6OF02JA76G.52.73.G07.1.454.CMB.1.raw
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaggggaaataaaagcggacggaggctttccttgactcagccgctgcctggtcttctcagacctgttctgaattctaactctggaggggtcgatgacgtggccattcttgcctaaagctattgagtttacngcaaggtcaagaaagcatgacaacgccctanagtaatggctagacaaagcgctaccaaacaaaactatttaacgaaacttttagtaaagggaaagttaaggggggaatacgttaaagggaaacgtaaaaccttacaaaaacgtataaaccgtaaagttaaacgtttttaaaagtaccgttacgttttacgtttacgggttaccctttacccgttagtaacctttaaagtttaacgtttaacgtacggttagggtaacttaacggcttaagttcggtacttttacggttttactcggtttaccttaccgtttaccctaaagtacgtttaccgtcccgtttagttacggttaaactttaccgtaacccgtaactaaaacccgaccgttaacccgaacccggttaacggggtaccctaacggtttaacccgttttaaacccg

SEQ ID NO: 182796 - DNA, 720 bp, Homo sapiens
  misc_feature: GYAE6OF02HFLI3.52.73.G07.1.454.CMB.1.raw
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttccttgactcagccgctgcctggtcttcttcagtacctgttctgaattctaactctgaggggtcgatgacgtggcctattcttgcctaaagcattgagtttacngacaaggtcagaaagcatgacaaagccctanagaatcggatgacaaagcgactacaaacaaactatttacgaactttaataaggaagtaggggaatacgtaaggaacgtaaacgtacaaaacgtactacgaaagttaattttaaacgtacgttactttaccgtttaggttacccttaccgtttaggtacctttaatttaaagttttaactacggttaggtaacgtttaaacggtactaagttcggtactttttcggtttttaccgttcgtttccgtttacgttaccccttaaacgtacgttaccggttacccttaggttacgttaaccgttttaccgacccggttaaccgttaaaacctaacccgtaacccgtaacccccggtaaagggtacccttaaggttttaaacccgttttaacgg

SEQ ID NO: 182797 - DNA, 793 bp, Homo sapiens
  misc_feature: GYAE6OF02F8OZO.52.73.G07.1.454.CMB.1.raw
  modified_base (301)..(301): a, c, t, g, unknown or other
  misc_feature (301)..(301): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaagcggacggaggctttccttgactcagccgctgcctggtcttcttcagacctgttctagtaattctaaactctaggaggggtcgatgacgtgccattcttgcctaaagctatgagtttacngacgaggtcaaggaaaagcaagtcgacaaacgtcccctacaagtaagtcgggactaggacgtaaaagacggtacctaaccgaaactaaaactaagtttaaacgtaaacttttaaagttaaaacggggaaagttaagggggggtaaatacggtaaagggaaaacgtaaactaacgaaaaacgacgtaacctaaaggttaaactttttaaacgtacgttacgtttacgttacggttaccgttaccgtttaggtactttaacgtttaaacgtttacgttcgggttaagggtaacttaaacggtcttaagttacgttacgttttacgttttaccgttacgtttactttacccggttaacccttaaacgttaccgtttccgtacccgttttacggtaacgtttaactttaaccgtacccggtaaaccctaaaacctaacccgaacccgttaaccccggaaacgggtccttaaaccggttaaccttttttaaacccgg

SEQ ID NO: 182798 - DNA, 916 bp, Homo sapiens
  misc_feature: GYAE6OF02FZ2J6.52.73.G07.1.454.CMB.1.raw
  modified_base (172)..(172): a, c, t, g, unknown or other
  misc_feature (172)..(172): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagccgtcgttatcccagcaccagtcctggaagaggcanaggggaaataaagcggacggaggctttctgactcagtccgctgcctaggtcttcttcagtacccgtgttcgtgtaacttacttaaactcgtagggtacgggggggttacgaagtacggtaccggttcgggaccctagtttacgttttccggaaccttaaaacggtctaacgtttggtacgttttaaccgtgtccggtaaaggttccgaaaggaaaaagtccaattacgggaaccttaaaaccgggaccccctttagaacgttaaacggttaccgggtacttacgggaactaaaaagggacgtaccgtaaacccgaaacaaaaaaccttatttttaaaccggtaaactttttaaaacggtaaaacggttaaagggttaacggggggtaaacggttacgttaaagggaaacgttaaaaccgttaaccggaaaactaaacgttaaaccgtaaagttaaacgttttaaaagttaacgttacgttttaacgttacgggtttaaccttccgttttaccgttaacgttactttaaagttaacgttaccgttagggtaaacgttaacgtaaccgttagttaccggtacttttacgttttaccgttacgtttacgttaccgtttaacccgtaacttaacgttccgttaacccgtttcgggtttaacggttaacctttccgtaacccggttaacaaaacccgttacgaaaccccaaccgggtaaccggaaccgttaaccttaacgttttaccgg

SEQ ID NO: 182799 - DNA, 843 bp, Homo sapiens
  misc_feature: GYAE6OF02GKV11.52.73.G07.1.454.CMB.1.raw
  modified_base (382)..(382): a, c, t, g, unknown or other
  misc_feature (382)..(382): n is a, c, g, or t
tcagcgcagtacgacacgaccggtgctcgatttagctctacgctcagggcacgaccggtgctcgatttagctctacgctcagggcctgctctgcagggaggttttagcccagcccagccaaacgtaacccccgggagcctgttatcccagcacagtcctggaagaggcacgagggaaataaaagcggacggaggctttcctgactcagccgctcgcctggtcttcttcacgtaccttgttctgtaacttactaaactcgtggaggggtcggatggacgtggcctatttcgttcacctaaagctattgtagtttactggacgtaaggtcaaggtaaaacgcagtacgaccaaacggtccagaagtatcggactagacaagacncctaacaaacaaactaagttaacgtaactttaagtaaaggaaggtaaggggaaactcggtaaaggaaaccggtaaactaacgtaaaacacgttaaacgtaaagtttaaattttaaacgtaacgttcgttttaacgttacggttaccctttaccgttaagttaactttaagtttaaacttaacgttacgttaagggtaactttaaacggctttaaacggttcgtttaacgtttttcggtttttttaacccgtcggttttaacccgttacccggtttaaaccccgttttaaacgtacccggttttacccgggtacccggtttttaaacggtttcgttaaaaccccgttttttaccgaaccccgttaaaaccccgtaaaaaccgtaaaccccgtaaccccggtaaaaccccggttaaaccgggggtaaaccttaaacccggtttttaaccgttttaaaccccgg

SEQ ID NO: 182800 - DNA, 860 bp, Homo sapiens
  misc_feature: GYAE6OF02HGR39.52.73.G07.1.454.CMB.1.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaaggggaaataaaaggcggacggaggctttccttgactcagccnctgcctggtcttcttcagtccttgttctgtaacttactaaactcgtggacggggtcgagtgacgtggcctattctttgacctaagctattgacgtttacngacgtaaggtacaaagaaagcatacgacgaaacgtcccacaaggtaatcgggtctagactaaaacggcgtaacctaaacccaaaaactaaaacgttaaacgttttaaacgtaaactttttaaggtaaaagggtaaaggttaaggggggaaactacggtaaagggtaaaacaaaacgttaacaaaacgtaattaaccgtaaaagtttaaactttttaaaacgtaccgttacgttttacgttacgtttaccgttaccttaggttaaacctttaagtttaacttacgttacgttaagggtaacttaaacggtacgttaacgttcggtttacgtttttacccgtttttcgtttaccggtttacccggtttaaccgtttaaaccccgtttaaacgtcgtttacccgttacccggtttttacggttaccgttttaaacccgtttaaccgtaaccccgttaaaaccgtaaaaacccgtaaaccccgtaacccgtaaacccggttaaaaccgggtaacccggtttaaaccgtttaaacccgttttttaaacccg

SEQ ID NO: 182801 - DNA, 652 bp, Homo sapiens
  misc_feature: GYAE6OF02JYAY5.52.73.G07.1.454.CMB.1.raw
  modified_base (314)..(314): a, c, t, g, unknown or other
  misc_feature (314)..(314): n is a, c, g, or t
  modified_base (566)..(566): a, c, t, g, unknown or other
  misc_feature (566)..(566): n is a, c, g, or t
  modified_base (576)..(576): a, c, t, g, unknown or other
  misc_feature (576)..(576): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaggggaaataaagcggacggaggctttccttgactcagccgctgcctggtcttcttcagacctgttctagtaattctaaactctaggaggggtcgagtggtacggtggcctattcgttcgacctaaagctagttgtagtttacngacaaggtcaagaaacgcagtgacaacgcctagagtaagtggactacgactaaagacgaccgtaaccaaactaaaactaacgtttaaagtaaacttttaagtaaagggtaaacgtaaggggggtaaactaaccggtaaaagggaaacgttaaacgtaacgtaaaacgtaactaaacgtaaagttaaatttaaacgtacgtactttacgttacggttacttacgttatacttattaacgttatacgtaggtanaagtctagtntacgttgttcgtcgtctacgtacctatctacgtactgtcgtatacgtcacaacacacgaccgagctacgtattacg

SEQ ID NO: 182802 - DNA, 980 bp, Homo sapiens
  misc_feature: GYAE6OF02HP5X8.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaacgtaacccccgggagcctgttactcccagcacagtcctggaagaggcacgaaggggaaataaagcggacggaggtctttccgttgactcagccgctgcctggtcctttcttcagaccttgttctgtaactttacctaaaccttcgtgggagggggtcgagtcggtacggtcggaccctagtttccgttttacgaccgttaaacgacctagtttaggtaacgtttttaccgtaggtacccgtaaagggttaccgtaaaggaaaacgtctaaggtacgaaccgtaaaaccggtcccctaacgaacggtaagttacggtaccgttaacggaacgtaaaacggtacgaaccttaaaccccgaaaaactaaaaaacgttaaagttttaaaacgtttaaaacgtttttaaaacggtaaaacgggttaaaagggttaaacggggggtaaacgtaaacggttaaaacgggtaaaaaccgtaaaaaccgtaaaccgtaaaaactaacgttaaaacgttaaaaacgtttaaacgttttttaaaaacgtaacccgtttacgttttaaccggtttaacggtttacccgtttacccgtttaacggttaacttttaaacgtttaaacgtttaacgttaaccggtttaaggggtaaacttaacggtaccttaagtttacggttttacgttttcgtttttaccgtttcgtttaccctttacggttaaccctttaacttaccggtttaccgttacccgtttacgggttaacttacgtttaaccgtaacccgtaaaccgtaaaacccgtaaaccgtaacccggttaaaccccgaaacggggtaacccttaaacgggtttaacccgttttaaacccg

SEQ ID NO: 182803 - DNA, 857 bp, Homo sapiens
  misc_feature: GYAE6OF02IL21Q.52.73.G07.1.454.CMB.1.raw
  modified_base (137)..(137): a, c, t, g, unknown or other
  misc_feature (137)..(137): n is a, c, g, or t
  modified_base (218)..(218): a, c, t, g, unknown or other
  misc_feature (218)..(218): n is a, c, g, or t
tcagcgcagtacgacacgaccggtgctcgatttagctctacgctcagggcacgaccggtgctcgatttagctctacgctcagggcctgctctgcagggtaggttttagcccagcccagccaaacgtacccccgggancctgttactcccagcacagtcctggaagaggcacgaaggggaaataaaggcggacggaggcctttacgtgactcgacgccnctgccttggtcctttcttcacgaccttgttcagtaattcctaaacgttctagggacggggtcgacgtacgacgggtcgtaccttagtttcgtttacgaccgttaaaaggcttagttcgtaagttttactggaccgtaagggtacaaaaggtaaacgcgtagtcgaaccgaaacgtcccctagaaggtaccgtaggtcctacggaacgtaaacggctaacccgtaacccaaaagttaaaacttacgtttaaacgtaaacgtttacgttaaaagggaacggtttaaaggggaaactaccggttaaaaggaaaccgtaaaccgttaaccgaaaccttagttaacgtaaacggtttaaacttttaaagtcccgttaacgttttccgttacggttttaccctacgtttaacggtacttttaacgttaacgttttacgacgggttaaggttaaaccttaggaacttacggttacccgtttgtttttaacccggtttacgttacgtttacccgtttacccggttaaccgttacgtttaccgtaccggttacctttagggtaaccggtttaacccttacgaaccccgtaaagtaaacccacccgtaaccggtaaaccgcgggttaacctaacgttttacgttaaccg

SEQ ID NO: 182804 - DNA, 738 bp, Homo sapiens
  misc_feature: GYAE6OF02IFV9N.52.73.G07.1.454.CMB.1.raw
  modified_base (497)..(497): a, c, t, g, unknown or other
  misc_feature (497)..(497): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgagggaaataaaagcggacggaggctttcctgactcagccgctgcctggtcttcttcagacctgttctgtaattctaaactcgtaggaggggtcgatgacgtggcctattctttgcctaaagctagttgagtttactgactaaggtcaagaaaagctaagtagactaaacgccctacagaactggactagaccaaagtacgacctaccaaaaactaaaacgtaatttaacgtaaacgttttaagtaaaagggtaaggtaaggggaagtaacgtaaggaaaagtaaacctaacaaaactagttaaacgaaaagttaaacttttaaaacncgttaccttacgttacggttaccttcctttaaggtaacctttaattaaagtttacgttacgtaagggtaacttaaacggtacttaagttggtaccttttaggttttaccgtttacgttcttaccggttacccttaaacgtcttacgtccctttaggtacgttaaccgtttactacccgtaaactaaaccgtaacgaacccgtaacccggtaaagggacctaacggttaaccttttaaccgg

SEQ ID NO: 182805 - DNA, 841 bp, Homo sapiens
  misc_feature: GYAE6OF02FW6NE.52.73.G07.1.454.CMB.1.raw
  modified_base (318)..(318): a, c, t, g, unknown or other
  misc_feature (318)..(318): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacgaggggaaataaagcggaggaggtctttccttgactcagccgctgcctggtcttcttcacgtaccttgttctagtaacttctaaactcgtgggaggggtcggatcggacgtcggcctatttcttcgacctaaagctattgtagtttacngtactaggtacaaggaaagctagtacgacaaacgtccctaagtagtaagtcggtactaggaacgaaagaccgtacctaaccaaaacctaaaaacgtttaactttaacggttaaacttttaaacggttaaaagggaaaggttaaacggggggaaactacggtaaaagggtaaaccgtaaaaccgttaaccaaaacgtaataaccgtaaaagttaacgttttaaaacgtacgttaccttttacggttacgttacctttaccgtttaacgtacgtttaactttaaagttacgttacgttaggtaaacgttaacgtacgtaacgtttacgttccgtttacggtttttacttccggttaccgtttaccggttaacccgttaaaccgttccggttacccgttacctttacgggttaattaacccgtttaaccgttaacccgttaaacctaaaaccccgggtaacctaaaccccggtaacccggtaaacgggttaacccgtttaaaccggtaaccgtttttaaaccccgg

SEQ ID NO: 182806 - DNA, 674 bp, Homo sapiens
  misc_feature: GYAE6OF02FMQ2F.52.73.G07.1.454.CMB.1.raw
  modified_base (299)..(299): a, c, t, g, unknown or other
  misc_feature (299)..(299): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaacccccgggagcctgttatcccagcacagtcctggaagaggcacaggggaaataaaagcggacggaggctttcctgactcagccgctgcctggtcttcttcagacctgttctgaattctaaactctgaggggtcgatgacgtggccattcttgacctaaagcattgagtttacngcaaggtcaagaaagcatgacaaacgcctcgagaagtggactaggacaaaaggcgacctaaccaaaacgaaaactaatttaaacgaaacttttaagtaaaggaaagttaaggggggaaactacgtaaagggaaacgtaaacgtaacaaaacgtaataactaaagtaacttttaaatacgtactttacgttacggtcttaccttagtacttaattaattagtacgttaggtattaacgtactaattcggtactttcggttttcttgtttccttacgttaccctaacgtcttcgtcccgttagttacgtaactttacgtacccgtactaaaccgacctaaccgaacccgtaagggtaccgtaacgttaatttaacgg

SEQ ID NO: 182807 - DNA, 939 bp, Homo sapiens
  misc_feature: GYAE6OF02G38TB.52.73.G07.1.454.CMB.1.raw
  modified_base (138)..(138): a, c, t, g, unknown or other
  misc_feature (138)..(138): n is a, c, g, or t
  modified_base (146)..(146): a, c, t, g, unknown or other
  misc_feature (146)..(146): n is a, c, g, or t
  modified_base (168)..(168): a, c, t, g, unknown or other
  misc_feature (168)..(168): n is a, c, g, or t
  modified_base (219)..(219): a, c, t, g, unknown or other
  misc_feature (219)..(219): n is a, c, g, or t
  modified_base (249)..(249): a, c, t, g, unknown or other
  misc_feature (249)..(249): n is a, c, g, or t
tcagcgcagtacgacacgaccggtgctcgatttagctctacgctcagggcacgaccggtgctcgatttagctctacgctcagggcctgctctgcagggtaggtttagcccagcccagaccaaacgtaacccccgggancctgttanccccagcacagtcctgggaagnggcacgaaggggaaataaaggcggacgggaggctttccttgactcagccgntcgcctggttcttcttcgacgtacccgttntagtaattacctaaactcgtcggaagggggtcgtatcggtacggtcggaccttagtttccgttacgaccccttaaaggcttaagtttacggtagtttttaccgtaggtaacggtaaacggttcgtaaaacggaaaacgtaccgtaacgtacgaaccgtaaaccggtcccccttaagaacggtaaacggttccgggacgttaacccggaaagaaaaccgggtacgtaaccctaaacccgtaaaaaactaaaaaccgttttaagttttaaaccgttaaaacctttttaaaagggttaaaaaccggggtaaaaggttaaacggggggggtaaaaccttacggggtaaaacgggtaaaaccgtaaaaccgttaaaaccgtaaacgttaaacgttaaacgttaaaacgtttaaacgtttttaaaacgttacggttaccgtttttaacgttacgggttaaccctttaccgtacttaaccggtttaattaacgtttacgtacgttacggtaagttaaccgtcttagttaccggttattttacggttttctaccgtttacgttttaccgtaaaccttaacggtccttaccgttaccgttacggttaacgttacgttacggtaaccccaaactaaacctaacccgaaccttacccggggaacgttaactaaccggtttaaccgttttacttaaaccccg

SEQ ID NO: 182808 - DNA, 772 bp, Homo sapiens
  misc_feature: GYAE6OF02GXABG.52.73.G07.1.454.CMB.1.raw
  modified_base (307)..(307): a, c, t, g, unknown or other
  misc_feature (307)..(307): n is a, c, g, or t
tcagcgcagtacgacacgaccggtgctcgatttagctctacgctcagggcacgaccggtgctcgatttagctctacgctcagggcctgctctgcagggaggttttagcccagcccagccaaagtaaccccggagcctgttatcccaagcacagtcctggaagaggcacgaggggaaataaaagcggacggaggctttccttagactcagccgctgctggtcttctcagacctgtctagaatctaaactctggaggggtcatagacgtggacctagttcttagacctaaagtcaattagtacgttacnggtacaaaggttcaaagaaaacggcaagtcggaactaaaacgcctactaaggaagtggacgttacgaaccaaaggtcaacccgttaaccaaaaactaaaaaccttagtttaaaacgtaaaccttttaaaggtaaaacggaaggttaagggggaaacctaggtaaacgggtaaaaaaacccttaaagtaaaacaaagttaaaccgaaagtttaaacttttaaaacggtaacctacgtttacccgtagggttacctacctttacggaacctttaagttaaatttacgtaacgttaggtaaagttaaccgaagttaacgttgttaacccgtttgttttacgtacgtttagttaccgtaacccttaaagtactccgggtacccttaaggtacgttaactacgttaaacccgaacgtaaaacctaaccgaaaccctaaccgaacgggaactaaccggtttatttaaaccg

SEQ ID NO: 182809 - DNA, 1052 bp, Homo sapiens
  misc_feature: GYAE6OF02GAOH2.52.73.G07.1.454.CMB.1.raw
tcagcgcagtacgacacgaccggtgctcgatttagctctacgctcagggcacgaccggtgctcgatttagctctacgctcagggcctgctctgcagggaggttttagcccagcccagccaaacgtaaccccgggagcctgttactcccagcacagtcctggaagaggcacgaggggaaataaaagcggtacggaggctttccgttgactcagccgctgcctggttcttcttcacgtaccttgttctgtaattacctaaactcgtggaggggtcggagtggacgtcggcctagtttctttacgacctaaagtctaagtttgtacgttttacgtcgacgtaaacggtcgaaaggaaaacgtctaacgtcgaaccgaaaccggtacccctaacgaaggtaaacgtttcgggaccttaggaaactaaaacggacccgttaacctaaaacctaaaaaccgttaaaaacgtttaaattttaaaaccggtttaaaaacgtttttaaaacggggtttaaaaaggggtaaaaacggggtttaaggggggggaaaacccttaacgggggttaaaaacgggttaaaaaccgtaaaaacccggttaaacctaaaaaaaccgtaacgtttaaaaaccgggttaaaaaacgggtttttaaaattttttaaaaaaccggttaacccggtttaaccgttttttaaacccggtttacggtttaaaccccgttttcccgtttaaacgggtttaaaccctttaaacgttttaaacgttttaaaccgttaccggttaaggggtttaaaacttaacgtaccggttaaacggttccggttttaacccgttttttagtttttaccgtttaccgggtttaccgtttaaaccccgttttaaccgttaaaacccggtaggtttacccggtacccgttttaggtttaacccgggtttaaccttttaaacccggtaacccccggttaaacgttaaaaacccccgtaaaccctaacccggggttaaaacccggtaaacggggttaaccttttaaaacccgggtaaccgtttttttaaaacc

SEQ ID NO: 182810 - DNA, 800 bp, Homo sapiens
  misc_feature: GYAE6OF02HOQAT.52.73.G07.1.454.CMB.1.raw
  modified_base (593)..(593): a, c, t, g, unknown or other
  misc_feature (593)..(593): n is a, c, g, or t
  modified_base (619)..(619): a, c, t, g, unknown or other
  misc_feature (619)..(619): n is a, c, g, or t
  modified_base (653)..(653): a, c, t, g, unknown or other
  misc_feature (653)..(653): n is a, c, g, or t
tcagcgcagtacgacacgaccggtgctcgatttagctctacgctcagggcacgaccggtgctcgatttagctctacgctcagggcctgctctgcagggaggttttagcccagcccagccaaacgtacccccgggagcctgttatcccagcacagtcctggaagacggcacaggggaaataaaagcggacggaggtctttccgtagactcgagccgctgcctggtcttcttcagtaccttgttctagtaattactaaactcgtaggtagggggtcgacgtggtacggtcggtcctagttccgtttacgaccgttaaaacgtctaggtttagtacggtttactaggtaccgtaaagggttaccgaaaggtaaaaacgcctaagtacggtaaccgtaaaacggtcccctaagaacggtaagttacggacgtacgaccgaaaaggtccaacctaaaccctaaacgtaaaaacttaaacgttaacgtttaaaccttttaaaggtaaaccggtaaagggttaacggggaacttacgtaaagggtaaacgtaaactaacgaaaactagtaacgtaaacgttaaatttaaactaccggttntacgtttcgtaccgtttaccgtagtntttaaactaagtttagccgttaaggattaacgtntaagttcgtcctttaggtttcctgtttaccgtaccgttaacctaacgtacgttcccgtaccgttaggtaacggtaccttacggtacccgaaacaaacctaccgaaccgtaaccggtaacggtacgttaaacgttacccgtttaaacg

SEQ ID NO: 182811 - DNA, 737 bp, Homo sapiens
  misc_feature: GYAE6OF02HQ62W.52.73.G07.1.454.CMB.1.raw
  modified_base (422)..(422): a, c, t, g, unknown or other
  misc_feature (422)..(422): n is a, c, g, or t
tcagcgcagtacgacacgaccggtgctcgatttagctctacgctcagggcacgaccggtgctcgatttagctctacgctcagggcctgctctgcagggtaggttttagcccagcccagaccaaacgtaaccccgggagcctgttactcccagcacacgtcctaggaagaggcacgaaggggaaataaaggcggacggaggtctttcctggactcagccgcgttgccgtggtccttcttcagtaccttgttctgtacttactaaacttcgagggtaggggtcgacgtgtacggtggccctattttccgttagacccgtaaaggtcctaagtttcgtacgttttacgtgaccgtaaacggtcaaacgaaagtccaagtcgaactaacggccctagaacgtaatcgggttacagaacaaacggtntaaccctacaaaaactaaaggttaagtttaactaaacgttttaaggaaaggtaacggtaaggggtaacacggttaaggaaaacgttaacaactaaaacgctaaacgtaaacgttaaattaaacgtacgttacgtttaaggttcgttacttacgttacttacgttaattaacttctaagtaggaacttagtactaatcgtacttgtttacttgttaccgtctaacctagtcgtcgttaccgttagtcgttaacttacgtacccgaactaaccgtaacccaccggtaccgaacgggaccttaccggtaagtttaccc

SEQ ID NO: 182812 - DNA, 421 bp, Homo sapiens
  misc_feature: GYAE6OF01DID4M.10.60.F05.1.454.CMB.1.raw
  modified_base (219)..(219): a, c, t, g, unknown or other
  misc_feature (219)..(219): n is a, c, g, or t
  modified_base (416)..(421): a, c, t, g, unknown or other
  misc_feature (416)..(421): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaagntgattccggcagttacttcttagataactgggggccgggaaccctggtcgccgtctcttcagcctccaccaaggcccatcggtcttccccctggccgccctgctccaggagcacctccgagagcacagcggccctgggctgcctggtcaaggactacttcccactactatgctgagcgggctggcaaggcgcatagnnnnnn

SEQ ID NO: 182813 - DNA, 435 bp, Homo sapiens
  misc_feature: GYAE6OF01DAQH4.10.60.F05.1.454.CMB.1.raw
  modified_base (220)..(220): a, c, t, g, unknown or other
  misc_feature (220)..(220): n is a, c, g, or t
  modified_base (424)..(435): a, c, t, g, unknown or other
  misc_feature (424)..(435): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggcagttacttcttagataacgtggggccgggaaccctggtcgccgtctcttcagcctccaccaagggcccatcggtccttccccctggccgcccctgcctccaggagccacctccgagagcacagccggccctgggctgcctggtcaaggactacttcccactactatgctgagcgggctggcaaggcgcagtagnnnnnnnnnnnn

SEQ ID NO: 182814 - DNA, 437 bp, Homo sapiens
  misc_feature: GYAE6OF01B2DYC.10.60.F05.1.454.CMB.1.raw
  modified_base (220)..(220): a, c, t, g, unknown or other
  misc_feature (220)..(220): n is a, c, g, or t
  modified_base (338)..(338): a, c, t, g, unknown or other
  misc_feature (338)..(338): n is a, c, g, or t
  modified_base (419)..(419): a, c, t, g, unknown or other
  misc_feature (419)..(419): n is a, c, g, or t
  modified_base (425)..(437): a, c, t, g, unknown or other
  misc_feature (425)..(437): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaaagntgattccggcagttacttcttagataacgtggggccgggaaccctggtcgccgtctcttcagcctccaccaagggccccatccggtccttccccctggccgcccctgcctccaggacncacctccgagagcacagccggccctgggctgcctggtcaaggctacctcccactactatcgctgagcgggctggcaaggcncatagnnnnnnnnnnnnn

SEQ ID NO: 182815 - DNA, 512 bp, Homo sapiens
  misc_feature: GYAE6OF01BV3N3.10.60.F05.1.454.CMB.1.raw
  modified_base (219)..(219): a, c, t, g, unknown or other
  misc_feature (219)..(219): n is a, c, g, or t
  modified_base (479)..(512): a, c, t, g, unknown or other
  misc_feature (479)..(512): n is a, c, g, or t
tcagcatagtagtgcacgaccggtgctcgatttagtacgtcatcagggaagggcctggagtgggtctcaggtattacttggaatggtggtataataggctatgcggactctgtgaggggccgcttcaccatctccaaggacagcaccaagagatccctctatctgcaaatgaacagtctgagaactgaggacacggcctactactactgtgacaaaagntgattccggcagttacttcttagataacgtgggggccgggaaccctggtcgccgtctcttcagcctccaccaagggccccatccggtccttcccccgtggccgcccctgcctccgaggacgccacccgtccgagacgccacgacggccggccccgtggggcctcggccctgggtaccaaacggtaccttaccgttccccaacttacctatcggcctggacggccgggctcgggaccgaaacgggccgacgagtaggcagnnnnnnnnnnnnnnnnnnnnnnnnnnnnnnnnnn

SEQ ID NO: 182816 - DNA, 544 bp, Homo sapiens
  misc_feature: GYAE6OF01B7UGY.10.60.F05.1.454.CMB.1.raw
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
  modified_base (508)..(508): a, c, t, g, unknown or other
  misc_feature (508)..(508): n is a, c, g, or t
  modified_base (510)..(544): a, c, t, g, unknown or other
  misc_feature (510)..(544): n is a, c, g, or t
tcagcatagtagtgcacgaccggtgctcgatttagtacgtcatcagggaagggcctgggagtgggtctcaggtattacttggaatggtggtataataggctatgcggactctgtgaggggccgcttcaccatctccaaaggacagcaccaaagagactccctctatctgacaaaatgaacagtctgagaactgaggacacggcctaactactactgtgacaaaaagatgattccggactaagttacttcttaagaacttaacggtcgggggaccgggtaaaccctggtaccgccgtctcttcacgtccctccaacgtaacgggcccctaagtccggttccctttccccccgnggcccgcccccgttagccgtacccgaagggacnccgaacccgtccgagacgccaacgaggccggcccgtgggctcgccgtggtacgaaacggtaccttacctcccgaatactagtcgctagacggcgggctacgggacaaggtccgagaacgtagnannnnnnnnnnnnnnnnnnnnnnnnnnnnnnnnnnn

SEQ ID NO: 182817 - DNA, 515 bp, Homo sapiens
  misc_feature: GYAE6OF01BD4R1.10.60.F05.1.454.CMB.1.raw
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (341)..(341): a, c, t, g, unknown or other
  misc_feature (341)..(341): n is a, c, g, or t
  modified_base (445)..(445): a, c, t, g, unknown or other
  misc_feature (445)..(445): n is a, c, g, or t
  modified_base (489)..(515): a, c, t, g, unknown or other
  misc_feature (489)..(515): n is a, c, g, or t
tcagcatagtagtgcacgaccggtgctcgatttagtacgtcatcagggaaagggcctggagtgggtctcaggtattacttggaatggtggtataataggctatgcggactctgtgagggaccgcttcaccatctccaaggacagcgccaagagactccctctatctgacaaatgaacagtctgagaactgaggacacggctactactactgtnacaaaagntgattccggctagtttacttcgtagagtaacggtgggggacccgggtaacctggtccgccgtcttccttcgacgccctacccaccgaaccggcccctagtcccggttccccttcccccgnggcccgcccctggcctccgaggccacctacccgtaccgagacgcaccgacggccggccgtgggctcggccgtcggtacaacggtcttaccctacctacttacgntcgacgtaggacggcgggtccgtggacgacggccgatagtacgnnnnnnnnnnnnnnnnnnnnnnnnnnn

SEQ ID NO: 182818 - DNA, 489 bp, Homo sapiens
  misc_feature: GYAE6OF01BBJOE.10.60.F05.1.454.CMB.1.raw
  modified_base (160)..(160): a, c, t, g, unknown or other
  misc_feature (160)..(160): n is a, c, g, or t
  modified_base (220)..(220): a, c, t, g, unknown or other
  misc_feature (220)..(220): n is a, c, g, or t
  modified_base (349)..(349): a, c, t, g, unknown or other
  misc_feature (349)..(349): n is a, c, g, or t
  modified_base (465)..(489): a, c, t, g, unknown or other
  misc_feature (465)..(489): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctntatctgcaaatgaacagtctgagaactgaggacacggcctactactactgtgacaaaagntgattccggctagtttacttcttaagataacgtgggggacccgggaaccctggtcgccgtctcttcagcctccaccaacgggcccagtccggtccttcccccgtggcccgcccctgcctccgagggacnccacccgtccggagacgccaccgacggccgtccccgtgggctcgccgtggtacaacggtctaccgttcccaatacctatcgctggacggcgggctaggacgaaggcgacagtagcnnnnnnnnnnnnnnnnnnnnnnnnn

SEQ ID NO: 182819 - DNA, 583 bp, Homo sapiens
  misc_feature: GYAE6OF01B8DA4.10.60.F05.1.454.CMB.1.raw
  modified_base (122)..(122): a, c, t, g, unknown or other
  misc_feature (122)..(122): n is a, c, g, or t
  modified_base (161)..(161): a, c, t, g, unknown or other
  misc_feature (161)..(161): n is a, c, g, or t
  modified_base (178)..(178): a, c, t, g, unknown or other
  misc_feature (178)..(178): n is a, c, g, or t
  modified_base (230)..(230): a, c, t, g, unknown or other
  misc_feature (230)..(230): n is a, c, g, or t
  modified_base (543)..(543): a, c, t, g, unknown or other
  misc_feature (543)..(543): n is a, c, g, or t
  modified_base (547)..(583): a, c, t, g, unknown or other
  misc_feature (547)..(583): n is a, c, g, or t
tcagcatagtagtgcacgaccggtgctcgatttagtacgtcatcagggaagggcctggagtgggtctcaggtattacttggaatggtggtataataggctatgcggactctgtgaggggccncttcaccatctccaaggacagcgccaaagagactccctntatctgacaaatgaacngtctagaagaactgacggacacgcctaactactacgtgtacgaacaaaaagntgtacgttccggacttagtttacttacgtaagacgtaacggtcgggggacccggtaaccgtcggtccgtccgtctcttcgacgtccctaccaaccgaccggccctacgtcccgttccccttcccccgtcggccctacccctccctaaccgaacgtacgacctaacccggtcggtcggggaccacggaccggcccggccgtcggccgtcgtcccgtacggtaccgaaacggtacccttaccctaccctaacttacgtagtcgtcgacggtacgggtccgggtcggtacggaccggaacggccgtacgtaagtcncgtnnnnnnnnnnnnnnnnnnnnnnnnnnnnnnnnnnnnn

SEQ ID NO: 182820 - DNA, 578 bp, Homo sapiens
  misc_feature: GYAE6OF01B3KEB.10.60.F05.1.454.CMB.1.raw
  modified_base (181)..(181): a, c, t, g, unknown or other
  misc_feature (181)..(181): n is a, c, g, or t
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (419)..(419): a, c, t, g, unknown or other
  misc_feature (419)..(419): n is a, c, g, or t
  modified_base (538)..(538): a, c, t, g, unknown or other
  misc_feature (538)..(538): n is a, c, g, or t
  modified_base (541)..(549): a, c, t, g, unknown or other
  misc_feature (541)..(549): n is a, c, g, or t
  modified_base (551)..(578): a, c, t, g, unknown or other
  misc_feature (551)..(578): n is a, c, g, or t
tcagcatagtagtgcacgaccggtgctcgatttagtacgtcatcagggaaagggcctgggagtgggtctcaggtattacttggaatggtggtataataggctatgcggactctgtgaggccgcttcaccatctaccgaaggcagccgccaaagagactccctctatcctgacaaatgaacngtctagaagaacgtggacggacaccggtccttaactaacgttacgngtagaaacaaaaggtnttgtacgttccggataacgtttccttataaggaacgtaacggtcggggggaccccgggtaaccgtcggtccgtacccgtcttacttcgacctccctaccaccgaaccggacctcgtcccgtcccttcccgnggcccgtccctcgcccgtcgaggtaccnccctacccgccaggacnccgtaacgacggcccgtcccgggtgggcgtccgcgtcggacgtaaccgtaccttaaccctcccaattaccgtagtcggcgtacgcggggtccgtcgagggacgtaacggctataacggngcnnnnnnnnngnnnnnnnnnnnnnnnnnnnnnnnnnnnn

SEQ ID NO: 182821 - DNA, 597 bp, Homo sapiens
  misc_feature: GYAE6OF01AU42W.10.60.F05.1.454.CMB.1.raw
  modified_base (154)..(154): a, c, t, g, unknown or other
  misc_feature (154)..(154): n is a, c, g, or t
  modified_base (161)..(161): a, c, t, g, unknown or other
  misc_feature (161)..(161): n is a, c, g, or t
  modified_base (254)..(254): a, c, t, g, unknown or other
  misc_feature (254)..(254): n is a, c, g, or t
  modified_base (552)..(552): a, c, t, g, unknown or other
  misc_feature (552)..(552): n is a, c, g, or t
  modified_base (560)..(564): a, c, t, g, unknown or other
  misc_feature (560)..(564): n is a, c, g, or t
  modified_base (566)..(566): a, c, t, g, unknown or other
  misc_feature (566)..(566): n is a, c, g, or t
  modified_base (568)..(570): a, c, t, g, unknown or other
  misc_feature (568)..(570): n is a, c, g, or t
  modified_base (572)..(573): a, c, t, g, unknown or other
  misc_feature (572)..(573): n is a, c, g, or t
  modified_base (575)..(582): a, c, t, g, unknown or other
  misc_feature (575)..(582): n is a, c, g, or t
  modified_base (584)..(597): a, c, t, g, unknown or other
  misc_feature (584)..(597): n is a, c, g, or t
tcagcatagtagtgcacgaccggtgctcgatttagtacgtcatcagggaaagggcctggagtgggtctcaggttattacttggaatggtggtataataggctatgcggactctgtgagggccgcttcaccatctccaaaggcagcgccaagganatccctntatctgacaaatgaacagtctggagaactggacggacaccggtctactactactgtgaaccaaagtctgtacgttccggactagtttaccttnttaacgtataaccggtggggggacccgggaacccttgggtccgccgttccttacttcgcggcctaccaaccgaggcccctatccgggttcccctttcccccggtggccccgtccccgtcgtccgtaccggtaaggacctacccgaccccgttacgaacggacgaccaaccgtccggcccggccgttcgggaccgtccgtaccggtacggtacgaaccggttaacctttaccttacccgacttactacgtcgtcgtggaaccgggttcggacgtacgggcgtaacgggcctaagtacgngtcatgcnnnnncncnnngnncnnnnnnnngnnnnnnnnnnnnnn

SEQ ID NO: 182822 - DNA, 573 bp, Homo sapiens
  misc_feature: GYAE6OF01BDXBE.10.60.F05.1.454.CMB.1.raw
  modified_base (124)..(124): a, c, t, g, unknown or other
  misc_feature (124)..(124): n is a, c, g, or t
  modified_base (163)..(163): a, c, t, g, unknown or other
  misc_feature (163)..(163): n is a, c, g, or t
  modified_base (235)..(235): a, c, t, g, unknown or other
  misc_feature (235)..(235): n is a, c, g, or t
  modified_base (259)..(259): a, c, t, g, unknown or other
  misc_feature (259)..(259): n is a, c, g, or t
  modified_base (380)..(380): a, c, t, g, unknown or other
  misc_feature (380)..(380): n is a, c, g, or t
  modified_base (542)..(573): a, c, t, g, unknown or other
  misc_feature (542)..(573): n is a, c, g, or t
tcagcatagtagtgcacgaccggtgctcgatttagtacgtcatcaggggaaagggcctggagtgggtctcaggtattacttggaatggtggtataataggctatgcggactctgtgaggggccncttcaccatctccaaggacagccgccaagagactccctntatctgacaaaatgaaacagtctagaagtaactggaaggaccaccggcctactactactgtagaacaaaagntgtacttccggctagtttaccttntagacgttaacggcggggacccgggaccgttcggtccgtccgtcttctcactcctacccacgaacgggccccagttcccggtcccttccccgtcggccgccccgtgcccgtcgacggtacncccgacccgtccgacgacgtcaacgtaccgggccggtcccggtcggaccgttccgccgtttacgggaccgtaacggaccctttaccctaccccgtaacctactacgtcgtaccgtcggacgggtcgggcgtagggaccgaacgggcgactaagtagctgcgnnnnnnnnnnnnnnnnnnnnnnnnnnnnnnnn

SEQ ID NO: 182823 - DNA, 421 bp, Homo sapiens
  misc_feature: GYAE6OF02G4IPD.10.60.F05.1.454.CMB.1.raw
  modified_base (219)..(219): a, c, t, g, unknown or other
  misc_feature (219)..(219): n is a, c, g, or t
  modified_base (419)..(421): a, c, t, g, unknown or other
  misc_feature (419)..(421): n is a, c, g, or t
tcagcatagtagtgcacgaccggtgctcgatttagtacgtcatcagggaagggcctggagtgggtctcaggtattacttggaatggtggtataataggctatgcggactctgtgaggggccgcttcaccatctccaaggacagcgccaagagatccctctatctgcaaatgaacagtctgagaactgaggacacggcctactactactgtgcaaaaagntgattccggcagttacttcttagataacgtggggccggggaaccctggtcgccgtctcttcagcctccaccaagggcccatcggtctccccctggcgcccctgctccaggagcaccctccgagacgcacagcggccctgggctgcctggtcaaggactacttcccactactatgctgagcgggctggcaaggcgcatagnnn

SEQ ID NO: 182824 - DNA, 433 bp, Homo sapiens
  misc_feature: GYAE6OF02HCWSY.10.60.F05.1.454.CMB.1.raw
  modified_base (221)..(221): a, c, t, g, unknown or other
  misc_feature (221)..(221): n is a, c, g, or t
  modified_base (231)..(231): a, c, t, g, unknown or other
  misc_feature (231)..(231): n is a, c, g, or t
  modified_base (426)..(433): a, c, t, g, unknown or other
  misc_feature (426)..(433): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctccaaggacagcgccaagagatccctctatcctgcaaatgaacagtctgagaactgaggacacggcctactactactgtgcaaaaagntgattccggnagttacttcttagataactgggggccggggaaccctggtcgccgtctcttcagcctccaccaaggcccatcggtcttccccctggccgccctgctccagacgcacctcgagagcacagcggccctgggctgcctggtacaaggactaccttcccaactactaatcgctgacgcgggctgggacaaggcgcatagnnnnnnnn

SEQ ID NO: 182825 - DNA, 503 bp, Homo sapiens
  misc_feature: GYAE6OF02F3LF0.10.60.F05.1.454.CMB.1.raw
  modified_base (227)..(227): a, c, t, g, unknown or other
  misc_feature (227)..(227): n is a, c, g, or t
  modified_base (299)..(299): a, c, t, g, unknown or other
  misc_feature (299)..(299): n is a, c, g, or t
  modified_base (340)..(340): a, c, t, g, unknown or other
  misc_feature (340)..(340): n is a, c, g, or t
  modified_base (385)..(385): a, c, t, g, unknown or other
  misc_feature (385)..(385): n is a, c, g, or t
  modified_base (428)..(428): a, c, t, g, unknown or other
  misc_feature (428)..(428): n is a, c, g, or t
  modified_base (461)..(461): a, c, t, g, unknown or other
  misc_feature (461)..(461): n is a, c, g, or t
  modified_base (469)..(503): a, c, t, g, unknown or other
  misc_feature (469)..(503): n is a, c, g, or t
tcagcatagtagtgcacgaccggtgctcgatttagtacgtcatcagggaaagggcctggagtgggtctcaggtattacttggaatggtggtataataggctatgcggactctgtgaggggccgcttcaccatctcccaaagggacagccgccaaagagatccctctatctgcaaaatgaacagtctgaagaactgaggacacggcctactactactgtgacaaaagntgacttccggactagtttacttcttaagattaacggtcgggggcccgggaaccctggtccgccgtctcttcncgcctccacgaacggcccagtccgtcctcccccgtggcccnccctcgctccgaggcaccaccgtcgagacgcacgcgccggtccgnggctcgcgtggacgaaacggtctaccgtccccaactacgtacncgtcgtcgacggcggtcgtcggacgacgccganagtacgcnnnnnnnnnnnnnnnnnnnnnnnnnnnnnnnnnnn

SEQ ID NO: 182826 - DNA, 560 bp, Homo sapiens
  misc_feature: GYAE6OF02HL2X3.10.60.F05.1.454.CMB.1.raw
  modified_base (141)..(141): a, c, t, g, unknown or other
  misc_feature (141)..(141): n is a, c, g, or t
  modified_base (154)..(154): a, c, t, g, unknown or other
  misc_feature (154)..(154): n is a, c, g, or t
  modified_base (364)..(364): a, c, t, g, unknown or other
  misc_feature (364)..(364): n is a, c, g, or t
  modified_base (433)..(433): a, c, t, g, unknown or other
  misc_feature (433)..(433): n is a, c, g, or t
  modified_base (520)..(524): a, c, t, g, unknown or other
  misc_feature (520)..(524): n is a, c, g, or t
  modified_base (526)..(527): a, c, t, g, unknown or other
  misc_feature (526)..(527): n is a, c, g, or t
  modified_base (529)..(532): a, c, t, g, unknown or other
  misc_feature (529)..(532): n is a, c, g, or t
  modified_base (534)..(534): a, c, t, g, unknown or other
  misc_feature (534)..(534): n is a, c, g, or t
  modified_base (536)..(537): a, c, t, g, unknown or other
  misc_feature (536)..(537): n is a, c, g, or t
  modified_base (539)..(539): a, c, t, g, unknown or other
  misc_feature (539)..(539): n is a, c, g, or t
  modified_base (541)..(560): a, c, t, g, unknown or other
  misc_feature (541)..(560): n is a, c, g, or t
tcagcatagtagtgcacgaccggtgctcgatttagtacgtcatcagggaaggcctggagtgggtctcaggtattacttggaatggtgtataataggctatgcggactctgtgaggggcctcttcaccatcctccaaggacngcgaccaaagganactcccctctatcctgacaaatcggaacagtctaggaacgaatggaggaccaccggtacctaacctactactgtacaacgaaaagtagacttccggctaagttctttacgtagaactaaccggtgggggacccggtaacctcggtccgtcccgttacttccgtcacgcccctaccaaccgaccggccctacgtccggtcccttcccccgnggtcccgcctccgctccggacggcaccctacccgtcaggaccgacgacgacggcccgtccgcgggtacncgtccgttgaacgaaccgtcttacccgtcccattacctgtaccgtgcggaaccggtccgtagacgggaacgtcggactagacgtgcnnnnncnncnnnngncnngncnnnnnnnnnnnnnnnnnnnn

SEQ ID NO: 182827 - DNA, 518 bp, Homo sapiens
  misc_feature: GYAE6OF01B86BK.45.58.F03.1.454.CMB.1.raw
  modified_base (201)..(201): a, c, t, g, unknown or other
  misc_feature (201)..(201): n is a, c, g, or t
  modified_base (213)..(213): a, c, t, g, unknown or other
  misc_feature (213)..(213): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctntcctgcagggccagtcagtatgttagcaccaacttagcctggtaccaacagagacctgcccaggctccaaactcctcatctctggtgtatctaccagggccactggtcgtcccagacaggttcaagggcagtggtctgggacagagttcactctcaccatcagcggcctgcagtctgaagtattttggactttattactgtcagcagtataatcactgtccgtactacgttttgggaccggggtaccaagtcgtaggagatacaaacgtactgtacggctgcacatctgtcttcatctccgctac

SEQ ID NO: 182828 - DNA, 576 bp, Homo sapiens
  misc_feature: GYAE6OF01A1BFD.45.58.F03.1.454.CMB.1.raw
  modified_base (425)..(425): a, c, t, g, unknown or other
  misc_feature (425)..(425): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccatataccactggagaaatagtgatgacgcagtctccagtcaccctgtctgtgtctccgaggggagacggccaccctctcctgcagggccagtcagtatgttagcaccaattagcctggtaccaacagagacctgccaggctcccaaactcctcatctctggtgtatcctaccagggccactggtcgtaccccaggaactagggttcaacggggcaggtgggtctggggacaggtagttcactctacaccatcgagcggcctgcagtctgagtattttggtaacttttntactgtacagtcagtataactctactcggtaccttacgtacgttttcggggaccgggggtaacctaaggcgttaggagtactacgaaacgtaccgtggtcgctacggctaccctagtcctttgtaccttcaaccttcttccccgcttaacg

SEQ ID NO: 182829 - DNA, 551 bp, Homo sapiens
  misc_feature: GYAE6OF01EU4ZX.45.58.F03.1.454.CMB.1.raw
  modified_base (263)..(263): a, c, t, g, unknown or other
  misc_feature (263)..(263): n is a, c, g, or t
  modified_base (313)..(313): a, c, t, g, unknown or other
  misc_feature (313)..(313): n is a, c, g, or t
  modified_base (344)..(344): a, c, t, g, unknown or other
  misc_feature (344)..(344): n is a, c, g, or t
tcagacgcgatcgacacgaccggtgctcgatttagtctgatcgagaagggaaagggggaggaactgctcagttaggacccagacggaaccatggaagccccagctcagcttctcttcctcctgctactctggctcccagataccaccggaaaaattgtgttgacacagtctccaggcaccctgtctctgtctccaggggagacagcccaccctctcctgcagggccagtaggagtgtcagtaagtacttaggctggtaccaanagaaacctggccaggcctcccaggctcctcatccatgatgcatccaacgngggtcccctggccgtcccagactggttccgnggctaggtgggtctggggacaggtagttcactctcaccgtcagcagcctggacgcctgatgtattttgctagtttacttcgtgtcagtctacgtccgttccgccaccgcccgctccgtaccgtttccggggaccggggggtaccgaggggtggagagtggagacgtaacgtgtggctgcacatctcgtctctactccttcccgctac

SEQ ID NO: 182830 - DNA, 543 bp, Homo sapiens
  misc_feature: GYAE6OF01CEI12.45.58.F03.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccagggganacggccaccctctcctgcagggccagtcagtatgttagcaccaattagcctggtaccaacagagacctgcccaggcctccaaactcctcatctctggtntactctaccgagggccacgtggtcgtcccagacaggttcaagggcaggtggtctgggacagagttcactctcaccatcagcgctgctagtctgtaagtatttaggtactttattactgtcagtctagtataatcacgtgacgtactacgtttcgggaccggggtacacgtcgtaggacagtacgaacgacgtgtacggtctagacacctactcttcgttcttactacttcctcccgtcctacg

SEQ ID NO: 182831 - DNA, 665 bp, Homo sapiens
  misc_feature: GYAE6OF01CT1NM.45.58.F03.1.454.CMB.1.raw
  modified_base (395)..(395): a, c, t, g, unknown or other
  misc_feature (395)..(395): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggacaccggccacctctcctgcagggccagtcagtatgtagcaccaattagcctggtaaccaacgagacgacctgacccaaggcctacccaaactcctcatcctctggtctatccgtacgacggccagttggtcgtacccagacgtaggttacgaagggctaggtgggtacgtggggaacaggtacgtaccacttcnctaacctatcgaggcccgctcgctagtcgtagtaagttgtttaggttacttttagttacgttagactacgtactaaggttaatacttacgtacgttcggtaccgttaaccgttacggttttaccgggacccggggtaactacgtcgtagggacgtaacgtaacgaaacggtacgttacgggtacggtcgtacggaccgtaccgttaacgttccgtttaccggttaccctttaacgttaccctttacccgttccccggtcctttaacccgg

SEQ ID NO: 182832 - DNA, 621 bp, Homo sapiens
  misc_feature: GYAE6OF01CBAJM.45.58.F03.1.454.CMB.1.raw
  modified_base (256)..(256): a, c, t, g, unknown or other
  misc_feature (256)..(256): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagaaaccattggagaaatactgatgacgcagtctccagtcaccctgtctgtgtctccgaggggagacggccaccctctcctgcagggccagtcagtatgtagcacattgctgtaccaanagagacctgcccaggcctcccaaactcctcatctctggtgtatctaccagggccacgtcggtgtcccaggactaggttcaagggcaggtgggtctggggacagagttcacgtctcacatcagtcggcctagcagtctagaagtagttttgggaacttttagttacttgtcgtagtctagttataacgtctaacgtcggtaccgtacgtacgtttttcgggacccgggggtaacctaaggtcgtagggtaacgacgttaaccgaaaacggtaaccgttgtacggtccgttaggaccgtaacccgtaattccgttacggtttcctttaccgtaactttcccggtttaccccgtccgtaactttccgg

SEQ ID NO: 182833 - DNA, 812 bp, Homo sapiens
  misc_feature: GYAE6OF01E45BL.45.58.F03.1.454.CMB.1.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccaccggaaaaattgtgttgacacagtctccaggcaccctgtctctgtctccgaggggagacacgcccaccctctcctgcagggccagtaggagtgtcagtaagttactaggctggtaaccaacgagaaacctggccaaggcctcccgaggtcctcctcactccatgactgaccactacccgaaaccgtacgggtccccgtcgggacccgttacccgaacggtaccgtaccgggtttccggtaggaccggtagggttcggggttacggtacggggacctaacgggttacgtttacccaaccgtttccctacccgtaacccggtcaccgggcctaaccggtcccgttagggaacccgtccgttaggtactttaggtttaacgtttttcggtaccgttttaacggtttttaaccgtttcgttacgttaccgacggttaccgtaccggttccccggtttccccgacccgtacccggtcccgtccgttaccggttaccggggtttccggggggaccggggggtacgtagggggtacggaggttaacggtacgggaagtaaccggtaacggttcggtaccgggtcgttccggaccctaacccgttacgtttcccgtttcgttaccccgtttacctaacccgtttccccggttaccccctcgttaacgtttcccgg

SEQ ID NO: 182834 - DNA, 796 bp, Homo sapiens
  misc_feature: GYAE6OF01CMCT8.45.58.F03.1.454.CMB.1.raw
  modified_base (295)..(295): a, c, t, g, unknown or other
  misc_feature (295)..(295): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctccagataccactggagaaatagtgatgacgcagtctcagtcacctgtctgtgtctccgaggggacgacggcctaccctctcctgcagggccagtcagtatgtagcacctaacttagcctggtaccaacgagacgcctgcccaggcctacccaaactcctanactctctggtcttactccgtaccgaggcccacgttgggtccgtaccccaaggtaccgtacgggttaccgaaacggggctaggggttcgggtcgtacgggggaactaggtacgttaccaccgttctaccaccctaagtcccgaaggtcccgggtacctggaccgtacgttaccgtaggtaaagtttagttttacggttaacgtttttaacgtttaacgttcgttacgtacggttactaaaggtttaacttaaacgttccgtaacggtttaccgggtacccggtttaaaccgttaaccgggtttttaccgggggaaccccggggggttaacctaacgggtaccgttaacggggtaacgtaaaccggttaaaccgtaaaaccgggttaaccgttacgggttacgggtaccgttacgggaacccgttaacccgttaacgttaccgtttaccgtttacccgtttacttaacccgttttccccgtttacccccgtaccggttacccg

SEQ ID NO: 182835 - DNA, 278 bp, Homo sapiens
  misc_feature: GYAE6OF01DQ4YB.45.58.F03.1.454.CMB.1.raw
  modified_base (194)..(194): a, c, t, g, unknown or other
  misc_feature (194)..(194): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctcggctcccagactaccactggaagaaatagtggtgacgcagtcaccaggccaccctgtctggtntcgtccgaggggagagcgtcctaccctctcctcgccgaccggccaggtactaaaggtcgttccgacaccggtatacttacggcc

SEQ ID NO: 182836 - DNA, 663 bp, Homo sapiens
  misc_feature: GYAE6OF01EGW2I.45.58.F03.1.454.CMB.1.raw
  modified_base (244)..(244): a, c, t, g, unknown or other
  misc_feature (244)..(244): n is a, c, g, or t
  modified_base (267)..(267): a, c, t, g, unknown or other
  misc_feature (267)..(267): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtcaccctgtctgtgtctccgaggggagaccggcccaccctctcctgcgacgggccagtcagtatgtancaccacttagcctaggtaccaanagagacctgcccaggcctacccaaacttcccgtactactccttcgtggtgtactaccgtaccgacggggacccacgttgggtccgtaccccgaagaccgtacgggttacgaaggggtcagggttgggtccggtaggggaacaggtacgttccaccttcgtaccacctatcggacgccggtcctggacgtacgttcgtaagtaaggtttacgtttttaggtaacttttaacttacgtgttacagtactaacgttaataacttacacggttcggtaccgttacgttaccggtttcggggacccggggtacctaaggtcgtaggagactaacgaaacgtagtacggtgtacgtgacgtacctagttcctacgttcttacctactttcctcccgtctacg

SEQ ID NO: 182837 - DNA, 640 bp, Homo sapiens
  misc_feature: GYAE6OF01CEGL4.45.58.F03.1.454.CMB.1.raw
  modified_base (202)..(202): a, c, t, g, unknown or other
  misc_feature (202)..(202): n is a, c, g, or t
  modified_base (281)..(281): a, c, t, g, unknown or other
  misc_feature (281)..(281): n is a, c, g, or t
tcagacgcgatcgacacgaccggtgctcgatttagtctgatcgagaagggaaagggggaggaactgctcagttaggacccagagggaaccatggaagccccagctcagcttctcttcctcctgctactctggctcccagagacctccggagaaattgtcttgacacagtctccagccattctgtctctctctccgagggganacagccaccctctcatgcaggccagtcagagtatagacatactggctggtatcaatacaagcctggccagggtccccgntcctcatctatgatcgccttcagccagggcccacgtcggaccactccccgagcccgtaggttccgagggttgggcgggtttaggggtttcggaccaacgtaggtacctttacaccgttctaccgaactaatacgagaccacgtaccctacccgtaaacctagtaacgtagttttacgactacgttactattactacgtacaacgtacgtacgtacgaagtacgttcggtccgtacgtccgttacgtttacgggacggtaacgggtaaccgtaagggtacggaaggtaacgtaacggaaaccggtacggttacggttacggacgttaccggacctaacccgtcgttaccgttgttacccg

SEQ ID NO: 182838 - DNA, 815 bp, Homo sapiens
  misc_feature: GYAE6OF01D3XHI.45.58.F03.1.454.CMB.1.raw
  modified_base (218)..(218): a, c, t, g, unknown or other
  misc_feature (218)..(218): n is a, c, g, or t
  modified_base (266)..(266): a, c, t, g, unknown or other
  misc_feature (266)..(266): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtctccagtcaccctgtctgtgtctccgaggggacacggccacctctccngcagggccagtcagtatgttagccaacaacttagcctaggtaacaacngaagacctcgacccaggcctacccaaactcctacactcttcgtaggttcgtaactacctaaccggacggggtaccaacgttcgggtcgtaccccgaagaaccgtaggttacggaagggtaccacgggttacggggtccggttagggaaacgtaacgggtaacgttttacgaaaccgttccgttacccgaaacccgttaagtaccgtaaacgggacccggtaacccgttaaaccgtaacggtttaacgggttaacggtaaaaaccggtttaggtttttttaaaccggggtttaaacccttttttaacgtttaaaaccgttacgggtttaaccgaacgggtaacctaagggtttaaaccttaaacgtttaccggtaaacgttaccgggttaacgttaaccgttaacggtttttaccgggggaccgggggtaacctaaacggtccggtaggaacgtacttaacgtaaaacggtaacgtggttacggacgtaggactacccgtaatcgttagttaccttactaacgttacccttacccggtataccttaacgg

SEQ ID NO: 182839 - DNA, 671 bp, Homo sapiens
  misc_feature: GYAE6OF01CTZMF.45.58.F03.1.454.CMB.1.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (247)..(247): a, c, t, g, unknown or other
  misc_feature (247)..(247): n is a, c, g, or t
  modified_base (307)..(307): a, c, t, g, unknown or other
  misc_feature (307)..(307): n is a, c, g, or t
  modified_base (632)..(632): a, c, t, g, unknown or other
  misc_feature (632)..(632): n is a, c, g, or t
  modified_base (666)..(666): a, c, t, g, unknown or other
  misc_feature (666)..(666): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgcttactctggcctcccagactaccactggagaaatagtgatgacgcagtcctccagtccaccctgtctgtntctccgaggggacaccggccaccctntcctgcgagggcctagtcagtatgtancacctattgcctaggtaaccactagacgaccctgacccaggccctacccaaactccctanacttcctacgtggtactactccctaccggacgggtcctacgtgggtccacccgaaggacctaggttacgaagggtctagggttggccgtaggggaactacggtattccactccgtaccacgtagtccgaggtccgacgtcgtacgtaccgtgttaacgtagtttagtttaccgttttacgtttaatttaccgtagtcgtaacgtatactaacgtttactacgtaccgtcgttaccgtaaccgttaccggtttacggtaccggggtaccgatggacgtggaacttacgtaaccgaacgtggtacggtccgagtccgaaccttcgtnttccgttaccgttcttaccgtaccttccccggtntaccg

SEQ ID NO: 182840 - DNA, 757 bp, Homo sapiens
  misc_feature: GYAE6OF01CVXLJ.45.58.F03.1.454.CMB.1.raw
  modified_base (203)..(203): a, c, t, g, unknown or other
  misc_feature (203)..(203): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtggtgacgcagtctccaggcaccctgtctgtgtctccgagggganagagtccaccctctcctgccacggcctagtacaagttcgtcgcgaaccggatacttagcctaggtaccagacaagtacgaccgtcgccgacgccctcccgaaggtcctcgtaccattctaggtcggtcgactacctccctccggacgggtccctcgttcgggtcccgtccccgtacgtacggttccgacggttggcgtagggtcggggtccggtagggactaggtacgtttcccacgtttaccacgaaccctatacgacggtacctacgtcccgtggtaccgtaacggttcgttacggtaaagttttacgttttcggtaacgttttaatttttacgttttagtttcgttctacgtactttaacttaagttaaacgttcgttccgtaccgggttcccgttacggggttaccgtttaccccgggccgtaaacgggtaccggtaacggggtttaacctaaacggttaaaccggtaaaacggttacgttcgggtaccgttacccggtacgtaacccgttaccgttaatttccgtttctttccgttcccttaaccccgg

SEQ ID NO: 182841 - DNA, 573 bp, Homo sapiens
  misc_feature: GYAE6OF02IVRA4.45.58.F03.1.454.CMB.1.raw
  modified_base (231)..(231): a, c, t, g, unknown or other
  misc_feature (231)..(231): n is a, c, g, or t
  modified_base (261)..(261): a, c, t, g, unknown or other
  misc_feature (261)..(261): n is a, c, g, or t
  modified_base (313)..(313): a, c, t, g, unknown or other
  misc_feature (313)..(313): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
  modified_base (499)..(499): a, c, t, g, unknown or other
  misc_feature (499)..(499): n is a, c, g, or t
tcagacgcgatcgacacgaccggtgctcgatttagtctgatcgagaagggaaaggggaggaactgctcagttaggacccagacggaaccatggaggccccagcgcggcttctcttcctcctgctactctggctcccagataccaccggaaaattgtgttgacacagtctccaggcaccctgtctctgtctccaggggagacagcccaccctctcctgcagggccagtaggngtgtcagtaagtacttaggctggtaccaanagaaacctggccaggctcccaggctcctcatcccatgatcgcatccaaacgngggtccctggccgtcccagaccacggttccgtggccaggttgggtcctagggacctagacgttcaacgttctcgaccgttcagcaacggcctgggancctgactgtattttgctagtttaccttctgtcagcacgtcgttccnccacgtccgcttcgacgtttcgggccggggactgggtcgtagngtcgaagacgtaccgtgtcggtctcggcgacctcttaccgtgttacctctacgttcccttcccggtcagttccg

SEQ ID NO: 182842 - DNA, 505 bp, Homo sapiens
  misc_feature: GYAE6OF02HLEZW.45.58.F03.1.454.CMB.1.raw
  modified_base (201)..(201): a, c, t, g, unknown or other
  misc_feature (201)..(201): n is a, c, g, or t
tcagacgcgatcgacacgaccggtgctcgatttagtctgatcgagaagggaaagggggaggaactgctcagttaggacccagagggaaccatggaagccccagctcagcttctcttcctcctgctactctggctcccagagacctccggagaaattgtcttgacacagtctccagccattctgtctctctctccagggganacagccaccctctcatgcagggccagtcagagtattagaacatacttggcctggtatcaatacaagcctggccagggtccccggctcctcatctatgatgcttccagcagggccatggcatcccagccagttcagtggcggtgggtttgcacgagacttcactctacacaatcagcagcctccaacctgaagtatttgctagtctattactgtcaacagcgtacagtattcggcctctctacgtttcggcggtagggaccaagggtggagtactacaaacgaatgtgctcgcacctatctgttc

SEQ ID NO: 182843 - DNA, 843 bp, Homo sapiens
  misc_feature: GYAE6OF02G5XBX.45.58.F03.1.454.CMB.1.raw
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggagaaatagtgatgacgcagtctccagtcaccctgtctgtgtctccgaggggagacggccaccctctcctgcagggccagtcagtatgttagcaccaacttagcctggtaccaacagacgacctggcccgaggcctaccccaaactcctcatctctggtgtactctaccgagggccctagtcggtcgtccccaggaccgtagggttaccgaaggggtctaggttcggggtcgttagggggacctaggtacgtttccgacttccgtaccaaccctattaccgaacggtccgggtacccttgccgtaacggttcgttagggtaaacggttaacgttttttagggtaaccttttttacgttaaccgtttacggttaccgtaacggtacgttaaacggtttaacgttaaacttccgttaaaccggttaccgggtacccggtttaaccggtttaacccgggtttttttcgggggggaacccccggggggggttaaacccggtaaacgggttccgggtttaacggggtaaaccggtaaaccttaacccgggttaaaaaccgggtaccggtttacggggttaccgggtccgggtttaccggaacccgttaaccccgttaacggttttaccggttacccggttttacccgtttaccgttaacccgttttacccccggtttaccccccggtacctttaacccgg

SEQ ID NO: 182844 - DNA, 664 bp, Homo sapiens
  misc_feature: GYAE6OF02FNWA3.45.58.F03.1.454.CMB.1.raw
  modified_base (450)..(450): a, c, t, g, unknown or other
  misc_feature (450)..(450): n is a, c, g, or t
tcagacgcgatcgacacgaccggtgctcgatttagtctgatcgagaagggaaagggggaggaactgctcagttaggacccagacggaaccatggaggccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacgagaaacctggccaggcctccgaggccttcctcactccatgatgcatccaacgcggtccctggcctccagactacgggttccgtggctaggtcgggtctggggactaggcgtttcacgttctcgaccgtcacgccgagccgtggacgtcctggattgtacgttttcgacttagttttctcgtgtaccngtctacgtcgtaccgcctaccgtccgcttaccgtcgggtttccggggcccggggggtacgtacgggggttcgaagggtacgttacggggaccgtaacgggtacgtttcgggtaacgggtccgtaccggacccgtaaacccgttggtttcccggttacggtttaccttttacccgtaaccgtttttccccggttaccccgaccccgttttaacgg

SEQ ID NO: 182845 - DNA, 695 bp, Homo sapiens
  misc_feature: GYAE6OF02FKJAW.45.58.F03.1.454.CMB.1.raw
  modified_base (151)..(151): a, c, t, g, unknown or other
  misc_feature (151)..(151): n is a, c, g, or t
  modified_base (274)..(274): a, c, t, g, unknown or other
  misc_feature (274)..(274): n is a, c, g, or t
  modified_base (357)..(357): a, c, t, g, unknown or other
  misc_feature (357)..(357): n is a, c, g, or t
  modified_base (691)..(691): a, c, t, g, unknown or other
  misc_feature (691)..(691): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactgganaaatagtgatgacgcagtctccagtcaccctgtctgtgtctccgaggggacacggccaccctctcctgccgagggccagtcaagttatgttagcacctaattacgcccttaggtaccaaacgnggaacgaccgtacgccccgaggcccttaaccccaaaactccctacacttcctcgtaggttctactccgtaaccggtcggaccncgttgggtccgtacccagacgttacgggttacgaagggtctagggttcgggtacgtaggggaaacctaggttacgtttccaaccgtcttaccaccgtactccggacggccgtctacgactacggttacacgttaagttacgttttacgtaaacttttagttactacggttaccagtactaagtttaacgttaatcccgttaacgtagggtcccttaacggttacgttttacccgggggaccgggttaaacctacggtcggtacggtaacgtacctaacgtaacgtacgtggaacggtctagaccacgtatcgacttcctagtacgtccctccgntaac

SEQ ID NO: 182846 - DNA, 737 bp, Homo sapiens
  misc_feature: GYAE6OF02IDC7V.45.58.F03.1.454.CMB.1.raw
  modified_base (213)..(213): a, c, t, g, unknown or other
  misc_feature (213)..(213): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggctcccagataccactggaagaaatagtgatgacgcagtcctcagtccaccctgtcctgtgtctcgaggggagaccggcccnccctcctcctgacgagggccagtcgagttagtgttacgacctaaccctaacttacggccttcggtaaccaacgacgaccgacccgtcgacccgacggtacccctaaccccaaaccttcctacgtacttccttcgttacggttacgttacttaccccgtaacggaccgggtaccctacggtcggttaccgtacccgtaaggtaaccgtaggttaccggaacgggcgtaggggttaccgggtcgtagggaacgtaggtaccgtttaccgacctcgttaaccaccgtatccggtacggcccggtctacgcgtacggttctaaggtaacgtttcgttttacggttaacttttattaccgtagtacgacgttacgttaatacgttactacgtacgttagtaccgttcgttaccggtttacgggaccgggtacgagtacgtggtaactaccgtaacgacgtacgtacggtacgtcgacgtacctcctacgttcgttcgttccttaccgttccgtcccttcccacttaccg

SEQ ID NO: 182847 - DNA, 868 bp, Homo sapiens
  misc_feature: GYAE6OF02FX8J4.45.58.F03.1.454.CMB.1.raw
  modified_base (153)..(153): a, c, t, g, unknown or other
  misc_feature (153)..(153): n is a, c, g, or t
  modified_base (863)..(863): a, c, t, g, unknown or other
  misc_feature (863)..(863): n is a, c, g, or t
tcagacgcgatcgacacgaccggtgctcgatttagtctgatcgagaagggaaagggggaggaactgctcagttaggacccagacggaaccatggaggccccagcgcggcttctcttcctcctgctactctggcctcccagataccactggaanaaacgtagtgaatggaccgcagtcctccgagtccaccctgtctgtactcctccgaggggacaccggcccaacccttcgtaccgtgaccgtaacggggccctagtaccgaacgttagttacgttaacgacctaaccctaacgttaccgtaccggttacggtaaacccgaaacgacggtaacgacccgtccggtaccccgaacgggttaccctaccccctaaaaccttcccgtaaccgtaccttacccgttcgttacgggttacgtttaaccttcccgtaaccggaccggtaccctacggttacgggtcctaaccccggagtaaccccggttagggtacggtaaacggcggttaacggttccgggtacgtacggggtaaccgtacggttacgtttacccgtacgtacccttaacgaacccgtactaacggaccggtaccgtacccgttcgaccgtaacgtacccgttaggttaacgttaaccggttttaacggtttaccgtttaaacgtttaacgttaccgtacggttaacgtttacgaactttaacggttaccgtttaaaccgtaccgttacgggttacccgttacgttaaccgggttccggtttaacccgggggacggtaacgtacggtacggtacggtagaaccgtaacgtacgacgttcggaacctagaccgtactacgttcgtagtcttaccgtacttccctccgtntaccg

SEQ ID NO: 182848 - DNA, 222 bp, Homo sapiens
  misc_feature: GYAE6OF01BPVSM.13.58.F03.1.454.CMB.1.raw
  modified_base (220)..(222): a, c, t, g, unknown or other
  misc_feature (220)..(222): n is a, c, g, or t
tcagtcacgtactacacgaccggtgctcgatttagtctgatcgagaagggaaagggggagaagggtttttgttcagcaagacaaatggagagctctcactgtggtggacgttcggccaagggaccaaggtggaaatcaaacgaactgtggctgcaccatctgtcttcatcttcccgccatctgatagtacgtgactgagcgggctggcaaggcgcatagnnn

SEQ ID NO: 182849 - DNA, 216 bp, Homo sapiens
  misc_feature: GYAE6OF02GL53L.13.58.F03.1.454.CMB.1.raw
tcagtcacgtactacacgaccggtgctcgatttagtctgatcgagaagggaaaggggagaagggttttgttcagcaagacaatggagagctctcactgtggtggacgttcggccaagggaccaaggtggaaatcaaacgaactgtggctgcaccatctgtcttcatcttcccgccatctgatagtacgtgactgagcgggctggcaaggcgcatag

SEQ ID NO: 182850 - DNA, 221 bp, Homo sapiens
  misc_feature: GYAE6OF02HAA96.13.58.F03.1.454.CMB.1.raw
  modified_base (218)..(221): a, c, t, g, unknown or other
  misc_feature (218)..(221): n is a, c, g, or t
tcagtcacgtactacacgaccggtgctcgatttagtctgatcgagaagggaaagggggagaagggttttgttcagcaagacaatggagagctctcactgtggtggacgttcggccaagggaccaaggtggaaatcaaacgaactgtggctacaccatctgtcttcatcttcccgccatctgatagtacgtgactgagcgggctggcaaggcgcatagnnnn

SEQ ID NO: 182851 - DNA, 222 bp, Homo sapiens
  misc_feature: GYAE6OF02GDGRY.13.58.F03.1.454.CMB.1.raw
  modified_base (218)..(222): a, c, t, g, unknown or other
  misc_feature (218)..(222): n is a, c, g, or t
tcagtcacgtactacacgaccggtgctcgatttagtctgatcgagaagggaaagggggagaagggtttttgttcagcaagacaatggagagctctcactgtggtggacgttcggccaagggaccaaggtggaaatcaaacgaactgtggctgcaccatctgtcttcatcttcccgcatctgatagtacgtgacgaggcgggctggcaaggcgcatagnnnnn

SEQ ID NO: 182852 - DNA, 543 bp, Homo sapiens
  misc_feature: GYAE6OF01CE11U.13.76.G10.1.454.CMB.1.raw
  modified_base (358)..(358): a, c, t, g, unknown or other
  misc_feature (358)..(358): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgttagctatttaaaaggtgccagtgtgaggtgcagctggtggagtctggaggaggcttgatccagccgtggggggtccctgagactctcctgtgcagcctcgtgggttcaccgtcagtcacacctacatgagctgggtccgccaggcctccgaggggaggggctggagtgcgtcttcttttattatagtagtggtagtacatactcgnagactccgtgacggggccattcacatctcagagacaattaccaaagaaccacgtacttgtttacttacaaattgaaacagcctgagagccgatcgacacggtcgtagtattacgtgtgcgagagagtcggggcccaaggtaacgttcacgtcctagtcgggactggcggggacccaagggacccg

SEQ ID NO: 182853 - DNA, 505 bp, Homo sapiens
  misc_feature: GYAE6OF01DNQ8R.13.76.G10.1.454.CMB.1.raw
  modified_base (435)..(435): a, c, t, g, unknown or other
  misc_feature (435)..(435): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgtcaagcggccctcgagggatccctgagcgattctctggctccaactctgggaactcagccactctgaccatcagcgggacccaggctagtggatgagctgactattactgtcagggcgtagggacagcagcacgtcgcccgntagtcgtcgttacggaactcggggaaccaagggtccacccgttacctaagtccgacggtcccaaaccggg

SEQ ID NO: 182854 - DNA, 482 bp, Homo sapiens
  misc_feature: GYAE6OF01CGLIK.13.76.G10.1.454.CMB.1.raw
  modified_base (428)..(428): a, c, t, g, unknown or other
  misc_feature (428)..(428): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctggaaataattggcagataaaatatacttcctggtatcagcagaagtcaggccagtcccctgtgctggtcatctatcaagatgccaagcggccctcagggatccctgagcgattctctggctccaactctgggaactcagccactccgacatcagcggacccaggctatggatgagctgactatactgtcaggcgtgggacagcagcactgcccgntatgtcgttcggaactgggaccaaggtcaccgtccaagtcagcccaaggacccc

SEQ ID NO: 182855 - DNA, 523 bp, Homo sapiens
  misc_feature: GYAE6OF01BJDXC.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctctttattatagtagtggtagtacatactcgcagactccgtgaggggccattcaccatctccagagacaattccaagacacgctgttctcaaatgaacagcctgagagccgatgacacggccgtgtattactgtgcgagagagtcggggcccaggaacgttcacgctagtcgggacgtctcgggggcccaaggggacccg

SEQ ID NO: 182856 - DNA, 574 bp, Homo sapiens
  misc_feature: GYAE6OF01B5JGQ.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcgacgtccttgcttactgcacaggatccgtggcctcctatgagctgactcagcccaccctcagtgtccgtgtccccaggacagacagccagcatcacctgctctaggaaataatggacagataaatatacttctggtatcagcagaagtcaggccagtcccctgtgctggtcatctatcaagactgaccaaggccggccctacgagggtacttccccgtaggacgtcgtactttcctcgtcggcctacccgtaaacttcgtacgggaacctccgacgccctactctacgaccatccgacggccgggacccaggctagtgatgagctagtacttattacgtgtacgagggtcgtagggacagcgagccgacgtcggcccgtatacgtcggttaccgtacgggaaccgtcggggaaccctaacggtcccaacccggtaccctaaacggtccgaacggtaacccccg

SEQ ID NO: 182857 - DNA, 482 bp, Homo sapiens
  misc_feature: GYAE6OF01DK09G.13.76.G10.1.454.CMB.1.raw
  modified_base (384)..(384): a, c, t, g, unknown or other
  misc_feature (384)..(384): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtccccctgtgcctggtcatctatcaagatgccaagcggccctcagggatccctgagcgattctctggctccaactctggaactcagccactctgaccatcagcggacccaggcctanggatgagctgactattactgtnacggcgtggacagcagcacgtgcccgntagtgtcttcggacttgggaccaaggtccaccgtctaagccagaccccg

SEQ ID NO: 182858 - DNA, 537 bp, Homo sapiens
  misc_feature: GYAE6OF01BGV74.13.76.G10.1.454.CMB.1.raw
  modified_base (434)..(434): a, c, t, g, unknown or other
  misc_feature (434)..(434): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccagggcctccgaggggaaggggctggagtgcgtctcttttattatagtagtggtagtacatactccgcagactccgtgacggggccattcaccatctccagagacaattccaaagaacacgctgtttctcaaatgaacngccctgagagccgatgacacggccgtgtattactgtgcgagagagtggggaccccaaggaacgttacctacgcttagtcgggacgtcgtggggccaaacgggg

SEQ ID NO: 182859 - DNA, 731 bp, Homo sapiens
  misc_feature: GYAE6OF01EPQUB.13.76.G10.1.454.CMB.1.raw
  modified_base (146)..(146): a, c, t, g, unknown or other
  misc_feature (146)..(146): n is a, c, g, or t
  modified_base (185)..(185): a, c, t, g, unknown or other
  misc_feature (185)..(185): n is a, c, g, or t
  modified_base (194)..(194): a, c, t, g, unknown or other
  misc_feature (194)..(194): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
tcagtcacgtactacacgaccggtgctcgatttagtcactcatacaggggctggggagaggagcccagcactgggattccgaggtgtttccattcggtgatcagcactgaacacagaggactcaccatggagttttggctgagcgngttcgtgtaggcgtattaaagtgccagtgtgagtgcagntggtgagtnggagtgctgatccagctggggcctgagctctctgngcancctntgggttcaccgtgatcancctagagtgagcgttggtcgccgaggacgtccgagggaaggggacggtccgggaacggttaggacgtacgttaccgttttacgttttaaacttacggtacgggttcggttaaggggtttaacccgaaagttaactttaccgggtacccctaaaggtaaccgtaccggtcccgggtaaaagggggtccccggggaaaagttttccgaaacccgtaccgttaccgtttcccctaagggtaacgtaaccgaaacgttttaccctaaacgggtaacctaaaccgggaccgtacgtttccgttttacccgaaacgtacgtaacgtaaagttacccttcgtacgtaaagggcccgtaaactttagtacgtacggacccgttcgggttaacttacgtttacgggtacggtacggtaggacggtacggtacgggaccgtaccgtaacgtacgtacgtacgtacgtacgtcgtcggtcggtacgg

SEQ ID NO: 182860 - DNA, 559 bp, Homo sapiens
  misc_feature: GYAE6OF01D46O4.13.76.G10.1.454.CMB.1.raw
  modified_base (292)..(292): a, c, t, g, unknown or other
  misc_feature (292)..(292): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagntgccaagccggacctcgagggactcccgtgagcgtacttctctggcctcaactcgtaggaacctcgacgccactctcgacctatcgaggccggacccaggcctagcggatgacggtctaggtactattacgtgtacgaggtcgtaggggactaggcgagcctaacgtcgccccgtattaccgttgttaccgttacgggtaacgtcggggtaacccgtaaacgggtccgaacccggttacccgtaacggtccgaccggtaaaccccgg

SEQ ID NO: 182861 - DNA, 506 bp, Homo sapiens
  misc_feature: GYAE6OF01ATWR6.13.76.G10.1.454.CMB.1.raw
  modified_base (451)..(451): a, c, t, g, unknown or other
  misc_feature (451)..(451): n is a, c, g, or t
tcagtcacgtactacacgaccggtgctcgatttagtcactcatacagggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctacccagctggtaccaacagaccccagccaggctccgcgcacgctcatctacacacaaacactcgctcttctgggtccctcatcgcttctctgctccatccttggaacaaagctgcccttatcatcgacggggcccaggcagaagatgaatctgattattatgtgttctttatatggtatgctatttctgtctgtgttcggaggnggccgacccggctgaccggtcctcggtcacgtcccagcgtcgccccgtgtcccgg

SEQ ID NO: 182862 - DNA, 553 bp, Homo sapiens
  misc_feature: GYAE6OF01B2HA3.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaattggcagataaatatacttcctggtatcagcagaagtcaggccagtcccctgtgctggtcatctatcaagatgcaagccgccctcgagggactccctggacgcgtattctctggcctcaactctggaacctcacgccactctagaccagtcaggccgggacccaggactagtggactggacggtctgacttattactgtcgaggtcgtagggactagcagccactcggccccgtatacgtcggttaccgttacgggaaacgtcggggtaaacccgaacgggtccctaaccccggttacccgtaaacggtcccgaaccggtaacccccgg

SEQ ID NO: 182863 - DNA, 541 bp, Homo sapiens
  misc_feature: GYAE6OF01AXA87.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaagggctgggagtgcgtctcttttattatagtagtggtagtacatactccgcagtactccgtgacggggccattccacctatcctccagacgacaattccaagaaccacgcttgtttctacaaatgaacagcctagacgagccgatgacacggccgtagtacttcgtgtcgcgagagacgtcggggacccaggaaccgttacaccgtctagtggacgttcgtggggaacccg

SEQ ID NO: 182864 - DNA, 479 bp, Homo sapiens
  misc_feature: GYAE6OF01A2O18.13.76.G10.1.454.CMB.1.raw
  modified_base (430)..(430): a, c, t, g, unknown or other
  misc_feature (430)..(430): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggactccctgagcgattctctggctccaactctggaactcagccactctgaccatcagcggacccaggctatggatgagctgactattactgtcaggcgtgggacagcagcactgcccgntagtcgtcttcggaactcgggaccaaggtcaccgtacaagtcagacccg

SEQ ID NO: 182865 - DNA, 552 bp, Homo sapiens
  misc_feature: GYAE6OF01DPR3T.13.76.G10.1.454.CMB.1.raw
  modified_base (170)..(170): a, c, t, g, unknown or other
  misc_feature (170)..(170): n is a, c, g, or t
  modified_base (193)..(193): a, c, t, g, unknown or other
  misc_feature (193)..(193): n is a, c, g, or t
  modified_base (255)..(255): a, c, t, g, unknown or other
  misc_feature (255)..(255): n is a, c, g, or t
  modified_base (324)..(324): a, c, t, g, unknown or other
  misc_feature (324)..(324): n is a, c, g, or t
  modified_base (385)..(385): a, c, t, g, unknown or other
  misc_feature (385)..(385): n is a, c, g, or t
  modified_base (420)..(420): a, c, t, g, unknown or other
  misc_feature (420)..(420): n is a, c, g, or t
tcagtcacgtactacacgaccggtgctcgatttagtcactcatacaggggggagaggagcccagcactgggattccgaggtatttccattcggtgatcagcactgaacacagaggactcaccatggagttttggctgagcgtggtttcgtatagtattaaagtgtcagtntgagtgcagttgtggagtctggnggaggcttggtccagccggggggtccctgagactctcatgtgcggcctctgggctcaccgtnaacaccaaactacatgagcctgggtccgccaggcctaccgagggaaagaggccggtaagtggggtcctnagtttatttatgtccgaggtgccacattctacgcagactccgtgaggggtccgttcaaccntctcagagacactacgaacgacgacgtatatctanaaatagaacgactgagagacgacggacgacgtcgtactaattacgtgtgacgaagatgcagacggaccggacccgtagcgggtcgtgggtcggtcggttcttgttcgtcgtcgcggcgggccgtcgggaccg

SEQ ID NO: 182866 - DNA, 492 bp, Homo sapiens
  misc_feature: GYAE6OF01ETVK1.13.76.G10.1.454.CMB.1.raw
  modified_base (237)..(237): a, c, t, g, unknown or other
  misc_feature (237)..(237): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (307)..(307): a, c, t, g, unknown or other
  misc_feature (307)..(307): n is a, c, g, or t
  modified_base (444)..(444): a, c, t, g, unknown or other
  misc_feature (444)..(444): n is a, c, g, or t
tcagtcacgtactacacgaccggtgctcgatttagtcactcatacaggggcgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggcatcacctgctctggaaataattggcagataaatntacttcctggtatcagcagaagtcaggccagtcccctgtgctggtcatctancaagntgccaagcgcctnacgggactccctgagcgattctctggctccaactcgtacgggaacctcacgcctactctcgaccatcagcggacccaggctagtggatgagctgactattactcgtcgacggcgtagggacagcagcactcgcccgntagtgtcttcggactcgggaccaaggtcaccgtactagtcagtacccg

SEQ ID NO: 182867 - DNA, 555 bp, Homo sapiens
  misc_feature: GYAE6OF01DDG2V.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaattggcagataaatatacttcctggtatcagcagaagtcaggccagtcccctgtgctggtcatctatcaagatgccaagccggccctcgagggactccctgacgcgattctctggctccactctgggaactcacgccactctcgaccatcagccggacccaggctagtcggatggagctagactattactgtacgacggtcgtacgggacacgcacgctaaccgtcggaccccgtcgtacgttcggtaccgttaccgggtaaaccgtacggggtaacccgtaacgggttccctaaacccggttcctaaacggtcgaacccggtaacccccgg

SEQ ID NO: 182868 - DNA, 308 bp, Homo sapiens
  misc_feature: GYAE6OF01EHNU6.13.76.G10.1.454.CMB.1.raw
  modified_base (302)..(308): a, c, t, g, unknown or other
  misc_feature (302)..(308): n is a, c, g, or t
tcagtcacgtactacacgaccggtgctcgatttagtcactcatacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnnnnn

SEQ ID NO: 182869 - DNA, 499 bp, Homo sapiens
  misc_feature: GYAE6OF01DVKNY.13.76.G10.1.454.CMB.1.raw
  modified_base (441)..(441): a, c, t, g, unknown or other
  misc_feature (441)..(441): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtcccgtgtcccccaggacagacagccagcatcacctgctctggaaataaattggcagataaatatacttcctggtatcagcagaagtcaggccagtcccctgtgctggtcatctatcaagatgccaagcggccctcaggatccctgagcgattctctggctccaactctgggaactcagccactctgaccatcagccgggaccaggcctagtggatgaggctgacttattactgtacgaggcgtgggacagcagcactcgcccgtntacgtcgtcgttcggaacgtcggaccaacggtccaaccgtctaaacgccgagaccccg

SEQ ID NO: 182870 - DNA, 955 bp, Homo sapiens
  misc_feature: GYAE6OF01EP9JT.13.76.G10.1.454.CMB.1.raw
  modified_base (174)..(174): a, c, t, g, unknown or other
  misc_feature (174)..(174): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgcccaccctnagtcgtccgtcgtcccgaggacagacacgccagcactccacctgccttcgtaaggaaaattaagttggacaagtaaattaaaattacttaccttccgttaggttacttacagacaagtaagtcgacggaccctacgtcccccgtggtcgtcgttcggtactacttacttaactaccgaaagtacgttaccgaacccgtaaacgggccccggtaccccgttaccgggaacggggtaacccttccccggttaggaaccgggtaccggttaacctttccgttcccggtacgggttaccctaaccccgtttttttaaaaccgcccggttaaccggggtaaacccttacccggaaccggtacccccttaacgttcccggttaacccgtaaccccgtacgttaaccccggaaccggggtaaccccggggaaaccccggtacggtaacccgtttaacgggtacgggttaacggttacggggtaaccggttccgttaacggttaaacccgtttaagtttttaacccggtcgggtttaacccggaacgggggttacccggggtttaacgggggaacctaaccccgggtacggaacccggtaaccgttaacccggttcccgggtacccccgtaacgttttaaccgggtttccggtttaacccgggtttaaccggggtaaccccggttaacgggggtaaaacccccgttaaccgggttaaccccggttaaacccccgggtttaaaccccgttaaaccgggtccccgtaaaccccggggaaaacccccccggg

SEQ ID NO: 182871 - DNA, 482 bp, Homo sapiens
  misc_feature: GYAE6OF01BAXTJ.13.76.G10.1.454.CMB.1.raw
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
  modified_base (475)..(475): a, c, t, g, unknown or other
  misc_feature (475)..(475): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtccccctgtgctggtcatctatcaagatgccaagcggccctcagggatccctgagcgattctctggctccaactctgggaactcagccactctgaccatcagccgggacccaggctagtggatggagctggactattacngtcaggcgtgggacngcagcnctcgcccntacgtgtcttcggactgggaccaggtccacgtcctacgcncgacccg

SEQ ID NO: 182872 - DNA, 558 bp, Homo sapiens
  misc_feature: GYAE6OF01CQZTZ.13.76.G10.1.454.CMB.1.raw
  modified_base (437)..(437): a, c, t, g, unknown or other
  misc_feature (437)..(437): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggaaggggctgggagtgcgtcttcttttatttatagtagtggtagtacatactccgcagactccgtgaggggccattcaccatctccagagacaattccaagaaccacgcttgtttcttacaaatgaaacngcctgagagccgatgacacggccgtgtattactgtgcgagagacgtcggggacccaacggaacgtttaccgaacgtcttagtcgggaaccgttcgtcgggggacccaagggggtaaccccg

SEQ ID NO: 182873 - DNA, 475 bp, Homo sapiens
  misc_feature: GYAE6OF01C27OY.13.76.G10.1.454.CMB.1.raw
  modified_base (429)..(429): a, c, t, g, unknown or other
  misc_feature (429)..(429): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatataacttcctggtatcagcagaagtcaggccagtcccctgtgctggtcatctatcaagatgccaagcggccctcagggatccctgagcgattctctggctccactctgggaactcagccactctgaccatcagcggaccaggctatggatgagctgactattactgtcaggcgtgggacagcagcactgcccgntagtgtcttcggactgggaccaggtccaccgtctaacgcagacccg

SEQ ID NO: 182874 - DNA, 578 bp, Homo sapiens
  misc_feature: GYAE6OF01DEFJB.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaattggcagataaatatacttcctggtatcagcaagaagtcaggccagtcccctgtcgctggtcatctatcaagntgaccaagccgccctcgagggactcccgtgacgtcgtattctctcggcctaccaactcgtaggaacctcgacgccactctcgaccatccaggccggaacccaggtctagtggatggagctagtacttagttacgtgtcgacggtcggtagggacagaccgagctaccgtcggccccgtcgttacgtcggttacccgttaccgggtaacggttaccggggaaccctaacgggttaccctaaccccggttaccgttaaacggcccgtaccggtaaaccccccg

SEQ ID NO: 182875 - DNA, 527 bp, Homo sapiens
  misc_feature: GYAE6OF01BM1RP.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagcctgggggtccctgagactctcctgtgcagcctctgggttcaccgtcagtcacacctacatgagctgggtccgccaggcctccgagggaggggctggagtgcgtctcttttattatagtagtggtagtacatactcgcagactccgtgaggggccattcaccatctccagagacaattccaagaacacgctgtttctcaaatgaacagcctgacgagccgatcgacacggtccgtgtattactgtgcgagagagtcggggcccaggaacgttctacgctagtcgggacgtcgcggggccgaagggacccg

SEQ ID NO: 182876 - DNA, 540 bp, Homo sapiens
  misc_feature: GYAE6OF01CXUGU.13.76.G10.1.454.CMB.1.raw
  modified_base (389)..(389): a, c, t, g, unknown or other
  misc_feature (389)..(389): n is a, c, g, or t
  modified_base (451)..(451): a, c, t, g, unknown or other
  misc_feature (451)..(451): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcaagataaatatacttcctggtatcagcagaagtcaggccagtcccctgtgctggtcatctatcaagatgccaagcggccctcgagggactccctgagcgattctctggctccactctgggaactcacgccactctcgaccatcgacgccgggaccaggctagnggagtgaggctagacttatacgtgtacgaggtcgtagggacagcgacgcaccgtcgcccgtntacgtcggttccgttacgggaaaccgttcggggaaccctaagggttcccgtaacccgttacctaaacggtccgaacggtaaacccccgg

SEQ ID NO: 182877 - DNA, 579 bp, Homo sapiens
  misc_feature: GYAE6OF01CV3BO.13.76.G10.1.454.CMB.1.raw
  modified_base (275)..(275): a, c, t, g, unknown or other
  misc_feature (275)..(275): n is a, c, g, or t
  modified_base (363)..(363): a, c, t, g, unknown or other
  misc_feature (363)..(363): n is a, c, g, or t
  modified_base (423)..(423): a, c, t, g, unknown or other
  misc_feature (423)..(423): n is a, c, g, or t
tcagtcacgtactacacgaccggtgctcgatttagtcactcatacagggggggagaggagcccagcactgggattccgaggtgtttccattcggtgatcagcactgaacacagaggactcacatggagttttggctgagcgtggtttcgtgtagctatttaaaggtgccagtgtgaggtgcagctggtggagtcgtggaggaggcttgatccagcctggggggtccctgagctctcctgtgcagcctcgtgggttcatcgtcagtcacacctacntgagctgggtccgccgaggcgtccgaggggaacggggctgggagtgtcgttccttatttttattatagttaggtagttagtacatacnccgcagactcggaggacgggccgattcaccatcctaccgagacgaactaattcccgaaanaacgacgtacttgttttctacaaaatcgaaccaggtcctagagacgtccgattacggactaccggtcgtagttaacttcgtgtcgcggagacgtgtccggggcccaacggtaacgttacgtacgcttagcggtacgtcggcggggtccaaacgggg

SEQ ID NO: 182878 - DNA, 486 bp, Homo sapiens
  misc_feature: GYAE6OF01DF0SG.13.76.G10.1.454.CMB.1.raw
  modified_base (402)..(402): a, c, t, g, unknown or other
  misc_feature (402)..(402): n is a, c, g, or t
  modified_base (430)..(430): a, c, t, g, unknown or other
  misc_feature (430)..(430): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcgccctcagggactcccgtgagcgattctctggctccaactctggaactcagccactctgaccatcagcggacccaggctagtggatgagctgactattacngtcaggcgtggacagcagcactgcccgntacgtgtcttcggaactcgggacaacggtccaaccgtcctaacgtcgcgtaccccg

SEQ ID NO: 182879 - DNA, 551 bp, Homo sapiens
  misc_feature: GYAE6OF01EWIJR.13.76.G10.1.454.CMB.1.raw
  modified_base (434)..(434): a, c, t, g, unknown or other
  misc_feature (434)..(434): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggctccgaggggagggctggagtgcgtctcttttattatagtagtggtagtacatactccgcagactccggtgaggggccattcaccatctccagagacaattccaaagaacacgcttgtttctacaaatgaaacngcctgagagccgatcgacgacgggccttgtacttactggtgcgagagagtcgggggccccaaggaaccgttacaccggcttagtcgggacgtcggtcggggacccaaggggaccccg

SEQ ID NO: 182880 - DNA, 488 bp, Homo sapiens
  misc_feature: GYAE6OF01DMJB5.13.76.G10.1.454.CMB.1.raw
  modified_base (405)..(405): a, c, t, g, unknown or other
  misc_feature (405)..(405): n is a, c, g, or t
  modified_base (435)..(435): a, c, t, g, unknown or other
  misc_feature (435)..(435): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagccccctgtgctggtcatctatcaagatgccaagcggcccctcgagggatccctgacgcgattctctggctccactctggaactcagccactctgaccatcagcgggacccaggctatggatgaggctgactattcngtcaggcgtgggacagcagcactgcccgtntagtcgtcttcggaacgtcgggaccaaggtccacgtcctaagtcgagaccccg

SEQ ID NO: 182881 - DNA, 519 bp, Homo sapiens
  misc_feature: GYAE6OF01DN0SU.13.76.G10.1.454.CMB.1.raw
  modified_base (236)..(236): a, c, t, g, unknown or other
  misc_feature (236)..(236): n is a, c, g, or t
  modified_base (288)..(288): a, c, t, g, unknown or other
  misc_feature (288)..(288): n is a, c, g, or t
  modified_base (325)..(325): a, c, t, g, unknown or other
  misc_feature (325)..(325): n is a, c, g, or t
  modified_base (346)..(346): a, c, t, g, unknown or other
  misc_feature (346)..(346): n is a, c, g, or t
  modified_base (507)..(507): a, c, t, g, unknown or other
  misc_feature (507)..(507): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacagtctctgtgacctcctatgaactgacacagccatcctcagtgtcagtgtctccgggacagacggccaggatcacctgctcaggaaatattctgaacaaaaaatntgctcggtggttccagcagaagccaggccaggccccagtactggtgatttanaaagcattgagcgcctgagggatccctgagcgattcnccggctctaatcagggaccanagtcacttgaccatcacgggcccagattgagatgaggctgactattattgttactctgcggctgacaaccattcgtggttttcgggcgggggtacctaggttcgaccgtggtgggtcaggtcccaagggcctcgcccccgtcggtcacctctcgttccccncccgtccctacg

SEQ ID NO: 182882 - DNA, 534 bp, Homo sapiens
  misc_feature: GYAE6OF01BYRD9.13.76.G10.1.454.CMB.1.raw
  modified_base (433)..(433): a, c, t, g, unknown or other
  misc_feature (433)..(433): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtcttcttttatttatagtagtggtagtacatactccgcagactccgtgaggggccattcaccatctccagagacaattccaagacacgctgtttctacaaatgaacngcctgagagccgatgacacggtccgtgtacttactgtgcgagagagtcgggcccaggaacgttcacgctagtcggacgtcggtcggggccgaagggacccg

SEQ ID NO: 182883 - DNA, 696 bp, Homo sapiens
  misc_feature: GYAE6OF01ECKIK.13.76.G10.1.454.CMB.1.raw
  modified_base (243)..(243): a, c, t, g, unknown or other
  misc_feature (243)..(243): n is a, c, g, or t
tcagtcacgtactacacgaccggtgctcgatttagtcactcatacagggggccgtggggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataattggcagaataaatntacttcctgtactcagcagaagtcacggccacgtcccctgtgctggtcatctatacaagactcgaccaagccggtccctacgacgggtactcccgtagacggtcgtactttccgtcgtcggtcccttacccgtaaaccttccggtacgggtaaacctccgaacgtaccctaccgttccgtaccgaacccacgtaccgaacggacccgggaacccagggtacgttaacgtacgggtagtacggaggtccgtacgttaacttacttacgtgttaccggaggtcgggtacgggaccgtacgaccgtacgccgtaacgtcccggtacccgtacgttacggttacggttaccggttaacccgggtaaccggtaccggggtaaacccgttaacccgggttaccccgtaaccccggttaacccgttaaaccgggttacccgacccggtaaaccccccggg

SEQ ID NO: 182884 - DNA, 515 bp, Homo sapiens
  misc_feature: GYAE6OF01DJBF2.13.76.G10.1.454.CMB.1.raw
  modified_base (285)..(285): a, c, t, g, unknown or other
  misc_feature (285)..(285): n is a, c, g, or t
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (393)..(393): a, c, t, g, unknown or other
  misc_feature (393)..(393): n is a, c, g, or t
  modified_base (405)..(405): a, c, t, g, unknown or other
  misc_feature (405)..(405): n is a, c, g, or t
  modified_base (409)..(409): a, c, t, g, unknown or other
  misc_feature (409)..(409): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtctggaggaggcttgatccagccgtgggggccctgagactctcctgtgcagcctcgtggtcacgtcagtcacacctacatgacgctgggccnccaggcttcgagggaggcaggcgtgngtctctttattatagtagtgtagtacatactcgcacgctcgcgagggcgactcacatcnccagagacataccagacacnctnttctataataanacancagagacgacgagacgacgacgtcgtagtagttacgtgtgagagagaggacggaccgacgtacgtacgtacgacgtacgtacgtacgtacggcggacggacggacg

SEQ ID NO: 182885 - DNA, 494 bp, Homo sapiens
  misc_feature: GYAE6OF01BARN0.13.76.G10.1.454.CMB.1.raw
  modified_base (412)..(412): a, c, t, g, unknown or other
  misc_feature (412)..(412): n is a, c, g, or t
  modified_base (442)..(442): a, c, t, g, unknown or other
  misc_feature (442)..(442): n is a, c, g, or t
tcagtcacgtactaacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggactccctgagcgattctctggctccaactctgggaactcagccactctcgaccatcagacgggacccaggcctagtcggatgaggctgactattacngtcaggcgtgggacagcagcacgtgcccgntacgtcgtcttcggaactgggaccaggtccaccgtactaagtcgagaccccg

SEQ ID NO: 182886 - DNA, 487 bp, Homo sapiens
  misc_feature: GYAE6OF01CJMGB.13.76.G10.1.454.CMB.1.raw
  modified_base (381)..(381): a, c, t, g, unknown or other
  misc_feature (381)..(381): n is a, c, g, or t
  modified_base (429)..(429): a, c, t, g, unknown or other
  misc_feature (429)..(429): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctagggaactcagccactctgaccatcagcggaccaggctangatgaggctgactattactgtcaggcgtgggacagcagcactgcccgntatcgtcttcggaactgggaacctaaggtccaaccgtcctaagccagcccgaaaccgg

SEQ ID NO: 182887 - DNA, 534 bp, Homo sapiens
  misc_feature: GYAE6OF01CBL5J.13.76.G10.1.454.CMB.1.raw
  modified_base (426)..(426): a, c, t, g, unknown or other
  misc_feature (426)..(426): n is a, c, g, or t
  modified_base (502)..(502): a, c, t, g, unknown or other
  misc_feature (502)..(502): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggtccgccaggcgtcgagggaaggggcgtggagtgcgtcttctttatttatagtagtgtagtacatactcgcagactcgtgaggggccatcaccatctccagagacaacttacaacgaacacgcttcgtttcttacaaatnaacagcctgagacgcgatagacgacggtccgtagtacttacgtgtgcgagagagtcgggccctagaacgttcacgntactggtacgtcgtcgggccgaagggtacccg

SEQ ID NO: 182888 - DNA, 697 bp, Homo sapiens
  misc_feature: GYAE6OF01CN9PV.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcaacctctggattcagtatttgatgagtatggctatacacgtcgggtcccaccaaccgtccgaaggggaacgggctggcgtaggtgggtctcgtaggtaactaaacgtggaattgggtcgaccgaggcaactaacttatgcaagtactcgtggtacgaacgggaccgtacgttccaacctatacctacccaagtaacgtaaacctaaacgtttacccgaaaacgaaacctaaccgtaccgtttacggttttaacccttaactaaaagttacggaaaaccgtaccggtacccgttaggaacggaccggacccgtaagtacggaaccgacccgggtaccgttaaggttacttaacggttcggttacggacggaaaggtacggtaacggtacccgggggtaacccctaaacggttaaccggtttaacccgtaacggtccgttaaacgggg

SEQ ID NO: 182889 - DNA, 506 bp, Homo sapiens
  misc_feature: GYAE6OF01DBTSL.13.76.G10.1.454.CMB.1.raw
  modified_base (294)..(294): a, c, t, g, unknown or other
  misc_feature (294)..(294): n is a, c, g, or t
  modified_base (422)..(422): a, c, t, g, unknown or other
  misc_feature (422)..(422): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggtcagtcccctgtgctggtcatctatcaagntgccaagcggccctcgagggatccctgagcgattctctggctccaactctgggaactcagccactctgaccatcagccggacccaaggcctatggatgaggctgactattactgtcaggcgtgggacngcagcacgtcgcccgtctagtcggtcttcgggaacgtcgggaacccaagggtccctacgtaccctaaggtccacggtaaccccg

SEQ ID NO: 182890 - DNA, 562 bp, Homo sapiens
  misc_feature: GYAE6OF01DG2YU.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctcgtggttcaccgtcagtcacacctacatgagctgggtcccgccaggcctccgaggggaaggggctgggagtgcgtcttcttttattatagtagtggtagtacatactccgcagactccgtgaggggccattcaccatctcagagacaattccaagaacacgtcttgtttcttcaaatgaacagcctgagacgccgatcgacacgggtccgtagtattacgtgtgcgagagagtcggggcccaacggtaaccgttacctacgtactaagtcgggacgttcgtcgggggacccgaaggggtaaccccgg

SEQ ID NO: 182891 - DNA, 568 bp, Homo sapiens
  misc_feature: GYAE6OF01BENHK.13.76.G10.1.454.CMB.1.raw
  modified_base (383)..(383): a, c, t, g, unknown or other
  misc_feature (383)..(383): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgagggagggctggagtgcgtctcttttattatagtagtggtagtacatactcgcagactcgtggacggggccattcaccntctccagacgacaattccaagaacacgtctgtttactacaaatgaacagcctagagacgccgatcgaccgacgggtccgttgttaacttacgtggtcgcggaagtaggagtccgggggaccctaacggtaaaccgttactaccggcttaagtcggacgttcggcggggacccgaagggtaccccg

SEQ ID NO: 182892 - DNA, 499 bp, Homo sapiens
  misc_feature: GYAE6OF01EKX9L.13.76.G10.1.454.CMB.1.raw
  modified_base (442)..(442): a, c, t, g, unknown or other
  misc_feature (442)..(442): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatatacttcctggtatcagcagaagtcaggccagtcccctgtgctggtcatctatcaagatgccaagcggccctcgacgggatccctgagcgattctctcggcctccaactcgtacgggaactcacgccactctgaccatcaggccggacccaggctatggatgaggctgactattactgtcgaggcgtgggacagcagcacgtcgcccgntagtcgtcttcgggaactcgggaccaaggtccaccggtacctaacgtcacgaccccg

SEQ ID NO: 182893 - DNA, 590 bp, Homo sapiens
  misc_feature: GYAE6OF01EMD6S.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataatggacagataaatatacttctgtatcagcagaagtcaggccacgtcccctgtgcgtggtctatctatacaagntcgaccgaagccggccctcgaggactcccgtagacgcgtattctcgtcggacctccaactcgtacggaactcgacgccctactcctacgaccacgtacgacggacccgggaacccgaggacttaggtaggtacgtggacggtccttagtaaccttacgttacgtcggtacggacgggtcgggtagggacctacggcacggccacgtccggcccgtagttacgtcgtaccgttacgggaacgtacgggaacccgtacggtcccgtacccgtactaaccggcaaccggaaccccg

SEQ ID NO: 182894 - DNA, 692 bp, Homo sapiens
  misc_feature: GYAE6OF01D2NAN.13.76.G10.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (653)..(653): a, c, t, g, unknown or other
  misc_feature (653)..(653): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttattttaaaaggtgccagtgtgaggtgcagctggtggagtcgtggaggaggcttgatccagccgtgggggtccctgagacctctcctgtgcagcctcgtggttcaccgtcagtcaacacctacatgagcgtcgggtccgccgaggcctccggaaggggaacggggcgtgggacgtggccgttctttactttttattataggttagtggtaacgtactatactccganacgtaccgtcggtaggacggggccgtacttccaaaccgtnttaccgtaccgaacgtaacgaaacctaacgttacccgaaaacgtaaacctaccggtcttttacggtttaaccctttaacgtaaaaacgttacggaaaaccgtacggtacccgttaggaacggtaaccgtaccggaacgttacggaacccgtaccgggtacccgttagttaacttacgtgtagacgagtacgagggtaccgggaccctaaggtaaccgttacacggtntaacggtcggtacgtccgaggggtaccgaagggtacccg

SEQ ID NO: 182895 - DNA, 557 bp, Homo sapiens
  misc_feature: GYAE6OF01EX2KJ.13.76.G10.1.454.CMB.1.raw
  modified_base (450)..(450): a, c, t, g, unknown or other
  misc_feature (450)..(450): n is a, c, g, or t
  modified_base (480)..(480): a, c, t, g, unknown or other
  misc_feature (480)..(480): n is a, c, g, or t
  modified_base (495)..(495): a, c, t, g, unknown or other
  misc_feature (495)..(495): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgtccagtgtgaggtgcaactggtggagtctgggggaggcttggtccagccgtggggggtccctgagactctcctgtcaagcctctgggttcagcttcagtgtatattggatgagctgggtccgccagactccgagggaaggggctgggaggtgggtggccaacgataaacacagacggaagtcgacccatactatgcggactctggtgaagggccgtattccaccatctccgagacgacaacgccaaagaactcactatatttgacaagtggaccnctgagagacgagacagctatgtatacgtgngcgagagatggaagnggttcggacgttacgacggggttcggggggacccggaacccgttgggtcccgaccggtaccg

SEQ ID NO: 182896 - DNA, 576 bp, Homo sapiens
  misc_feature: GYAE6OF01BC8MQ.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggcctccgaggggaaggggctggagtgcgtcttcttttattatagtagtggtagtacatactccgcagactccggtgacggggcctattcaccatcctaccgagacgacaacttccaagaaccacgtcttgtttctacaatgaacagcctgagacgccgatacgacgacggtccgttgttacttacgtgtcgacgagagaggtccggggaccctaacggtaaccggttcacggtcttagtcgggaccgtcggtcggggacccgaacggggtaccccg

SEQ ID NO: 182897 - DNA, 703 bp, Homo sapiens
  misc_feature: GYAE6OF01C84Z1.13.76.G10.1.454.CMB.1.raw
  modified_base (334)..(334): a, c, t, g, unknown or other
  misc_feature (334)..(334): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttccaccgtcagtccacacctacatgagcgtgggtccgccaggcctccgaggggaagggctgggagtgcgtcttntttattatagtagtggtatacatactcgcagactccgtgacggggccattcaccatcctaccgagacgaacaacttaccaaagaaccacgtcttagtttacctacaaattcgaaacctagtaccctaggaacgacgacccgtaagtcggaaccgtaccggggtcccgttaggttaacgtttaaccgtgggttacggaccggtaaggtaacgggtaacgggttacccgggggggtaacccccctaaaggggttaaaaccccggttttacccgttaaaccgggtacccgtttaaacggtacgggggttaaccccggttaccggggttaccgggggggaaacccccgtaaaacgggggggtaaaccccccgg

SEQ ID NO: 182898 - DNA, 514 bp, Homo sapiens
  misc_feature: GYAE6OF01EX1I4.13.76.G10.1.454.CMB.1.raw
  modified_base (296)..(296): a, c, t, g, unknown or other
  misc_feature (296)..(296): n is a, c, g, or t
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcanctacaacacaaacactcgctcttctgggtccctcatcgcttctctggctcatccttgggaacaaagctgcccttatcatcacgggggcccaggcagaaagatgaatctgattattactgtgtttctttatatggtagtgcctatttctgctgttgttcggaggaggcgacccggctggacccgtccgtcggtcacgacccaggctcgccccagtccgg

SEQ ID NO: 182899 - DNA, 558 bp, Homo sapiens
  misc_feature: GYAE6OF01C8QD2.13.76.G10.1.454.CMB.1.raw
  modified_base (482)..(482): a, c, t, g, unknown or other
  misc_feature (482)..(482): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttccaccgtcagtcacacctacatgagcgtgggtccgccgaggcctaccgaggggaaggggctggagtgcgtcttcttttattatagtagtggtatacatactcgcagactcggtgaggggcctattccacatctccagagactaattccaaagaacacgcttgtttctacaaatgaaccagcctgagacgccgatcgaacacgggtccgtagttattacgngtgacggagagagtcggggaccccaggtaaccgttacacgctagtcggtacgtcggcggggacgaacgggaacccg

SEQ ID NO: 182900 - DNA, 673 bp, Homo sapiens
  misc_feature: GYAE6OF01CVXR9.13.76.G10.1.454.CMB.1.raw
  modified_base (262)..(262): a, c, t, g, unknown or other
  misc_feature (262)..(262): n is a, c, g, or t
tcagtcacgtactacacgaccggtgctcgatttagtcactcatacaggggagaggagcccagcacctgggattccgaggtgtttccattcggtgatcagcactgaacacagaggactcaccatggagttttggctgagcgtggtttccgtgttagctatttaaaggtgccagtgtgaggtgcagctggtggagtctggaggaggcttgatccagccgtgggggtccctgagactctcctgtgcagcctcgtggttcaccgtnagtcaacacctacatgacgcgtgggtcccgccgagggcctccgaggggaagggccgtgggagtgcgtcttcttttattatagtagtggtagtactatacgtccgactacgtactcccggtggacggggccgtattaccgaccactctacccgaaggaacgaacctaacttacccgaaaggtaacccacgttccgttacgttttacctttaacaaaacgttcgaaacctaggtcccttaggaaccgtagccccggaattaccggaacccgtaaccgggtccgttaagttacgttacgtggtacggaccggaaggacgtacggtccgggggaacccctaaggttaaaccggtttaaccgcgtacgttaacgtacgggtaccgtggggtccggggaccgtaaacgggggacccc

SEQ ID NO: 182901 - DNA, 448 bp, Homo sapiens
  misc_feature: GYAE6OF01C0WRJ.13.76.G10.1.454.CMB.1.raw
  modified_base (436)..(448): a, c, t, g, unknown or other
  misc_feature (436)..(448): n is a, c, g, or t
tcagtcacgtactacacgaccggtgctcgatttagtcactcatacaggggcttgagtggatgggagggatcctctctggttttggtctggggacctatgcaccgaagctccagcctagactcatcattaccgcggacgaatctgcgagcacagtctacatggaactgaccagcctgcgttctgatgacacggccgtctattactgtgcgagaggtcccagtaatgacaagattgactcctggggcctgggaaccctggtcagtgtctcctcagcctccaccagggccatccggtccttccccgtggccgccctgcctccgaggacgccaccgtccgagacgcacgacggccggcccgtgggcctcgccgtggtaccaacggtccttaccttccgtagtacgtgacgtggacggcgggctggcgaaggcgacatagnnnnnnnnnnnnn

SEQ ID NO: 182902 - DNA, 580 bp, Homo sapiens
  misc_feature: GYAE6OF01DGOH4.13.76.G10.1.454.CMB.1.raw
  modified_base (298)..(298): a, c, t, g, unknown or other
  misc_feature (298)..(298): n is a, c, g, or t
  modified_base (570)..(570): a, c, t, g, unknown or other
  misc_feature (570)..(570): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctgggaggaggcttgatccagccgtggggggtccctgagactctcctgtgcagcctctgggttcaccgtcagtcacacctacatgagcgtgggtccncgaggctccgagggaagggctggagtgcgtcttctttattatagtagtggtagtacatactcgcagacctccgtggacggggccattccgacctatcctaccagaacgaactaacttaccaaagaacacgtacttcgtttactacaaaatcgaaactgacctaggaacgacgacccgatcggaaccacgggtccgttagtacttacgtggtgacggaagaggacgtcgggacccctaacgtaaccgttactacgactagtaggacgttcggnggggtaaccg

SEQ ID NO: 182903 - DNA, 517 bp, Homo sapiens
  misc_feature: GYAE6OF01AHGJU.13.76.G10.1.454.CMB.1.raw
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttggaacaaagctgcccttatcatcgacggggccaggcagaagatgaatctgattattactgttgttctttatattggtagtgcctatttctgcttgtggttggaggtcggcacccggctcgacccggtctccggtcacgtcccgaggtccncgcccngtcccgg

SEQ ID NO: 182904 - DNA, 561 bp, Homo sapiens
  misc_feature: GYAE6OF01DPVWP.13.76.G10.1.454.CMB.1.raw
  modified_base (473)..(473): a, c, t, g, unknown or other
  misc_feature (473)..(473): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgaccaagccggccctcgagggactccctgagcgattctctggctccaactcgtgggaactcgacgccactctacgacccatcgacggccggacccaggctagtggatggaggtctaggacttacgttacgtgtacgacgggcgtaggggaactaggctaaggccacgttccggaccccgtnttacgtcggtccgttacgggaacgttacggggaaccctaagggtaccctacccggttactaacggtccaaccggaccccgaaacccgg

SEQ ID NO: 182905 - DNA, 506 bp, Homo sapiens
  misc_feature: GYAE6OF01CNWV2.13.76.G10.1.454.CMB.1.raw
  modified_base (367)..(367): a, c, t, g, unknown or other
  misc_feature (367)..(367): n is a, c, g, or t
  modified_base (443)..(443): a, c, t, g, unknown or other
  misc_feature (443)..(443): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagccggccctcgagggactcccgtgacgcgattctctggcctccaactctgggaactcacgccactcngaccatcagcggaccaggctatggatgaggctagactattactgtacgagggcgtgggacagcagcactcgcccgntagtcgtcttcgggaactcgggaaccaacggtcctacccggtactaacgtccgacgaaccccg

SEQ ID NO: 182906 - DNA, 513 bp, Homo sapiens
  misc_feature: GYAE6OF01BTBIL.13.76.G10.1.454.CMB.1.raw
  modified_base (234)..(234): a, c, t, g, unknown or other
  misc_feature (234)..(234): n is a, c, g, or t
  modified_base (385)..(385): a, c, t, g, unknown or other
  misc_feature (385)..(385): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaaggcagacagccagcatcacctgctctggaaataattggcagataaatntacttcctggtatcagcagaagtcaggccagtcccctgtgctggtcatctatcaagatgaccaagccggccctcgacgggactccccgtgacgcgtattctctggctccactctcggaactcacgccactctcgaccatcaggccggaccnggctagtggatgaggctagacttattacgtgtacgacggcgtacggacacgcacgcgacgtcgccgcttagtcgttacgtacggacgtcggaccgaacggtcctacccgtactaacgtcgacgacccg

SEQ ID NO: 182907 - DNA, 532 bp, Homo sapiens
  misc_feature: GYAE6OF01AZJ5E.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtcgctggtcatctatcaagatgccaagccggccctcgacgggctcccgtgacgcgacttctctcggctcccgaactcgtacgggaacctcacgcccacgtctacgaccatccgacgccgggacccaggctagtcggatggagtctagtactacgttacgtcgtacgaggtcgtagggactagcagccacgtcgcccgtctagtcgtcgttacggacgacgggacctaacggtccaccgtacctacgtcgacgtacccg

SEQ ID NO: 182908 - DNA, 611 bp, Homo sapiens
  misc_feature: GYAE6OF01B1M02.13.76.G10.1.454.CMB.1.raw
  modified_base (298)..(298): a, c, t, g, unknown or other
  misc_feature (298)..(298): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcggggtcccnccgaggcctccggaggggaaggggctgggagtgcgtctttcttttatttatagttagtggtagtacatactcccgcagactccggtgacggggccattcaccatcctccagagaccaattccaaagaaccacgcttgtttacttacaaattcgaactacgccgtagacgtacgccgaagtcgaccgaccgggtccgtacgttattacgtgtcgacggagacggagtcgggggacccctaacggtaaccggtttacgaccgtcttaacgtcgggaccggttaccggtcgggggacccgaaaggggtacccccgg

SEQ ID NO: 182909 - DNA, 521 bp, Homo sapiens
  misc_feature: GYAE6OF01BLL9O.13.76.G10.1.454.CMB.1.raw
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctacccagctggtaccaacagacccaggccaggctccgcgcacgctcatctacaacacaaacactcgctcttctgggtccctcatcgcttctctggctccatccgtgggaacaaagctcgccttatcatcgacggggccaggcagaagatagaatctatattattactgtgttcttatagtggtagtgctatttctgtcgtgtgtcggaggtacggccgacccggctcggacccgtccgtcggtacacgacccgaacggcctcgccctgtcccgg

SEQ ID NO: 182910 - DNA, 601 bp, Homo sapiens
  misc_feature: GYAE6OF01CN882.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctctgggttcaccgtcagtcacacctacatgagcgtcgggtccgccaggcctccgaggggagggcgtggagtgcgtcttcttttattagtagtagtggtagtacatacctccgacacgacctccggtagacggggcctattccacctatcctccaagacgtaactaacttacccaaagaaccacgtcttacgtttacttacaaagtcgaactacgacctaggacgaacggacccgagtacgaaccgacgggtccgttgttaacttcgtggtgacggagacgtacggtcggggaccctaccggtaacgttacgtacgtacttagtcgggacgttcggtcggggaacccgg

SEQ ID NO: 182911 - DNA, 751 bp, Homo sapiens
  misc_feature: GYAE6OF01CU8OE.13.76.G10.1.454.CMB.1.raw
  modified_base (129)..(129): a, c, t, g, unknown or other
  misc_feature (129)..(129): n is a, c, g, or t
tcagtcacgtactacacgaccggtgctcgatttagtcactcatacaggggctgggcctcaggaagcagcatcggaggtgcctcagccatggcatggactccctctccttcctcggcgtccttgcttacngcacgaggactccgtgcctctatgagctacgacctccaccgccctaccctcgtacggtcgtcccgtccgaccccgaggaccacgaccacgacccagcctactccgaccgtgtacctaacgtaagtaaattaagtaggaactaagtaacttaaactacttaccgttcgtagtacacgaagacgaagacgtccgaccggtaccctaccggtcccctggtacgtaccgttacgtacctaacgttacctaacgtacgaaacgccgtaccgacccggtaaccggcccgaccgtacggaccgtacctccgagtacgtctacgttcgtacgtaccgtaccctaccgacgttacggaaccgtacctaccgacgtacctacgtacgaccgacgtacgacggacccggtaccgacgtagtcgtaggtacgtagtacgaccgtacgttacgttacgttaaccgtcggtacggtacgggtacggtaccggacgacgacgtaccgacgtacccgtaccgtccggaccgttacgtaccgggttaccgtacccggtttaaccggaccggttaccggtaacccggtacccgttacccgaacccggtacaaccccggtcccgaaccccggtaaaccccg

SEQ ID NO: 182912 - DNA, 534 bp, Homo sapiens
  misc_feature: GYAE6OF01CKF8O.13.76.G10.1.454.CMB.1.raw
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaagggctggagtgcgtctcttttattatagtagtggtagtacatactccgcagactccgtgacggggccattcaccatcctccagagacaattccaaagaacacgcttgtttcttacaaatgaacagcctaganacgcgatgacacggtccgtgtattactgtgcgagngagtcggggcccaggaacgttcacgctagtcggacgtcgtcgggccgaagggacccg

SEQ ID NO: 182913 - DNA, 626 bp, Homo sapiens
  misc_feature: GYAE6OF01CDOCS.13.76.G10.1.454.CMB.1.raw
  modified_base (214)..(214): a, c, t, g, unknown or other
  misc_feature (214)..(214): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggaccagacagccagcatcacctgctcngaaataatggcagataaatatacttcctggtatcagcagaagtcaggccacgtcccctgtgctggtcatctatcaagatgccaagccggcctcgagggactcccgtgacgtcgtattctacgtcggacctaccaaacgttccgtagggaacctcgacgtacccaacgtctacgacctactcgaacggacccgggacccaaggtccttaacgtggtaactacgggaacggctaggttaaccttaacgtttacgtgtaccgacggggtcggtacggggaaccaggtcccgacggtcctacggtccgccccggtacgttacgtcgtttaccgtacccgggtaaacgttccggggtaaccctaaacgggtccctaacccggttacccgtaaacgtccgaaccggtaaaccccccgg

SEQ ID NO: 182914 - DNA, 574 bp, Homo sapiens
  misc_feature: GYAE6OF01AJZ7A.13.76.G10.1.454.CMB.1.raw
  modified_base (313)..(313): a, c, t, g, unknown or other
  misc_feature (313)..(313): n is a, c, g, or t
  modified_base (382)..(382): a, c, t, g, unknown or other
  misc_feature (382)..(382): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggaaataattggcagataaatatacttcctggtatcagcagaagtcaggccagtcccctgtgctggtcatctatcaagatgccaagcggcctcgacggntccctgagcgattctctggctccaactctgggaactcgacgccactctcgaccatcgacgcggaacccnggctagtcggatggaggtcgtagtacctagttacgtggtaccgagggtcgttagggactaggccgaggccgaccgtcggccccgtcgttaaccgtcgggttcccttaccggggtaacgttaccggggaacccgtaaaccgggtcccgtaaccccggttacccttaaacgggtcccaaccggtaaccccccgg

SEQ ID NO: 182915 - DNA, 548 bp, Homo sapiens
  misc_feature: GYAE6OF01CCF6B.13.76.G10.1.454.CMB.1.raw
  modified_base (418)..(418): a, c, t, g, unknown or other
  misc_feature (418)..(418): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtctcttttattatagtagtggtagtacatactccgcagactccgtggacggggccgattcaccatcctccagacgacaattcccaaagaacncgcttgtttcctacaaatgaacagccctgacgagccgatcgaccgtacggccgtntattacgngtgcgagagagtcggggacccaacggtaacgttacacgctagtcggacgtcgtggggccaaacgggg

SEQ ID NO: 182916 - DNA, 531 bp, Homo sapiens
  misc_feature: GYAE6OF01CC9YB.13.76.G10.1.454.CMB.1.raw
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (436)..(436): a, c, t, g, unknown or other
  misc_feature (436)..(436): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtcgggtccgccgaggcctaccgagggaacggggctggacgtgcgtcttcgttttatttatagttagtggttagtacatactcgcagactcgtgagggccatcacatctcaganacatccaaagacacgtctgttctanaaatnaacngctagagagccgatcgaccacggcctgtattactggtgcgaagcgaggtcgggacccaagtaccgttacacgtctagtggactggtgggaacccg

SEQ ID NO: 182917 - DNA, 742 bp, Homo sapiens
  misc_feature: GYAE6OF01EFLKZ.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagcgtcgggtcccgccgagggcctccggaagggggaacgggggctgggaggtcggtccgttctttctttttaatttagttaggttagttggtagtacattactccgcagtaccgtccggtaggacggggtacccattccaacctacgttaccctaccgaagaagaacctaaacgttacccgaaaagaaccctacgtactttacgttttacccttaacaaaacgttacggaaacctacggtacccgtaggaaacggtaccggacccggtaagtaccggaaccgtacccggggtccgttaggtttaactttaccgttggtcggtacggaaggtacggacggttacccggggggaaccccctaagggtaaaacccggtttaccgtaaccggtaccgttaagggttaccggggacccgtttaccgggtaccggggggtaaccccgaaacggggggtaacccccg

SEQ ID NO: 182918 - DNA, 536 bp, Homo sapiens
  misc_feature: GYAE6OF01A6GST.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaagggctggagtgcgtctcttttattatagtagtggtagtacatactccgcagactccgtgaggggccattcaccatctccagagacaattccaagaacacgctgtttctacaaatcgaaactagcctagagacgccgatcgacacgggccgtgtacttactgtgcgagagagtcggggacccaggaacgttacacgtctagtggaccgtgcggggccgaagggacccg

SEQ ID NO: 182919 - DNA, 544 bp, Homo sapiens
  misc_feature: GYAE6OF01BMFVN.13.76.G10.1.454.CMB.1.raw
  modified_base (146)..(146): a, c, t, g, unknown or other
  misc_feature (146)..(146): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (186)..(187): a, c, t, g, unknown or other
  misc_feature (186)..(187): n is a, c, g, or t
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (298)..(298): a, c, t, g, unknown or other
  misc_feature (298)..(298): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagcggngttcgtctaggcgcttaaagtgcantgngtncatngnganngggngctgaagcggggtcctgactcnctgtgcanctctgatncttnagtgacgcctgatganggtcgcngcncaggagggngtgngtgngtgtagtatagtagngntgngngaggacgacgacgacgtcgcgtcgcgacgacgacgacgagactacactactactacgacgacgtagtacgtagtaacgaacgaacgtacgtagttacgttacgtacgtacgtaacgacgaacgtacgacgtacgacgtacggaccggaccgtacgtacgtacgtacgtacgtcgtcgtcgtaccgtacgcgacgacgtccgtaccgtacgtacgttacttactttagtttacgttcgtcggtacgg

SEQ ID NO: 182920 - DNA, 570 bp, Homo sapiens
  misc_feature: GYAE6OF01DOXLS.13.76.G10.1.454.CMB.1.raw
  modified_base (169)..(169): a, c, t, g, unknown or other
  misc_feature (169)..(169): n is a, c, g, or t
  modified_base (489)..(489): a, c, t, g, unknown or other
  misc_feature (489)..(489): n is a, c, g, or t
tcagtcacgtactacacgaccggtgctcgatttagtcactcatacaggggctgggcctcaggaagcagcatcggaggtgcctcagccatggcatggatccctctcttcctcggctccttgcttactgcacaggatccgtggcctctatgagctgactcagcccaccctnagtcgtccgtcgtccccaggaccagacagccagcatcacctgcttcaggaaataatggacaagtaataaatatacttctaggtatcagcagaagtcaaggccagtcccctgtgcgtcgttcatctagtacaagctgcccaagcccgccctagacgggactccctgaacgcgtattcctcgtggacctaccgtaaacgtcgtacggaactccgaacgccctacgtcctacgacctaacgtccgaacggacccgggaacccaggtactaaggttcgaagtgacgggcctagactattacgtcgtacgacgggcgtacgggancgacagctacgtcgcccgtatagtcgttactacgggtacgtcggaaccacggtcctaccgtacaagtccaacggaaccccg

SEQ ID NO: 182921 - DNA, 564 bp, Homo sapiens
  misc_feature: GYAE6OF01B9FVL.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcaggccagtcccctgtcgctggtcatctatcaagatgaccaagccggccctcgacgggactcccgtgacgcgtattcctctcggcctaccaactcgtagggaacctcgacgccacttctacgaccatccgacgccgggacccaggtctagtggatggacggtctaggtaacttagttacgtgtacgagggtcgtagggacagccagccacgtcgcccgtatacgtcggtaccgttacgggaaccgtcgggaaccctaacgggttcccaacccggttaccctaaacggtccgaacggtaaccccccg

SEQ ID NO: 182922 - DNA, 525 bp, Homo sapiens
  misc_feature: GYAE6OF01AUYWY.13.76.G10.1.454.CMB.1.raw
  modified_base (291)..(291): a, c, t, g, unknown or other
  misc_feature (291)..(291): n is a, c, g, or t
  modified_base (364)..(364): a, c, t, g, unknown or other
  misc_feature (364)..(364): n is a, c, g, or t
  modified_base (366)..(366): a, c, t, g, unknown or other
  misc_feature (366)..(366): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgagggaagggctggagtgcgtctcttttattatagtagtggtatacatactccgcagactccgngngggccattcacntcncagagacaatccaagaacacgctgtttctacaaatgaacagcctgagacgccgatgacacgggtccgtagtacttactgtgcgagagagtcggggcccaggaacgttacacgctagtcggacgtcgcggggccaaggggacccg

SEQ ID NO: 182923 - DNA, 522 bp, Homo sapiens
  misc_feature: GYAE6OF01EGS0W.13.76.G10.1.454.CMB.1.raw
  modified_base (237)..(237): a, c, t, g, unknown or other
  misc_feature (237)..(237): n is a, c, g, or t
  modified_base (441)..(441): a, c, t, g, unknown or other
  misc_feature (441)..(441): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccagtccccctgtgctggtcatctatcaagatgccaagcggccctcacgggactccctgagcgattctcgtggctccaactctggaactcagccactctgaccatcagcggaccaggctagtggatgaggctgacttattactgtcaggcggtgggacagcgagcacgtcgcccgtntacgtcgttcgttacgggaacgtcggggaccgaaacgggttccaacccggttacctaaacggttccgaacggtaacccccg

SEQ ID NO: 182924 - DNA, 526 bp, Homo sapiens
  misc_feature: GYAE6OF01BUN60.13.76.G10.1.454.CMB.1.raw
  modified_base (512)..(512): a, c, t, g, unknown or other
  misc_feature (512)..(512): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaagggctggagtgcgtctcttttatttatagtagtggtagtacatactccgcagactccgtgacggggccattcaccatctccagagacaattccaaagacacgctgtttctcaaatgaacagcctgagagccgatcgacacggtccgtgtattacgtgtgcgagagagtcggggcccagaacgttacacgctagtcggactcgngggccagggacccg

SEQ ID NO: 182925 - DNA, 578 bp, Homo sapiens
  misc_feature: GYAE6OF01AX33T.13.76.G10.1.454.CMB.1.raw
  modified_base (437)..(437): a, c, t, g, unknown or other
  misc_feature (437)..(437): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaacgggcgtggagtcgcgttcttcttttattatagtagtggtatacatactcgcagactcgtggacgggcctattcaccatcctcagagacaacttccaaagacacgtcttgtttactacaaatgaaccngcctagagcgccgatacgaccgacggtccgttgttaacttacgtggtaggcgaaggtaggacggtcggggcccctaaggtaacgttaccgaacgtctaggtcgggaaccgttcggggcgggaacccggaagggtaccccgg

SEQ ID NO: 182926 - DNA, 549 bp, Homo sapiens
  misc_feature: GYAE6OF01BFO44.13.76.G10.1.454.CMB.1.raw
tcagtcacgtactacacgaccggtgctcgatttagtcactcatacaggggctgggcctcaggaagcagcatcggaggtgcctcagccgtggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcgagggactcccgtgagcgattctctggctccaactctgggactcagccatctgaccatccagccggacccaggctagtggatggaggtctgactattacgtcgtcgaggcggtagggactacgcagccacgtcggacccgtctacgttcggtccgttacgggaacggtcggggtaacccgaaacgggttccctaacccggttacccttaaacggtcctaaccgggacccctaaaccccggg

SEQ ID NO: 182927 - DNA, 609 bp, Homo sapiens
  misc_feature: GYAE6OF01D868I.13.76.G10.1.454.CMB.1.raw
  modified_base (323)..(323): a, c, t, g, unknown or other
  misc_feature (323)..(323): n is a, c, g, or t
  modified_base (352)..(352): a, c, t, g, unknown or other
  misc_feature (352)..(352): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
  modified_base (418)..(418): a, c, t, g, unknown or other
  misc_feature (418)..(418): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgtagctatttaaagtgccagtgtgaggtgcagctggtggagtctggaggaggcttgatccagccgtggggggtccctgagactctcctgtgcagcctctgggttcaccgtcagtcacacctacatgagctgggcccgcaggctaccgaggggaggggctggagtcgcttcttnttttaattataggtagtggtatcattacnccgnagctccggtgacggggcctattcacccatcnccaagaacgacaaattcccgaaagaaacccncgtcttcgtttactanaaagtcgaacncgtcgtagagcgtaccgtatacggacgtacggtcgttattaacgttacgtggtacggacgtaaggacggtaggtccggggacccctaacgggttaacgttaaccgtacgtacttaacggttccgggaaaccgttgggtaaccggggacgaaccggggtaacccg

SEQ ID NO: 182928 - DNA, 619 bp, Homo sapiens
  misc_feature: GYAE6OF01BS8ZU.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtgggaggaggcttgatccagccgtgggggtcctgagactctcctgtgcagcctcgtgggttcaccgtcagtcacacctacatgagcgtcgggtccgccgacggccgtccgaggggaacggggcgtgggagtcgtcgttctttcttttatttagtagttagtggtagtacatactccgcacgctcggtggacgggcacttcaccatctccagacgactaacttaccaaagaacacgtcttacgtttactacaaatcgaacagcctaggacgacgaccgatcggaccgacggtccgtagttacttacgtggtcgacgaggtacgaacggtccggggaaccctaacgggtaacctttaccgacgtacgttacggtacgggtacgttacgggtacggggaacccgaaacggggtaccccg

SEQ ID NO: 182929 - DNA, 615 bp, Homo sapiens
  misc_feature: GYAE6OF01CQNTG.13.76.G10.1.454.CMB.1.raw
  modified_base (370)..(370): a, c, t, g, unknown or other
  misc_feature (370)..(370): n is a, c, g, or t
  modified_base (459)..(459): a, c, t, g, unknown or other
  misc_feature (459)..(459): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacatctacatgagcgtgggtcccgccgaggcctccgaggggaacggggctgggagtcgcgttcttcttttattatagtagtggtatacatactccgnacgactccgtggacgggcctattccacctatcctaccgagacgaactaattacccaaagaaccacgtcttgtttcctacaaatcgaacncgtcctagacgacgaccgatacggaaccgtcggtccgttagttaacttactggtcgacggaggagacggtccgggggacccctaacggtaaaccgttaaccgtacgtaccgttaagtcgggtaccgttccggtacgggggacccgtaaaccggggg

SEQ ID NO: 182930 - DNA, 563 bp, Homo sapiens
  misc_feature: GYAE6OF01BUH7C.13.76.G10.1.454.CMB.1.raw
  modified_base (365)..(365): a, c, t, g, unknown or other
  misc_feature (365)..(365): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccaggcctccgaaggggaggggcgtggagtgcgtcttcttttattatagtagtgtagtacatactcgnacgactcggtggacggggcctatcacctatctcagacacaattaccaagaacacgtcttcgtttctacaaatcgaactacgcctagagacgtacgagtcgacgacggtccgttagtacttacgtgtagcgaagcgagtcggggaccctacgtaacgttacgtacgctagtcggacgtgtcggggccaacgggtacccg

SEQ ID NO: 182931 - DNA, 629 bp, Homo sapiens
  misc_feature: GYAE6OF01APMW7.13.76.G10.1.454.CMB.1.raw
  modified_base (447)..(447): a, c, t, g, unknown or other
  misc_feature (447)..(447): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagctgggtccgccaggctccgagggagggctggagtgcgtctcttttattatagtagtggtagtacatactccgcagactccggtgacggggcctagttccaccatcctccagacgaactaattaccaaagaaccacgtcttgtttaccttacaaattcgaacngtacctggagacgaccgatcggaacgaccgggtcccgttagttaacgtttactggttacgcgaggaacgtacggttccgggggaccccctaagggtaaacccggtttaccgtaaccggtaccgttaagttaccggggaaccggtttccgggtcgggggaaccccgaaagggggtaacccccg

SEQ ID NO: 182932 - DNA, 705 bp, Homo sapiens
  misc_feature: GYAE6OF01COY3Z.13.76.G10.1.454.CMB.1.raw
tcagtcacgtactacacgaccggtgctcgatttagtcactcatacaggggacccaaaaaccacacccctccttgggagaatcccctagatcacagctcctcaccatggactggacctggagcattccttttcttggtggcagcagcaacaggtgcccactcccaggttcagctggtgcagtctgcagctgaggtgaagaagccgtggggcctcagtgaagatctcctgcaaggcttctggttacacctttagcagctatcttatcagctgggtgcgacacggcccctggacgacggactcggaggtggagtgggatggatcagcccttaacgaaacggaaacacgaagactagtcgggaacaacggaaccctcgagggcctaaggtactttaccgaacctagtacggaaccgacgaacggaaccaacaactaaccgaaaccgaaacctaaccgaacggaccctaacgagtacgggaaggtaggaacggacgtaccgtaggaagtaagttaacgtacggaaccggtaaccgaaccgggaccctaaagttaacttaacgtttaaccgtaggttacggaccggtaagggtaaacggggtttaaccggggtttttaggggggacccgggtccgggttaacccgttcccgtttaccggttacgggtaacggtacggttaccggtcggggggtacccgggtaaacgggggg

SEQ ID NO: 182933 - DNA, 524 bp, Homo sapiens
  misc_feature: GYAE6OF01A75NY.13.76.G10.1.454.CMB.1.raw
  modified_base (386)..(386): a, c, t, g, unknown or other
  misc_feature (386)..(386): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctctgggttcaccgtcagtcacacctacatgagctgggtccgccaggctccgagggaaggggctggagtgcgtctcttttatttatagtagtggtagtacattactcgcagactcgtgaggggccattcaccntctcagagacaattccaagaacacgctgtttcttacaaatgaacagcctgagagcgatgacacggcgtgtattactgtcgcgagagagtcgggcccacggtaacgttactaccgnttacgnggacgtcgtggggaccg

SEQ ID NO: 182934 - DNA, 670 bp, Homo sapiens
  misc_feature: GYAE6OF01CSJT2.13.76.G10.1.454.CMB.1.raw
  modified_base (374)..(374): a, c, t, g, unknown or other
  misc_feature (374)..(374): n is a, c, g, or t
  modified_base (648)..(648): a, c, t, g, unknown or other
  misc_feature (648)..(648): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcacagtgtgaggtgcagctggtggagtcgtggaggaggcttgatccagccgtggggggtccctgagactctcctgtgcagcctctgggttccaccgtcagtcaacacctacagtgacgcgtgggtcccgccgaggcctccggaggggaacgggctagggagtggccgttcttacgtttttattagtagtaggtggtacgtanattacctccgacagaccttccggtggacggggcctattccaaccgtattcctacccaaggacgaacctaacttacccgaaagtaacccgacgtcgtttacgtttttacctaacgtaaaatcgaaacacgtcccgtagaacggacgaccgagttccggaaccgtaccgggtcccttagttaacttacggtgtcgtaccgaggaagtacggtcggggaacccccaaggttaaacccgtttaccgaccggtactacggtacggtaccggttaccggngggggaacccgtaaacccgggg

SEQ ID NO: 182935 - DNA, 535 bp, Homo sapiens
  misc_feature: GYAE6OF01CXOXM.13.76.G10.1.454.CMB.1.raw
  modified_base (456)..(456): a, c, t, g, unknown or other
  misc_feature (456)..(456): n is a, c, g, or t
  modified_base (526)..(526): a, c, t, g, unknown or other
  misc_feature (526)..(526): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaggggctgggaggtgggtaggtttcagttaggagctaattctcatgagtgggaacaacgagaatacgccgcgtacgtagtaaaaggcaagtattacacctatctacaaagagtatagaacgtccaagaagcagtccgtcctttcngcagatgagtacgccgtagaacgaccgagaccacacgccatcgtattactgtgcgtagagtagtattgcngtccgtacg

SEQ ID NO: 182936 - DNA, 657 bp, Homo sapiens
  misc_feature: GYAE6OF01ES4G6.13.76.G10.1.454.CMB.1.raw
  modified_base (126)..(126): a, c, t, g, unknown or other
  misc_feature (126)..(126): n is a, c, g, or t
  modified_base (236)..(236): a, c, t, g, unknown or other
  misc_feature (236)..(236): n is a, c, g, or t
  modified_base (313)..(313): a, c, t, g, unknown or other
  misc_feature (313)..(313): n is a, c, g, or t
tcagtcacgtactacacgaccggtgctcgatttagtcactcatacaggggggggctgagcccttctctggaaaccacacagctcctcctgcagcagcccctgactgctgatttgcatcacgggccnctctttccagcaaggggataagagagggcctgggaagaaccctgcccagcctgggcctcaggaagcagcatcggagtgcctcagccatggcatggactccctctcttccncggtcgttccttgctttactgcaacaggaactcccgtaggcctcctagtgacgcttcgacctccacgtcccaccctnacgtcgtcccgtacgtccccaggacagaccacgcccagcagtcacctgctcgtaaggaaattaaagttcggactaagaattaaatcttaacttccaggttactcagtacgaagtaacgtcgacggccctaaccggttccctttagtccgtacgttacggtactacttaccgttaataccgtaaacggtacgttcggaaccccgttaaacggcccgggtaacccttacggaacggggtaccttacccgaggtaaccgtccggttaattttcccgacgttaccggacccttaccccgaaacgtttccgggaacgggttaaacccttcctaacggtccctaacccgg

SEQ ID NO: 182937 - DNA, 698 bp, Homo sapiens
  misc_feature: GYAE6OF01DF6TS.13.76.G10.1.454.CMB.1.raw
  modified_base (200)..(200): a, c, t, g, unknown or other
  misc_feature (200)..(200): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (281)..(281): a, c, t, g, unknown or other
  misc_feature (281)..(281): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcggtggtttcgtcgtaggcgtattaaagtgccagtgtgagtgcagcgtggtggagtntggaggaggcttgatccgagtccgtgggggtccctgagctctccgtgcgcncgctcgtggtacaccgtnaatcacacctanagtgcgtcgtcggccgcgacggcgtacggaggggacggtgtggtagtcgtacgttcttttagttttaagtttagtaggttaggttacgttaacgtactacgtaccgtaccggtacgtaccggtaccgttaccgggtagggaccggtacctacgttacccacgttactacccgtaaccgaagtaacgaaccgttaaactaccgaaacgtaaccgtacgttccgtttactttaacttaacgaaacgtacgaacgtacgtacggtaaggacgaacgtaccgtagtacggaccgtaccggttacgttagttacgttcgtacggtacggacggtaacggtacggtacgggaacccgggtaaccttaacggttaaccgttacgtacgtacggttacggtccggacggtcgggtaccgggaacg

SEQ ID NO: 182938 - DNA, 683 bp, Homo sapiens
  misc_feature: GYAE6OF01D0JHA.13.76.G10.1.454.CMB.1.raw
  modified_base (352)..(352): a, c, t, g, unknown or other
  misc_feature (352)..(352): n is a, c, g, or t
  modified_base (556)..(556): a, c, t, g, unknown or other
  misc_feature (556)..(556): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgactccgaggccggtcgggggtccctgagacctctcctgtgcacgtcctcgtggttccaccgtcacgtcaccacctacatcgagtcgtcgggtccgccgaggcctccggaggggagggcgtggagtcgcgttntttacttttattatagtagtggtatacatactcgctacgacgtcgtggacgggtcctataccactactctaccgaagaacactaactacccgaaagaacctacgtcttcggttttaacctaactaaaacgttcgaaaccgcgtacccgtggaacgcggaccgtagtacggaacgtacccgggttacgttagttaactttaccgnggtacggacgaaggtggtaacgggtcccggggtaaccctaaaggttaaccgtttaaccacggtacgttacggtacgggtaccgtaccggggtaccggggtaaaccccgaaacggggttaacccccgg

SEQ ID NO: 182939 - DNA, 743 bp, Homo sapiens
  misc_feature: GYAE6OF01E10XY.13.76.G10.1.454.CMB.1.raw
tcagtcacgtactacacgaccggtgctcgatttagtcactcatacaggggtctggggagaggagcccagcactgggattccgaggtgtttccattcggtgatcagcactgaacacagaggactcaccatggtagtttggctgagtcgttggttttccttgttgtcttaattttaaaaggtcgccctagtgtgaggtgcgagcgtggtggtagtcgtgggaggaggtcttgactccgacgccggtcgggggtccctgacgtacctcctccgtgtcgcacgtcctcgtcggttccaccgtcagtccacctacctacatgacgtcgtcgggtcccgccgtacggtccgtacggaaggggtacgggtcgtgggtagtcggtcgttccgttttacttttaagtttagtaggttaggttacggttagttaactacgttaacccgtccgactaacggtaccgttccgggtagggtaccggggtacctacttacccgaacctacgttccgtaacccgaaaggtaacctaaccttaaaccgttaaccccgaaaaagtaccctaccggttacctttacgtttttactaacgtaaaagttccgaaactacggtccaggtaacgccgtaccgtaagccggtaaccgaccgggttcttaagtacgttacgtggtacgacggaagacggtcgggtacccggaaccctaggtaacccttacgacgtcgtacgtacggtcgtcgggtccgggaaacccg

SEQ ID NO: 182940 - DNA, 697 bp, Homo sapiens
  misc_feature: GYAE6OF01DPMNR.13.76.G10.1.454.CMB.1.raw
  modified_base (288)..(288): a, c, t, g, unknown or other
  misc_feature (288)..(288): n is a, c, g, or t
  modified_base (586)..(586): a, c, t, g, unknown or other
  misc_feature (586)..(586): n is a, c, g, or t
tcagtcacgtactacacgaccggtgctcgatttagtcactcatacaggggctgggcctcaggaagcagcatcggaggtgcctcagccatggcatggactccctctcttcctcggcgtccttgcttactgcacaggtactccgtggccttctatgacgtctgacctcacgccctacctcgagtcgtccgtcgcccgaggacagacacgccagcatccacctgacttacgtaaggtaaacttaagtcggataataaacttaaacttacttaccttcgtaggtactacgancgaagactcgacgtccacgtcccgtggtcgtcgtcgtaactacgtactactaacgaacgtctaccgaccgaaccggtcccgtacccgtagggaaccggtccttccgacggtacgtcgttacttccggtacgtccggaccctaaccgttacgtaccggtacgtaactccgaccgtaccttcgtaccgtacgaacctcggtacgggacccggtaccgggcctaagggtctagggtcgtaggtcggtacttacgtctaacgtttacgtggtcgaggaccgggtggaacggactcgcgaacnccgtacgtcccgttacgtaattcgggtaccgttacgggaaaccgtcggggtaaaccgaccgttcccggaaccgtacccgtaaaccgtaccgccggaaccccgtaaacccgg

SEQ ID NO: 182941 - DNA, 485 bp, Homo sapiens
  misc_feature: GYAE6OF01BD9LC.13.76.G10.1.454.CMB.1.raw
  modified_base (320)..(320): a, c, t, g, unknown or other
  misc_feature (320)..(320): n is a, c, g, or t
  modified_base (437)..(437): a, c, t, g, unknown or other
  misc_feature (437)..(437): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggcctcgagggatcccngagcgattctctggctccaactctggaactcacgccactctcgaccatcagcggaccaggctagtggatgaggctgactattactgtacgaggcgtgggacagcagcactcgcccgntagtgtctacggactcgggaccagtcaccgtctaacgtcgacgacccg

SEQ ID NO: 182942 - DNA, 562 bp, Homo sapiens
  misc_feature: GYAE6OF01DGQI9.13.76.G10.1.454.CMB.1.raw
  modified_base (451)..(451): a, c, t, g, unknown or other
  misc_feature (451)..(451): n is a, c, g, or t
  modified_base (493)..(493): a, c, t, g, unknown or other
  misc_feature (493)..(493): n is a, c, g, or t
  modified_base (548)..(548): a, c, t, g, unknown or other
  misc_feature (548)..(548): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggtccgccgaggctccgaggggaaggggcgtgggagtgcgtcttcttttattatagtagtgtagtacatactccgcagactccgtggaggggccgattcaccatctaccagacgaacctaattacccaaagaacacgtcttgttttctacaaattcgaacngcctagacgagccgatacgacgacggtccgtgttacttacgngtcgacgagagacgtcgggacccaaggtaccgttacacgctagtcggacgtcggnggggccaaacgggg

SEQ ID NO: 182943 - DNA, 680 bp, Homo sapiens
  misc_feature: GYAE6OF01D60XZ.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatcacctgctctaggaaataatggacagataaatatactctgtatcagcagagtcaggccacgtcccctgtcgcgtggtcatctatacaagtatcgacctaagcccggtaccctacgacgggtacctcccgtagacggtcgtacttccgtcgtcggtcctaccgaacgtcgtacggaacctcgacgtcccactccgtacgacctacgtaccgacgggacccggaaccgtaggtaccttaggtcggtagtacggacggtcttacggtaccttagttacgtcggtaccgtacgggtcgggtacggaccgtaacggcgaaccgtccgtaccgtccgggtaccccgtagttaccggttccggttacccgttaacccggggtaaacggttacccggggaaaccccgttaaccggggttaccccgttaaaccccgggttaacccgtaaaccgggttacccgaaccccggtaaaccccccggg

SEQ ID NO: 182944 - DNA, 796 bp, Homo sapiens
  misc_feature: GYAE6OF01D2OFO.13.76.G10.1.454.CMB.1.raw
tcagtcacgtactacacgaccggtgctcgatttagtcactcatacaggggcgtggggcctcaggaagcagcatcggaggtgcctcagccatggcatggatccctctcttcctcgcgtccttgcttactgcacaggatccgtggcctcctatgagctgactcacgccaccctcagtcgtccgtgtccccaggacagacagccagcatcacctgctctaggaaataatggacaagataaatatacttactagtatcagacagagtcgacgccagtccctgtcgtctaggtacatctatacaagactcgacgaacgccgacccgtcgacggactccgtcgactacgggggtacttcgtacgtcggccgtaccgtaaccgtaccgtacgggtaaccgtaccgtaaccgtaccctaaccgttaccgtaccgtaacccgtaacgtacccggtaaccggtacccgggaaccccggaacggtaccgtaacggtacgggtaacgtacgggtaacgggttaccgttacggttaaccgtttaacgtttaaccgttacgggttaccggtaacggggtaccgggttaacggggtaaccggtaacggtaccggtaaccgggtaaccggtaaccgggttacccgggtaccccggtaccggttaaccggtttaccgggtttacccggtttaacccggggttaaacccgggttaaccggggtaaaccccgggtaaacccgggttacccggtaaacccccgggttaacccggttaaacccggttaccccggtaaccccggtaaacccccccggg

SEQ ID NO: 182945 - DNA, 522 bp, Homo sapiens
  misc_feature: GYAE6OF01DOC5H.13.76.G10.1.454.CMB.1.raw
tcagtcacgtactacacgaccggtgctcgatttagtcactcatacaggggtctgggagaggagcccagcactgggattccgaggtgtttccattcggcgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtctcttttattatagtagtggtagtacatactccgcagactccgtgaggggccattcaccatctccagagacaattccaagaacacgctgtttctacaaatgaacagcctgagacgccgatcgacacgggctagtattacgtgtgcgagagacgtggggcccagaacgttacacgtctatggactcgtgggaccg

SEQ ID NO: 182946 - DNA, 532 bp, Homo sapiens
  misc_feature: GYAE6OF01CE8P4.13.76.G10.1.454.CMB.1.raw
  modified_base (353)..(353): a, c, t, g, unknown or other
  misc_feature (353)..(353): n is a, c, g, or t
  modified_base (393)..(393): a, c, t, g, unknown or other
  misc_feature (393)..(393): n is a, c, g, or t
  modified_base (515)..(515): a, c, t, g, unknown or other
  misc_feature (515)..(515): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccgccaggcctccgagggaggggctggagtgcgtctcttttattatagtagtggtagtanatactcgcagactcgtgacggggccattcacatctcaganacaataccaagacacgcttagtttctacaaatgaacagcctgagacgcgatgacgacggtccgtgtacttactgtgcgagagagtcgggacccacgaacgttcgacgctagtcggacgtcgnggggccgaagggacccg

SEQ ID NO: 182947 - DNA, 708 bp, Homo sapiens
  misc_feature: GYAE6OF01E48FD.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatactcctggtatcagcagaagtcaggccacgtcccctgtgctgtcatctatacaagactcgaccgaacgcccggccctacgacgggacctcccgtaggacgtccgtactttccgtccgtcggtacccttacccgtaaaccgtccggtacggggtaacccttcgaaccgtaccctaccgtccgtacgaacccctaacgtacccggaacgggtacccggggaacccccgtagggtaccgttaaggtgggtaacgttcgggtaaccggtaccgttaacggttaaccgtttaacgtttaccgtcgggttaccgaacgggggtccggtacggggaactacggaccgacgccgtacgtcccggtacccgtacgttacgttccggttaccggttaaccgggaaacggttaccgggaaacccgtaaccgggtacccgtaacccggtaacccgttaacgtaccgacccggtaaacccccgg

SEQ ID NO: 182948 - DNA, 639 bp, Homo sapiens
  misc_feature: GYAE6OF01COPAK.13.76.G10.1.454.CMB.1.raw
  modified_base (296)..(296): a, c, t, g, unknown or other
  misc_feature (296)..(296): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggacagataaatatacttcctggtatcagcagaagtcaggccagtcccctgtgctggtcatctatacaagntgaccaagccggccctcgaggactccctagacgcgtattctcgtcggcctaccgaactcgtagggacctcgacgccactctacgaccatccgacggccgggaacccacggtactacgtagggacgtcggacgtaccgtaggtaaccttagtttacgtcgtaccggtaagggtaccgttggggaaacctacgggaccacggacccgtaccgttcggacccccgtagttacggttaccggttaccgtttaccggggaaaccggtttaccggggaaacccgtaaacgggttacccgtaaccccggtttaccgtaaaccggttacccgaacccggtaaaccccccgg

SEQ ID NO: 182949 - DNA, 780 bp, Homo sapiens
  misc_feature: GYAE6OF01CO62P.13.76.G10.1.454.CMB.1.raw
tcagtcacgtactacacgaccggtgctcgatttagtcactcatacaggggtcgttggggcctcaggaagcagcatcggaggtgcctcagccatggccatggatccctctcttcctcggcgtccttgcttactgcacaggatccgtggcctcctatgagctgactcagccaccctcagtgtccgtgtccccaggacagacagccagcatcactgctctggaataattggcagataaatatacttcctggtatcagcagaagtcaggccagtccccctgtcgctggtcatctatcaagatcgaccaaggccggccctcgacgggactcccgtagacgtccgatttccgtcgttcgggccttacccgaacgttccgtacgggggtaaaccttccggaacggtacccctaacgtttccctacggtaaccccctaagttaccccgaaacgggtcccggggaaacccccgacggggtacccttaacgggtacggggaacgttacgggaacgggtacccgtttaaggtaacccgttttaacgtttaccgtttacggttaccggtaagggggttacccggttagggggaacctaacgggtacccgtacggtaccccgtaacccgttccggggacccccggttacgttaccggttaccgggtttacccgggtttaacccggggtaaacccgggtttaccggggggtaaaaccccgttaacggggttaaccccgtaaccccgggttaacccgttaaacgggttccccgaaacccggtaaacccccccggg

SEQ ID NO: 182950 - DNA, 643 bp, Homo sapiens
  misc_feature: GYAE6OF01B80Y8.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtccctgagactctcctgtgcagcctctgggttcaccgtcagtcacacctacatgagcgtgggtcccgccgaggcctaccgaggggaaggggctgggagtgcgtcttcttttattatagtagtggtatacatactccgacagacctcccggtggacggggccctattccaaccgtacttccgtccaaggaacgaacctaactttacccgaaagaaaccctaccggtctttacgttttaccttaccaaaattcgaaacacgtcccgtagacgaacgcccgaatccggaaccgtaccgggacccgttgtaacgtttacgtggtacgcggaagaggtacggtcggggacccctaacggtaaacgtttaccgacgtacgttagtcggacgttacggcggggacccgaaggggtaccccg

SEQ ID NO: 182951 - DNA, 566 bp, Homo sapiens
  misc_feature: GYAE6OF01DZY4F.13.76.G10.1.454.CMB.1.raw
  modified_base (385)..(385): a, c, t, g, unknown or other
  misc_feature (385)..(385): n is a, c, g, or t
  modified_base (436)..(436): a, c, t, g, unknown or other
  misc_feature (436)..(436): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggaggggctggagtgcgtcttcttttatttatagtagtggtagtacatactcgcagactccgtgaggggccattcacntctcagagacaattccaaagaacacgcttgtttccttacaaattcgaaacngccctgagacgccgaatcgaacaccgggtccgttagttattacgtgtagacgagagagtcgggggacccaacggtaacgttactacgcttaagtcgggaacgttgtacggggcccgtaaaggggaccccg

SEQ ID NO: 182952 - DNA, 700 bp, Homo sapiens
  misc_feature: GYAE6OF01D4RF3.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagcgttgggttttccttgttgcttattttaaaaggtgcccagtgtgaggtgcagctggtggagtcgtggaggaggcttgactccgagccggtcggggggtccctgagactctcctgtgcagcctcgtcgggttcaccgtcagtccacacctacatgagcgtcgggtcccgccgaggcctaccggagggggaacggggctagggagtcggccgttctttactttttattagtaggttagtaggtacgtaactactacctccgacacgtaccgtccggtaggacggggtcctattccgacctactcctaccgagtaacgaactaacgttaccaaacgtaaccacgtcttcgttttacctaacaaatgaaaccacgcccgtagaacgacgaccgagtacggaccgtaccgggtaccgttagttaactttacgtggttcggacggtaaggtacggtacggtacccgggggacccctaaacgggttaacccggtttaaccgaccggtacgttaggtaccgggtaccggttaccgggtacgggggacccgtaaacgggggtaccccg

SEQ ID NO: 182953 - DNA, 530 bp, Homo sapiens
  misc_feature: GYAE6OF01EKVEX.13.76.G10.1.454.CMB.1.raw
  modified_base (331)..(331): a, c, t, g, unknown or other
  misc_feature (331)..(331): n is a, c, g, or t
  modified_base (423)..(423): a, c, t, g, unknown or other
  misc_feature (423)..(423): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcagccagtcccctgtgcgtggtcatctatcaagatgcaagcggccctcgagggactcccgtgacgcgattcnctggctcaactcgtacggaactcgacgccactctcgaaccatcgacgtccggacccagggacctagtcggatggagcgtagtactattacgngtacaggtcgtggacagcgacgcgacctcgcccgtatcgtcgttacgttacggaacgttcgggaacctaacggtcctaaccgttacaacggttcgacggaacccccg

SEQ ID NO: 182954 - DNA, 608 bp, Homo sapiens
  misc_feature: GYAE6OF01CN1CE.13.76.G10.1.454.CMB.1.raw
  modified_base (169)..(169): a, c, t, g, unknown or other
  misc_feature (169)..(169): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctggaaataatggacagataatatacttctgtatcagcagaagtcaggccagtcccctgtcgcgtggtctagtctatacaagatcgaccaaggccggccctcgaacgggtctcccgtggacgcgtattcctcgtcggccttaccgaactcgtagggaacctcacgccactctacgaccatacgacggaccgggaccagggctacgtaggacgtaggacgtcgtacgtacttattacgtgtcgaacgggtccggtagggactacgcgaacgcgtaaccgtcggaccccgtagttaccgtcggtttccgtttaccggggaaacgttcgggggaaccctaaacgggttccctaaccgggttaccgtaaacgttccgaaacccggaccccgtaaaccccggg

SEQ ID NO: 182955 - DNA, 617 bp, Homo sapiens
  misc_feature: GYAE6OF01C7KOE.13.76.G10.1.454.CMB.1.raw
  modified_base (173)..(173): a, c, t, g, unknown or other
  misc_feature (173)..(173): n is a, c, g, or t
  modified_base (195)..(195): a, c, t, g, unknown or other
  misc_feature (195)..(195): n is a, c, g, or t
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (307)..(307): a, c, t, g, unknown or other
  misc_feature (307)..(307): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtagcgtattaaaggtgccngtgtgaggtgcagcgtggtggngtgtggaaggcggtcttgatccgagccggtgggggtcctgacgctctccgtgcgcnggccttcgtggtccaccgtntcgacacacctaantcgctcgtcggccgcgacggcnccggagggtaggcgtggactggccttnttnttttagtagtagtagtggtatactaancgtcgagaacgctccggtaggcgggactcgtaccacttctaccgcgaagaactataacctacaaacggtacaacgttcttacgttactaacttaanacgtacacgtcgtagacgtcgacgtacggtacgtaccgtacgttacgttagtacgtcgtggtacgtacgaggtacggtcgggtacccggtaaccgtaacggttaccgtacgttaacgtacgttacggtcgggtaccgtcggggtaaccgggaaccgg

SEQ ID NO: 182956 - DNA, 897 bp, Homo sapiens
  misc_feature: GYAE6OF01CO8EC.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagtttggctgagctgggttttccttgttgctagttttaaaggtgcccagtgtgaggtgcagctggtggagtcgtggaggaggcttgactccgagccggtcggggggtccctggacgtaccgtcctccgttggtcgcacggtccttcgtgggttccacccggtctacggtccaacctaacccttaacacgtcggaaggtccggttcggggtccccgccgtaacgggtcccttacccggaagggggtaacggggtccgtaggggtaggtcggtccggttacttttaccgtttttaatttagttaagggttaggttagggttaacgtaaccgtaacgttacccgtacccggtacgtaacggtaacccgttcccgggtagggtaaccgggggtcccctaaggtttacccaaaccctacgtacccgtacccgaaaggtaaccgtaaaccttaaaccgtttaacccgaaaacgtaaacccgtaacccgtacgtttaacggttttacccttaacgtaaaacgttacgaaaccgtaaccgtacccgtaaggaacgtaaccgggtacccgtaagttacggaacccggtaccggggttacccgttaggtttaactttaaccgggtcgggttaacgggaccggtaaacgggtacgggtaccggttacccggggggaaaccccctaaccgggttaaaacccgtttaccggtaaccggtacgttaacggtccggggtaacggttaccgggtaccgggggaacccgtaacggggtaacccccggg

SEQ ID NO: 182957 - DNA, 592 bp, Homo sapiens
  misc_feature: GYAE6OF01CD5RG.13.76.G10.1.454.CMB.1.raw
  modified_base (490)..(490): a, c, t, g, unknown or other
  misc_feature (490)..(490): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggcctccgagggaagggctggagtgcgtctcttttattatagtagtggtagtacatactccgcagctcggtgacgggctattcaccatctccagacgacaacttaccaaagaacctacgcttacgtttacttacaaattgaaacgtacgcctaggaacgacgccgatacgaccgaccggtcgtagtacttacgngtggcgaggacgtaggtaccggggaccctaagttaaccggttacaccggtacttaagtccgggtaacgtccggtacgggggaacccgaaggggtaaccccgg

SEQ ID NO: 182958 - DNA, 602 bp, Homo sapiens
  misc_feature: GYAE6OF01E1MQZ.13.76.G10.1.454.CMB.1.raw
  modified_base (307)..(307): a, c, t, g, unknown or other
  misc_feature (307)..(307): n is a, c, g, or t
  modified_base (372)..(372): a, c, t, g, unknown or other
  misc_feature (372)..(372): n is a, c, g, or t
  modified_base (407)..(407): a, c, t, g, unknown or other
  misc_feature (407)..(407): n is a, c, g, or t
  modified_base (474)..(474): a, c, t, g, unknown or other
  misc_feature (474)..(474): n is a, c, g, or t
  modified_base (480)..(480): a, c, t, g, unknown or other
  misc_feature (480)..(480): n is a, c, g, or t
  modified_base (518)..(518): a, c, t, g, unknown or other
  misc_feature (518)..(518): n is a, c, g, or t
  modified_base (560)..(560): a, c, t, g, unknown or other
  misc_feature (560)..(560): n is a, c, g, or t
tcagtcacgtactacacgaccggtgctcgatttagtcactcatacagggggggagagggagcccagcactgggattccgaggtgtttccattcggtggatcagcactgaacacagaggactcaccatggagtttttggctcgagcggtcggtttcgtgtagctactttaaaaggtgcccagtgtgaggtgacagctggtggagtctggaggaggcttgatccaggcctggggggtccctggacactctcctgtgcaggtcctgtgggttcaccgttcagtcacaccgtacagtcgagctgggtcccnccaggctccaggggacgggctggatggcttaccttgttttattactagtgtaggtatacattacnccggcaagctccggtggaggggcccattccaactntcctaccagacgtaacccaattcccgaaacgaacacggcgttagttttccacaaaaggttcaaaacngtcccngaaccgtgccatagaccgtacgggccttataattcggngtgagagacggcggtccgggaccctaaggtaaccgttcacgnttacggtcgggaccgttagggccggggaaccaacggggaccc

SEQ ID NO: 182959 - DNA, 644 bp, Homo sapiens
  misc_feature: GYAE6OF01BEMA0.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataatatactcctggtatcagcagaagtcaggccagtcccctgtgctggtcatctatacaagatcgaccaacggccggtaccctcgacggactcccgtgacgcgattctcgtcggtcctcccaacgttccgtacgggtaacctcgacgacccaccttccgtacgacctacgtaccgacgggacccgggaacccacgggccgttacgtagggtagtacggtacggaccttacgtaacgttacgtttacgtcgtaccggagggtacgggtacgggaccaggaccgtagacccgtaccgtcgacccccggtagttacgtccgggtttacgttacccgggtaaccgtaccggggaaccctaacggggttaccctaccccgggttaaccttaaccggacccgacccgggtaaacccccgg

SEQ ID NO: 182960 - DNA, 597 bp, Homo sapiens
  misc_feature: GYAE6OF01CTJ8S.13.76.G10.1.454.CMB.1.raw
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctacatgagcgtcgggtccgccgaggcctaccgaggggaggggcgtggagtgtcgtcttcttttattagtagtagtgtagtacatacctccgnacgactccggnggacggggccgtacttccaccatcctaccgagagtaccaaacttacccaaagaaccacgtcttcgtttacttacaaatcgaacagcctagacgacgccgagtacgaccgacgggtcctagttacttacgtgtacgcgaaggtgtacggtcggggacccctaacgggtaaccgttaccgacgtacgtagtcgggaacgttcgggcggggaacccgg

SEQ ID NO: 182961 - DNA, 671 bp, Homo sapiens
  misc_feature: GYAE6OF01EAJS2.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtcgtggaggaggcttgatccagccgtgggggtccctgacgactctcctgtgcagcctcgtcggtcaccgtcagtcacacctacatgagcgtcgggtccgcgaggcctccgaggggaacgggctgggagtcgtcgttcttcttttaatttagtagttaggtggtagtactagtacctcgctacgaccgtccggtaggacggggaccgtacttccaaccgtactccgtaccgaagaacgaacctaagttacccaaagtaaccgaccgtcctttaggttttaccttaacgtaaaacgttcgaaacctaggtacccttaggaacggaacgacccgtaagtacggtacccgaaccgggttccgttaggtactttaccgtggttacggacgtaggacgtaacggttcggggacccctaaggtaaaccgttaacgaccggtactacggtagggtaccggtggtccgggggtaaacccgg

SEQ ID NO: 182962 - DNA, 850 bp, Homo sapiens
  misc_feature: GYAE6OF01AHWAJ.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctctgggttcaccgtcagtcacacctacatgagcgtggggtcccncccgagggtcctccggaggggaacgggggcgtaggggaggtcggtccggttcctttcttttttaatttaagttacggttaaggttagggttaacgttaactaagttaacccgtcccgaccgtaacgtaacccgttccgggtagggacggggggtaccccgtaagtttcccaacccgtactttcccttacccgaaggaacgtaacccttaaacgtttaacccccgaaaacggtaaaccctaaccggttccctttacggttttttaacccttaacgtaaaaacgttacggaaacccgtacggtacccgtaagggaacggaaccggtacccggtaacgtaccggaacccggtaccggggtacccgtttaaggtttaacttttaccggttaggttagggttaggaacgggtacgggtaacgggtacccggggggtaaccccctaaacggggttaaaaccccggttttacgtaaacccgggttccttaaacggttccgggggtaaccggttacccgggtaccggggggtaaccccggtaaacgggggtaaccccccgg

SEQ ID NO: 182963 - DNA, 657 bp, Homo sapiens
  misc_feature: GYAE6OF01D6Z4W.13.76.G10.1.454.CMB.1.raw
  modified_base (380)..(380): a, c, t, g, unknown or other
  misc_feature (380)..(380): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttagaaggtgcccagtgtgaggtgcagctggtggagtcgtggaggaggcttgatccagccgtggggggtccctgagactctcctgtcgcagtcctcgtggttcaccgtcagtcacacctacatgagcgtcgggtccgccgagggcctccggaaggggacggggcgtggagtgcgtcttacttttattataggttagtggtagtactatactccganacgacgtccggtggacggggccgtattaccacctactcctaccaagacgaactaacttaccaaacgaacaccgtacttcgttttcttacaaatacgaaactacgccgtgaacggacgaccgaagtcggaaccgtaccgggccgttaggttaactttaccgttaggtcgacggaggaacggtacgggtaccgggggacccccgaaaccggttaaaccggtttaaaccgttaccggtaacgttaaggttaccgggtaccggttccgggtaaccgggggg

SEQ ID NO: 182964 - DNA, 537 bp, Homo sapiens
  misc_feature: GYAE6OF01BP2AS.13.76.G10.1.454.CMB.1.raw
  modified_base (481)..(481): a, c, t, g, unknown or other
  misc_feature (481)..(481): n is a, c, g, or t
  modified_base (491)..(491): a, c, t, g, unknown or other
  misc_feature (491)..(491): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggacagataaatatacttctgtatcagcagaagtcacggccacgtcccctgtgcgtggtcactctatcaagactcgaccaacggccggcccctacggacgggactcccgaggacgcgtacttctcgtcggtcctaccaacgtcgtacggaacctcgacgtcctactcgtacgaccactcgacggaccggacccaggtctagtggagtagacgtctacgtactattcgcgtacgaggtcgtaggaccagacagaccncgtcgccgtntagtcgttctacggacgtcggacacgtcacgtacacgcgcgacccg

SEQ ID NO: 182965 - DNA, 613 bp, Homo sapiens
  misc_feature: GYAE6OF01CF163.13.76.G10.1.454.CMB.1.raw
  modified_base (295)..(295): a, c, t, g, unknown or other
  misc_feature (295)..(295): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctctgggttcaccgtcagtcacacctacatgagctgggtccnccaggcctccgaggggacgggctggagtgcgtcttcttttattatagttagtggtagtacatacgtcgcagactccgtggacgggggcctattccaccctatcctccgaagacgaacctaattacccaaagaacctacgtccttagttttaccttacaaattcgaaacctacgccgttaggaacggacgccgtaatcggaaccgaccgggtccgttagttacgttacgtggtacggacgaggagacggtcggggacccctaacggaaccgtttacgacgtctagtcggtacgtaggtcggggaccgaagggtaccccg

SEQ ID NO: 182966 - DNA, 608 bp, Homo sapiens
  misc_feature: GYAE6OF01DOJJM.13.76.G10.1.454.CMB.1.raw
  modified_base (443)..(443): a, c, t, g, unknown or other
  misc_feature (443)..(443): n is a, c, g, or t
  modified_base (528)..(528): a, c, t, g, unknown or other
  misc_feature (528)..(528): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcacgcctcgtgggtcaccgtcagtcacacctacatgacgcgtggggtcccgccgaggcctaccggagggggaaggggccgtgggaggtgccgttctttctttttattagtagttaggtggtagtacatacctccgcagactccggtggacggggcctattcaccgatcctaccagacgactaacttccaaagaacncgtacttgtttaccttacaaatgaaccagtcctagagagcgatcggacaccgggtcgtagttacttacgtgtacggcgagacggngtaccggggaccccaaggttaaacgttacctaccgattagtccgggacgttcgggacggggacccgaaaggggtaccccg

SEQ ID NO: 182967 - DNA, 611 bp, Homo sapiens
  misc_feature: GYAE6OF01BLRYO.13.76.G10.1.454.CMB.1.raw
  modified_base (449)..(449): a, c, t, g, unknown or other
  misc_feature (449)..(449): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggcctccgaggggaacgggctggagtgcgtctcttttattatagtagtgtagtacatactccgcagctccggtggacggggccattccacctatcctccagagacctaattaccaagaaccacgtcttgtttaccttacaaattcgaaacncgcctaggagacgccgatcggaacgtaccgggtccgttagtacttacgtggtcgcggaaggagtacggtaccgggggacccctaacgggtaaaccgttaccgtaccggtacttacggtacgggtacggttccggtacgggggacccgtaaacggggaccccg

SEQ ID NO: 182968 - DNA, 583 bp, Homo sapiens
  misc_feature: GYAE6OF01DGNMR.13.76.G10.1.454.CMB.1.raw
  modified_base (404)..(404): a, c, t, g, unknown or other
  misc_feature (404)..(404): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgcaggctccgaggggaggggctggagtgcgtcttcttttattatagtagtggtagtacatactccgcagactccgtgaggggcattcacatctcagagacaattccaaanacacgcttcgtttctacaaatcgaacagcctgagacgccgaagtgaaccgaccgggtaccgttgttaactttacgtggtggaccgtaagacggaggtcggggaccccaaggtaaaccgtttacgaaccgtcgttaagtcgggaacgttcggtacgggggccgtaaacgggggaaccccg

SEQ ID NO: 182969 - DNA, 696 bp, Homo sapiens
  misc_feature: GYAE6OF01A5Q17.13.76.G10.1.454.CMB.1.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaactaagttggacagataaatactaacttcctaggtatcgagcaagaagtcaggcctacgtcccctgtcgctggtcactctatcaagntcgacaacgccggccctgacggactccgngacgtcgtattcgtcgtcggtcctaccgaacttcggtacgggtaacctccgacgtaccctaccgttccgtacgaaccctacgtaccgaccggggtacccgggaaccctagggtaccctaggtcgggtacgtacgggtacgtcgtaacgtaccgttaacgtttaccgtaggtaccgaacggggtccggttacggggaccgtacggtacgtaccggtacctaccggtcccgacccggtaccgttagttcccgggttcggttaacccgggaacccggttacggggaacccccgttaacgggttaccccgtaaccccggtttaccggtaaaccgtaccccggtaaacggacccccgtaaaccccggg

SEQ ID NO: 182970 - DNA, 733 bp, Homo sapiens
  misc_feature: GYAE6OF01CR31Z.13.76.G10.1.454.CMB.1.raw
  modified_base (350)..(350): a, c, t, g, unknown or other
  misc_feature (350)..(350): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtggaggaggcttgatcagccgtgggggtccctgagactctccgtgtgcagcctctggttcaccgtcagtcacactacatgagctgggtccgccaggcctccgaggggacgggctggagtgcgtcttcttttattatagtagtgtacgtanatactccgcagtaccgtccggtaggacgggggtaccctagtttccgacctaagtcccttaccgaacgaacgtaactaaacttaccgaaacgaaacctaccggtactttacgtttaccttaacgaaaagtttagaaaacctacggtaccccgtaggaaacggaaccggacccggtaaacgtacggtaacccggaaccggggttcccggtttagttaaacgttttacccggtagggtcggtaccgggaacgggtaagggtaaccggttaccgggggaaccccgtaaacggtaaaccccggtttaacgttaccccggaacgttaacgggtaccggggtaccggttaccggtaaccggggggacccgaaaacgggggtaacccccgg

SEQ ID NO: 182971 - DNA, 665 bp, Homo sapiens
  misc_feature: GYAE6OF01B8SQU.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacacgccagcatcacctgctctaggtaaattaagttggacaagattaaatacttactttccgtaggtatcgagacgtaagaagtcgacggtcctacgtcccctgtcgtcgtggtcacttcgtatacaagtctacgaccgaacggtcccgaccccgttacgacgggttacctcccgtaggacgtaccggtactttcgtcccgtacggtccctaacgtaccgtcggtacggaacctcgaaccgtccctaccgtctaccgtacacgtaccgaccggtaccggacccgtaggtctaaggtcgagtcgacgtcgtaatacgttacgtcgtgtacggacggtacggtcggtaacgcggacacgtaccacgtccggtacccgtacgttcgtcgttacccggttacggaacccggtacggtaacccgtaaccgggtcctacccggttaacgtacggtaccccgacgtaaacccccgg

SEQ ID NO: 182972 - DNA, 615 bp, Homo sapiens
  misc_feature: GYAE6OF01AUI5L.13.76.G10.1.454.CMB.1.raw
  modified_base (295)..(295): a, c, t, g, unknown or other
  misc_feature (295)..(295): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaggtgcccagtgtgaggtgcagctggtggagtctggaggaggcttgatccagccgtgggggtccctgagactctcctgtgcacgcctcgtggttccaccgtcacgtcacacctacatgagctgggtccnccgaggcctaccgaggggacggggctgggagtcgcgttcttctttttatttatagttaggtggttagtacatacctcgcagctccgtggacggggccattcacctatctaccagtacgaactaacttacccaaagaaaccctacggtccttaggttttaccctaacgaaattacggaacctaggtacccctgggaacgacgccgtatcggaactccggggccttagtacttacgtgtcgacgtaggacgtacgtcggggacccctaaggaacgtttcaacgtctaacgtggacgttcggcggggacccaaggggaccccg

SEQ ID NO: 182973 - DNA, 529 bp, Homo sapiens
  misc_feature: GYAE6OF01A6631.13.76.G10.1.454.CMB.1.raw
  modified_base (235)..(235): a, c, t, g, unknown or other
  misc_feature (235)..(235): n is a, c, g, or t
  modified_base (450)..(450): a, c, t, g, unknown or other
  misc_feature (450)..(450): n is a, c, g, or t
  modified_base (469)..(469): a, c, t, g, unknown or other
  misc_feature (469)..(469): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatntacttcctggtatcagcagaagtcaggccacgtcccctgtgctggtcatctatcaagatgaccaagccggccctcgacgggactcccgtgacgcgtattctctggcctccaacgtcgtagggaacctcacgcccactctacgaccatccgacggccggacccgaggacctagtggatggacggtctgtacttacttactgtcgaggtcgtggacngacacgcacgtcgcccgtntagtcgtcgttacggacgtcggaacctacggtccacccgtacctaacgtcgacgaccccg

SEQ ID NO: 182974 - DNA, 562 bp, Homo sapiens
  misc_feature: GYAE6OF01EVC27.13.76.G10.1.454.CMB.1.raw
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (474)..(474): a, c, t, g, unknown or other
  misc_feature (474)..(474): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcacgcctcgtgggttcaccgtcagtcacacctacatgacgctgggtcccgccgaggctcccgaggggaacgggcgtgggagtggcgtcttcttttatttatagtagtggtagtacatactcgcagacctcggtggacggggcctattccacctatcctcagacgactaataccaagaacacgcttgtttactacaaatcgaaacngtcctagacgcnccgatcgacncgggtcttagtattcgtgtgcgagagtagtcggggacccaggtaaccgtacacgctagcggtacgtcgcggggaccaaggggtacccg

SEQ ID NO: 182975 - DNA, 759 bp, Homo sapiens
  misc_feature: GYAE6OF01CI0BR.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagaataatatacttcctggtatcagcagaagtcaggccagtcccctgtgctggtcagtctatcaagatgaccaagcggccctcgacgggactccccgtgaacgcgtaactttcctactcgggtaccttacccaaaccgttcgtacggggaaacctttccgacggacccctaacgttcccttacggaacccctaacgttacccgaaccggggtacccggggaacccccgaaggggtacccgttaacggtacgggtaacgttacgggaacgggtccgttaacggtaaaccgttttaacgtttaaccggttcggttaccgaacgggggttaccgggttaacggggaccgtaacgggccgaaacggtccgtaaaaccgtcccgggtacccccggtacgtttaacggttccggtttaacccggtttacggggtaaaacccggttccgggggtaaacccgtaaaccggggttaccccgtaaccccggttaaccgtttaaccggtacccggaaacccggtcccccggtaaaaacccccggg

SEQ ID NO: 182976 - DNA, 601 bp, Homo sapiens
  misc_feature: GYAE6OF01A9I8D.13.76.G10.1.454.CMB.1.raw
  modified_base (170)..(170): a, c, t, g, unknown or other
  misc_feature (170)..(170): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (177)..(179): a, c, t, g, unknown or other
  misc_feature (177)..(179): n is a, c, g, or t
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (194)..(194): a, c, t, g, unknown or other
  misc_feature (194)..(194): n is a, c, g, or t
  modified_base (200)..(200): a, c, t, g, unknown or other
  misc_feature (200)..(200): n is a, c, g, or t
  modified_base (242)..(242): a, c, t, g, unknown or other
  misc_feature (242)..(242): n is a, c, g, or t
  modified_base (273)..(273): a, c, t, g, unknown or other
  misc_feature (273)..(273): n is a, c, g, or t
  modified_base (515)..(515): a, c, t, g, unknown or other
  misc_feature (515)..(515): n is a, c, g, or t
  modified_base (526)..(526): a, c, t, g, unknown or other
  misc_feature (526)..(526): n is a, c, g, or t
  modified_base (568)..(568): a, c, t, g, unknown or other
  misc_feature (568)..(568): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcggtcgttcgtgtaggcgtattaaagtgcngtngngnnngntgngntngngngntgatcngcgtggggcctgagctctctgtgcagcctgtggttcaccgtnacgtcacacctacatgacgcgtcgggtaccnccgaggccgtaccggaagggggaggcgtggagtcggtcgttcttcttttattagtagtaggtaggtagtaccagttacctccggacacgtaccgttccggtaggacggggtccctacttccgaaccctatccgtaccaaggactaacctaacgttacccaaagaacccacggttctttcgtttacctaacgaaattcggaaacctcgacctgggaactagccgagtacgaacgcgggtcctnttaactcgtgngacgtagaggacgtccgggaaccctagtaaacgtcgtaccgngtagtccgggatcgggtcgggacgaagggtccc

SEQ ID NO: 182977 - DNA, 714 bp, Homo sapiens
  misc_feature: GYAE6OF01BNIRI.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcaggttggtggagtctgggaggaggcgttggtcccgagggcccgggggggtccctggagacctcgtcatggtgccggtcctcgtgggctcaccgtcaacaccaactacatgagctgggtcccgccaggcctccgagggaagcgggccggaggtgggtctcgtagttatttagtgtcgacggtcgccgaactattctacgcgagtaccgtccgtgggacggggtcccgtttacaccctagtctcccgaagaacgactaaacttaccgaaacgtaaaccgtacggttagttacttaccgttacaaacgtacgtaaaccgacccgttaggaagacggtacgggaacgggaaccgacccgggtacccgttacgttaacgttaccgttggttacgaacggtaaagtagttacggacggaacggaacgggtacccggggtacccccggttaagggtccgggggtaccgttgggggttacgggttacggggttttccgtttcgtttacggaccgttgggtcggtaccgggggg

SEQ ID NO: 182978 - DNA, 679 bp, Homo sapiens
  misc_feature: GYAE6OF01DVEPR.13.76.G10.1.454.CMB.1.raw
  modified_base (370)..(370): a, c, t, g, unknown or other
  misc_feature (370)..(370): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctttgcagcctctgggttcaccgtcagtcacacctacatgagctcgggtcccgccgaggctccgaggggaaggggctgggagtgcgttcttcttttattatagtagtggtagtacatactccgnagtactccggtggacggggcctattccaccatcctaccaagacgaactaattaccaaagaacacgtcttgtttacttacaaattcgaaacacgtcccgttaggaacgacggacccgtaagttacggaacccgtaccggggtaccgtttagttaacgtttaccgtggttacgggaccggtaaggacggtacgggtacccggggggaccccctaaacgggttaaacccggttaaacccgttaaccggaccgtttaacggtaccggggtaaccggtttccgggtacggggggaccccgtaaaacccgggggg

SEQ ID NO: 182979 - DNA, 580 bp, Homo sapiens
  misc_feature: GYAE6OF01EIN1C.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtcccgccgaggcctccgagggggaacggggcgtgggagtgcgttcttcttttattatagtagtggtagtacatactccgcagactccgtggaggggccgattcaccatcctccagacgacaattccaaagaacacgcttgtttctacaaattgaacagcctgagagccgatcgacgacgggtccgttagttacttacgtgtgcgaaggagacgtcgggggacccctaaggtaaccgttcaccggctaagtcgggaaccgttcgtcgggggacccaaacgggggtacccg

SEQ ID NO: 182980 - DNA, 581 bp, Homo sapiens
  misc_feature: GYAE6OF01B2B6J.13.76.G10.1.454.CMB.1.raw
  modified_base (362)..(362): a, c, t, g, unknown or other
  misc_feature (362)..(362): n is a, c, g, or t
  modified_base (451)..(451): a, c, t, g, unknown or other
  misc_feature (451)..(451): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggcctccgaggggaacggggctggagtgcgtcttcttttattatagtagtggtagtacattacnccgcagacctccggtggacggggcctattccacctatcctccagacgacaacttaccaaagaacacgtcttgtttcttacaaatgaacngacctgacgacgccgatcgaccgaccggccgttagttacttactggtgacggagaggacggtcggggacccaacggtaaccgtttacgacgtacgttagtcgggacgtcggtcggggacccgaaacgggg

SEQ ID NO: 182981 - DNA, 690 bp, Homo sapiens
  misc_feature: GYAE6OF01CXQKB.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggccgtccttgcttactgcacaggatccgtggcctcctatgacgctgactcacgcccaccctcgagtcgtccgtcgtccccaggacagacacgccagcactccactgctcgtaaggaaataagtcggacaagtaataatattacttcctaggtatacagacagaactcgaggtacccacgttcccctgtcgtcgtacggtctagttcaataccgaaggtactcgacccgaacggccggtacctacgacgggtacctccgagacgtcgtacttctacgtcgactaccgtacgtacggtacggaactccacgtccctacgtccgtaacgaccacgtaccgaccgggacccggaaccgtaggtaccgtaggtacggtacggtacggaccgttcgttacgtaacgttacgtttacgtcggtacgggtacgggttcgggaacgggtaccgacggacccgtacgtcccgtacgtaccccggaccgttaacgttggtaacccggtttaccggtacgggtaaccggtaccgggtaaccgaccggttaccgtacccggtataacccggccgaacccggtaaaccccgg

SEQ ID NO: 182982 - DNA, 563 bp, Homo sapiens
  misc_feature: GYAE6OF01EKBPX.13.76.G10.1.454.CMB.1.raw
  modified_base (374)..(374): a, c, t, g, unknown or other
  misc_feature (374)..(374): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggccgtccgaggggaacggggctgggagtgcgttcttcttttattatagtagtggtatacatactcgcagactcgngacggggccattcactatcctccagacgaacaacttaccaaagaacacgtcttgtttactacaaattgaaacagcctgagacgcgatcgacacgggtccgtgttattactgtcgacgagacgagtcggggacccaacggtaacgttacacgtctagtcggacgttcggacggggccgaaggggtacccg

SEQ ID NO: 182983 - DNA, 577 bp, Homo sapiens
  misc_feature: GYAE6OF01CG8TO.13.76.G10.1.454.CMB.1.raw
  modified_base (430)..(430): a, c, t, g, unknown or other
  misc_feature (430)..(430): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctccgaggggaggggctgggaggtgggtggccgtaagttaaaggtagaagacagtggtacgacaacagactacagtcgttcccgtagaaaggcagtattcacttatcgtacaagagatagaactaanaaaagtaaatagaatattactctagaacaaatagaaacaaccgtaagaaagcgaagacacgaggtcgtagtacttacgtacgtaccaacgaggtacgtacgggacgagatagactaaaggtacggccgacggacgtaggtaacccgg

SEQ ID NO: 182984 - DNA, 874 bp, Homo sapiens
  misc_feature: GYAE6OF01EC564.13.76.G10.1.454.CMB.1.raw
  modified_base (285)..(285): a, c, t, g, unknown or other
  misc_feature (285)..(285): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttcctgttgcttattttaaaaggtgccagtgtgaggtgcagctgggtggagtcgtgggaggaggcttgactccgaggccgtggggggtccctgagacctctccgtgtgcacgtccttcgtcggttccgacccgtntacgtccaaccacctacagtgagtccgtcgggtcccgccgacggtccgtaccggaggggaacgggcgtggacgttcggtcgtttccgtttactttttaagtttagttaggttaggttaggttaagttaacgtacgttaaccctcccggacgtaaccggtaccgttccgggtacgggaccggggtaccccttaagttacccaaccgttacttacccgtaccgaaggtaacgtaacccgtaaaactttacccgaaaaacggtaaacccgtaccggtttacttttaccggttttaacccgtttaaacctaaaacggttaccgaaaccgtacggttaccccggtagggaaacgggtccgtaacccggtaacggtaaccgggtaacccgttaaccccggggttactttaacggtttaaaccggtttagtaccgggttaccgggtaaccggtaaaaggtaccggggttaagggtacccccggggggttaaacctaaaccccggtttaaacgggtttaaccccgtaacggttaacccggttaacgggttaccggggtacccgggtttaccggggaaccgggggtaaacccccgggg

SEQ ID NO: 182985 - DNA, 649 bp, Homo sapiens
  misc_feature: GYAE6OF01DW902.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcaagaagtcaggccagtcccctgtgctggtcatctatacaagatcgaccaagccggccctacgacgggtactcccgtagacgcgtacttcgtcgtcggtacctcctaactcgtagggaacctcgacgccctactccgtacgacctagtccgacgggtacccggaacccgaggtcctaagtacgggtagtacggtacggtaccgtagtaacttacttaccgtgttaccggacgggtcggtacgggaacgacgacgtacgaccgtaccgcggtccccgtattacgtcggttacccggttacgggaaaccggttccggggaaacccgttaacgggtaccccgttaaacccgttacccggttaaacggttccccgaaccggtacccccgtaaaaccccggg

SEQ ID NO: 182986 - DNA, 772 bp, Homo sapiens
  misc_feature: GYAE6OF01ALQP0.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtggaggaggcttgatccagccgtggggggtcctggagactctcctgtgcacgcctcgtgggttcaccgtctacgtacgtaccacctacctactagtagacgtcggtccggtccgacggccgtccgacgggaggggacggtgggtaggtcgtcgtccgttcttttacgttttagttaacgttaggttaggttaggtactacgtaccgtccgtacgacgtacgtaccggtacgggtacggggccggtacgttaccgtaccctacgtacctaccgtacgaacggtaactaaccgttaaccgaacgaaacgtaaccgtcgttaccgttttacgttactaaaacgtaacgaacgaaaccggtcgtacgggtaagaacccggttaccggaacgttaccggtaaccggtaaccgggtccccggtttacggttaacgtttaccggttaccggttcgggaacgggtaaccgtagggtaaccgggttaccgggggaccccggtaaaccggtaaacccggttaacgttacccggtacggtacgttaacgggtccggggtaccggtacggggtaaccccgggg

SEQ ID NO: 182987 - DNA, 548 bp, Homo sapiens
  misc_feature: GYAE6OF01BNROO.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttctggtatcagcagaagtcaggccagtcccctgtgctggtcatctatcaagatgccaagccggccctcgacgggactccctgacgcgattctctcggcctccaactcgtacgggaactcgacgccctacgtctcgaccatcgacggccgggacccaggctagtggatgacggctgtaacttattactgtacgagggcggtagggacaggcgacgcacgtcgcccgtactacgtcgttcgttaccgggtaacgtcgggaaccctaacgggtacccacccggttacctaacgtccgacggtaacccccgg

SEQ ID NO: 182988 - DNA, 592 bp, Homo sapiens
  misc_feature: GYAE6OF01C9FXF.13.76.G10.1.454.CMB.1.raw
  modified_base (332)..(332): a, c, t, g, unknown or other
  misc_feature (332)..(332): n is a, c, g, or t
  modified_base (379)..(379): a, c, t, g, unknown or other
  misc_feature (379)..(379): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcaccacctacatgagctcgggtccgccgaggcctccgaggggaaggggcgtgggagtgcgtntttcttttattatagtaggtgtagtacatactccgcagacctccggnggacggggcctattcacctatctccaagtacgaacaattacccaaagaacctacgtacttgtttaccttacaaatcgaaaccagcctagaggacgcccgatcggaacctacgggtccgttagttactttatcggtagaccggagagagtcggggaccctaacgtaacgttaccacgtcctaagtcggacgtcggcggggccaaacgggacccg

SEQ ID NO: 182989 - DNA, 535 bp, Homo sapiens
  misc_feature: GYAE6OF01DWS9V.13.76.G10.1.454.CMB.1.raw
  modified_base (476)..(476): a, c, t, g, unknown or other
  misc_feature (476)..(476): n is a, c, g, or t
tcagtcacgtactacacgaccggtgctcgatttagtcactcatacagggggggagaggagcccagcactgggattccgaggtgtttccattcggtgatcagcactgaacacagagactcaccatggagttttggctgagctgggttttccttgttgctattttaaaaggtgcccagtgtgaggtgcagctggtggagtctggaggaggcttgatccagcctggggggtccctgagactctcctgtgcagcctctggttcaccgtcagtcacacctacatgagctgggtcccgcaggctccgagggaaggggctggagtgcgtcttcttttattatagtagtggtagtacatactcgcagactccgtgacggggccattcacatctccagagacaattccaaagaacacgcttagtttcttacaaatgaaacagcctagagagccgaatgacgacggtcgtgtattactgtgcgagngagtcgggacccaagtaacgttacacgctagtcggacgttcgtcgggccaagggacccg

SEQ ID NO: 182990 - DNA, 588 bp, Homo sapiens
  misc_feature: GYAE6OF01DZ71I.13.76.G10.1.454.CMB.1.raw
  modified_base (443)..(443): a, c, t, g, unknown or other
  misc_feature (443)..(443): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgaggggaaggggctggagtgcgttcttcttttattatagtagtggtagtacatactcgcagactccgtgacggggccagttcaccatctccagagacaattccaaagaacacgcttgtttccttacaaatcgaaacngcctggagacgccgatcgaacgaccgggtccgttagttacttacgtgtcgacggaagaggacgtcgggggacccctaacggaaccgtttaaccaacggtccttaaggtcggtaccgtcggtcgggggcctaaacgggggaccccg

SEQ ID NO: 182991 - DNA, 786 bp, Homo sapiens
  misc_feature: GYAE6OF01BLVNL.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggaggaggtcttgatccgaggccggtcggggggtcccgtggacgtaccttccgtccgtggtcgaccgtacgtccgttcggttcgggttcctaccggtccacgttaccaacctaaccctaacagtcggacgtccggttcgggtccccgccgacggtccgtaccggaggggaacgggcgtgggagtcgtcgttctttcgttttagttagtagttaggtaggtagtacactaccgtccgacgacgtccgtcggtggacgggtaccgtacttacgacctatcccgtacgaagaacgtaacctaactacccgaaaacgtaccgtaaccgttcgtttacgtttaccttaaacgtaaacgtaacgaaacctacggtacccgtaaggaacggtaaccgtaccgtacgtaccggaacccggtaacccgggttcccgtttaaaggttacgtttacggtacggtacggaccgggtaaagggtaaccgggtaccgggtacccgggtaacccccgtaaacgggttaaccgtttaaccgaccggttaacgttaggtacccgggtacgttccggggtaccggggaaacccgg

SEQ ID NO: 182992 - DNA, 648 bp, Homo sapiens
  misc_feature: GYAE6OF01EDMOJ.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataatggacagataaatatacttcctgtatcagcagagtcaggccagtcccctgtgctggtcatctatacaagatgccaagccggcctcgacggactcccgtgacgtcgtattctcgtcggcctaccgtaacctcgtacggaactccgacgtccctactccgtaccgacctaagtacccgaacgggaccgggaacccgtacgggtacttaagttcgggattacgggacggtcgtaacggttaacttacgttacgtggtaccggtagggtaccgtacgggacgacggtaccgacggaccgtaccgtcccggtacccgtacgttacgtcggtttacccgttaccgggtaaccgttacggggaaacccctaaacgggttacccccttaaccgggttaccctaaacggttcccgaacccggtaaacccccgg

SEQ ID NO: 182993 - DNA, 517 bp, Homo sapiens
  misc_feature: GYAE6OF01DBAR2.13.76.G10.1.454.CMB.1.raw
  modified_base (134)..(134): a, c, t, g, unknown or other
  misc_feature (134)..(134): n is a, c, g, or t
  modified_base (163)..(163): a, c, t, g, unknown or other
  misc_feature (163)..(163): n is a, c, g, or t
  modified_base (218)..(218): a, c, t, g, unknown or other
  misc_feature (218)..(218): n is a, c, g, or t
  modified_base (238)..(238): a, c, t, g, unknown or other
  misc_feature (238)..(238): n is a, c, g, or t
  modified_base (281)..(281): a, c, t, g, unknown or other
  misc_feature (281)..(281): n is a, c, g, or t
  modified_base (288)..(288): a, c, t, g, unknown or other
  misc_feature (288)..(288): n is a, c, g, or t
  modified_base (298)..(299): a, c, t, g, unknown or other
  misc_feature (298)..(299): n is a, c, g, or t
  modified_base (316)..(316): a, c, t, g, unknown or other
  misc_feature (316)..(316): n is a, c, g, or t
  modified_base (342)..(342): a, c, t, g, unknown or other
  misc_feature (342)..(342): n is a, c, g, or t
  modified_base (384)..(384): a, c, t, g, unknown or other
  misc_feature (384)..(384): n is a, c, g, or t
  modified_base (425)..(425): a, c, t, g, unknown or other
  misc_feature (425)..(425): n is a, c, g, or t
  modified_base (435)..(435): a, c, t, g, unknown or other
  misc_feature (435)..(435): n is a, c, g, or t
  modified_base (486)..(486): a, c, t, g, unknown or other
  misc_feature (486)..(486): n is a, c, g, or t
tcagtcacgtactacacgaccggtgctcgatttagtcactcatacaggggcgtggggcctcaggagcagcatcggaggtgcctcagccatggcatggatccctctcttcctcggcgtccttgcttactgacacnggatccgtggcctcctatgacgctgactnacgccacccttcagtgtccgtgtccccaggacagacagccagcatcacctgctcngaataattcggcagattaanagtacttcctggtatcagccagaagtcaggccagtcccctgtnctggtcntctagcaagnnggtccaagccgtccctnagggtactcccgtgacggtcatttcncgtcggccttaaccacttcagggtactcgacgcccaacttcnacctagccaggccggacctaggccttagtggactggacgtntgacttatangtcaggcgtggacaggcctaggcacgtcgcccgtgtactgtacctcgggancggtaccaggtccactcaattccacgacccc

SEQ ID NO: 182994 - DNA, 596 bp, Homo sapiens
  misc_feature: GYAE6OF01BXO1L.13.76.G10.1.454.CMB.1.raw
  modified_base (294)..(294): a, c, t, g, unknown or other
  misc_feature (294)..(294): n is a, c, g, or t
  modified_base (482)..(482): a, c, t, g, unknown or other
  misc_feature (482)..(482): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctggtgctggtcatctatcaagntgccaaggcggccctcgacgggactccctgacgcgtacttctcgtcggctaccctaactcgtaggggaaccttccgacgccctactccgtacgaacccactccgacggcccggggaaccccaggtcctagtcggagtggacggtctacgtacttattacgtgtccgtaagggcggtacgggacacgcncggaccaccgtccgcccgtacttacgtcggttaccgttccgggaaccggtacggggtaacccgtaacgggtccctaacccgggtaccgtaaccgtacggcccggaaacccccgg

SEQ ID NO: 182995 - DNA, 634 bp, Homo sapiens
  misc_feature: GYAE6OF01CPFZW.13.76.G10.1.454.CMB.1.raw
  modified_base (296)..(296): a, c, t, g, unknown or other
  misc_feature (296)..(296): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttcctgtatcagcagaagtcaggccagtcccctgtcgcctggtcatctatacaagntcgaccgaagccgacccgtcgacgggtactcccgtagacgtcgtacttcctcgtcggtcctaccctaaccgttcgtacggggtaaccttccgacgtccctaacttcccgtacgaacccctaacgttacccgaacgggacccgggaacccgaggtaccgtagtcgggtatacgggacggtactacggtaaccttagttacgttggtaccgtagggtaccggttacggggaacacgacgacgccgtacgtccgcccgtacgtaagttcggtaccgttacggacgtaccgggaacctacggtacccgtaccgttaccgtaacgtccgaacgtaacccccgg

SEQ ID NO: 182996 - DNA, 701 bp, Homo sapiens
  misc_feature: GYAE6OF01D5W84.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagcctggggggtccctgagactctcctgtgcagcctctgggttcaccgtcagtcacacctacatgagctgggtccnccgaggctccgaggggaacggggctggagtgcgttcttcttttattatagtagtggtagtacatactccgcacgacgtccggtggacggggccacgttccacctactcctaccgaagtacgaacctaacttaccgaaagtaacccacgtacttcggttttacctaacctaaaagttacgaaacctaggtccccgttaagggaacggtaaccggtacccggtaaagtaccggaaacccggtacccggggtacccgtttagggttaaaccttttaccgtggttaacggcggtaaggaaggtaccggtaccggggacccctaaacggttaaacggttaccctacgggtacttacggtacggggaaccggttccggttaccgggggggaaccctaagggggaaaccccccg

SEQ ID NO: 182997 - DNA, 562 bp, Homo sapiens
  misc_feature: GYAE6OF01CY39I.13.76.G10.1.454.CMB.1.raw
  modified_base (293)..(293): a, c, t, g, unknown or other
  misc_feature (293)..(293): n is a, c, g, or t
  modified_base (438)..(438): a, c, t, g, unknown or other
  misc_feature (438)..(438): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccncaggctccgaggggagggctggagtgcgtcttcttttattatagtagtggtagtacatactcgcagactccggtgacggggcctattcacctatcctaccagacgacaattccaaagaaccacgcttgtttcttacaaatgaacngcctgacgagccgatcgaccacgggtccgttagtacttacgtgtgcgtaagagaggtcggggacccaaggtaacgttcacgcttacgtcgggtacgtccggtcgggggcccaaggggtaacccg

SEQ ID NO: 182998 - DNA, 720 bp, Homo sapiens
  misc_feature: GYAE6OF01BGO8B.13.76.G10.1.454.CMB.1.raw
  modified_base (442)..(442): a, c, t, g, unknown or other
  misc_feature (442)..(442): n is a, c, g, or t
  modified_base (599)..(599): a, c, t, g, unknown or other
  misc_feature (599)..(599): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctaattttaaaggtgcccagtgtgaggtgcagctggtggagtctggaggaggcttgatccagccgtggggggtccctgagactctcctgtgcacgcctcgtgggttcaccgtcagtcaccacctacatcgagcgtgggtccgccaggcctccggaaggggaacgggcgtagggagtgtccgttctttactttttaagtttataggttaggttggtaacgtaactactaccgtccgacgagtaccgtccggtagggacggggtacccgtaacttccaaacccgtnttcccgtaccgaaggtaacgtaaccctaaactttaccccgaaaggaaaccctaaccggttcctttagttttactaaccaaaagttcgaaacctaggtcccgtagaagtaccgacccgtaagtacgaaccgaccgggtccgttagttaactttacggnggttcgacggtaaggtagtaccggttccggggaacccctaacgggtaaaccgtttaccgaacgtcggttaacgtccggggtacgttacgggtaccggggaacccggaaacggggtaccccg

SEQ ID NO: 182999 - DNA, 576 bp, Homo sapiens
  misc_feature: GYAE6OF01BHMQX.13.76.G10.1.454.CMB.1.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccnccaggcctccgaggggaggggctggagtgcgtcttcttttattatagtagtggtagtacatacnccgnagactcgtgaggggccattccacatcctcagagactaattaccaagacacgtcttgtttctacaatgaacagcctagagacgccgatcggacgacggtccgttagttacttacgtgtacgcggagagacggtcggggacccctaaggtaaccgttacctacttaccgtagtcgggaccgttacggacgggggacccgaacggggtaacccg

SEQ ID NO: 183000 - DNA, 653 bp, Homo sapiens
  misc_feature: GYAE6OF01B2TGJ.13.76.G10.1.454.CMB.1.raw
  modified_base (444)..(444): a, c, t, g, unknown or other
  misc_feature (444)..(444): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctcctgtgcagcctcgtgggttccaccgtcagtcacaccctacatgagcgtcgggtcccgccgaggcctccggaggggaacggggctgggagtcgcgttcttcttttattagtagtagtggtatacataccgtccgacagaccgtcggtggacggggcctatccaccactcctaccgagacgaacctaactacccgaaagtaaccncgtcttacgtttacctaacgtaaacgtgaaaccgtgcccgtaggaacgacggaccgatcggaccgtacgggtccgtagttacttccgtggtacgacggtaagcggtacggccggggtaccccaacgggttaacccgttacgacccggttactagggtacgggtacccggttacgggtaccggggaccccggtaaagggggtaacccccg

SEQ ID NO: 183001 - DNA, 562 bp, Homo sapiens
  misc_feature: GYAE6OF01ENUCE.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtcttcttttatttatagtagtggtagtacatactccgcagactccggtggacggggccgattcaccatcctccagacgaacaattaccaaagaacacgcttagtttcttacaaatgaacagcctgacgagcatacgacgacggtccgtgttacttcgtgtcgacgagagagtcggggaccctaaggtaacgttacgacgtctagtcggacgttacggcggggacccgaagggaacccg

SEQ ID NO: 183002 - DNA, 554 bp, Homo sapiens
  misc_feature: GYAE6OF01DHQDJ.13.76.G10.1.454.CMB.1.raw
  modified_base (172)..(172): a, c, t, g, unknown or other
  misc_feature (172)..(172): n is a, c, g, or t
  modified_base (201)..(201): a, c, t, g, unknown or other
  misc_feature (201)..(201): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggngcccagtgtgaggtgcagttggtggagtntgggaggaggcttgggtccaggccgggggggtccctgagactctcatgtgcggcctcgtgggctcaccgtcaacaccaaatacaatgagctgggtccgccaggctccgagggaagacggccggagtggtcagtagttatttangtcgacgtgccanatctacgcagactcgngacgggcgttcacatctaccagagacaactacaagaacacggtgtatctacaatagaacgactagacgagtacgagacgacgtcgtctattactgtagacgaaagatgacagacgacggtaccccgaagtcgggcgtgggtggtaggttcttcgttagacgtgcggtgggccgtaaccggg

SEQ ID NO: 183003 - DNA, 604 bp, Homo sapiens
  misc_feature: GYAE6OF01A1P5F.13.76.G10.1.454.CMB.1.raw
  modified_base (298)..(298): a, c, t, g, unknown or other
  misc_feature (298)..(298): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatccacctgctctaggaaataattggacagataaatactacttcctggtatcagcagagtcaggccacgtcccctgtcgctggtcatctatcaagntacgcctaaggccgtccctacgacgggtactcccgtagacgtcgtacttcctcgtcggaccttaccaacgtcgtaggacctacgacgtaccctacgtcgtacgacccagtaccgacggtaccgggacccaggtacctaggtcggaagtcggacggtcgtacgtacttacgttacgtcgtacgtacgggtcggtaacgggacgtacgacgacgccgtacgcgtccccgtagttacggtcgttacgtaccgggaccgtacgggaaccgtacgtaccgtaccgttacgtaccgtccgaccggtaccccg

SEQ ID NO: 183004 - DNA, 799 bp, Homo sapiens
  misc_feature: GYAE6OF01AN45A.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatcgccaagccggccctcgacgggactccccgtggacgcgtacttcgtcgtcgggcctccctaaactccgtaggggtaaaccctccgaacggtcccctaaccttccgtaccgaaccccgtaacgttcccgaaccgggtaccccgggggtaacccccgaacggggtacccttaacggttacggggaaacgtttacggggaaacgggttcccgttacgggttaacccgtttaaacgttttaacccgtttcgggttaacccggtaacgggggtcccggggtttaaccgggggaaacccgtaacgggtacccggtaacggtaccccgtaaccggttcccgggaccccccggttaacgtttaacggttccgggtttaaccccgtttaacccgggggtaaaccccgtttacccggggggaaaacccccgttaaaccggggttaaccccgtaacccccggggtttaaccccgttaaaacgggttcccccgtaaacccgggtaaaccccccccggg

SEQ ID NO: 183005 - DNA, 615 bp, Homo sapiens
  misc_feature: GYAE6OF01A2BI6.13.76.G10.1.454.CMB.1.raw
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctcgtagtacgttacctaccccagctggtaccaacacgaccccaggccaggcctccgcgcacgctcatcctacacacaacactcgctctcgtgggtccctcactcgcttctctggcctccattccgttagggaacaagctcgtcccttatcactccgaccggggcccagggcaagaagtagtagaactcgtagtaatttactttacgtgtttagtttactttagtagttgggttagtcgtaccttattttctcgttcgttggttggttacgggagggtacggacccgtacccgggtcgttccggacccggttcccgtaccgggtacccaacccggtccccggtaaacgggtcccgtacccggcccccgtacgttccccggg

SEQ ID NO: 183006 - DNA, 603 bp, Homo sapiens
  misc_feature: GYAE6OF01B4UI0.13.76.G10.1.454.CMB.1.raw
  modified_base (170)..(170): a, c, t, g, unknown or other
  misc_feature (170)..(170): n is a, c, g, or t
  modified_base (232)..(232): a, c, t, g, unknown or other
  misc_feature (232)..(232): n is a, c, g, or t
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (284)..(284): a, c, t, g, unknown or other
  misc_feature (284)..(284): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtcgtccgtgtccccaggacagacagccagcatcactgctcagaaataatgcagtataatntacttctgtatcancagagtcaggccacgtccctgngctgcatctatcaagntcgaccaaggccgcctagacggtactcccgtgacgtcgtattcctcgtcggtccctaccgtaactccgtagggtaaccctcgaccgacctacgttactaccggacctacgtccgacgggtacccggaaccgacggtaccgtaagtcgggaacgttcgggaaccgtcgttaacgtaacctttaacgttcggtaacggttcggacgggtcgggttaacgggaccgagcgacgtaccgtacgtacccgcccgttatacgttcgtacgtaccgggtactacgggactaacggtccctacgtacctacgtccgaccgtaacccg

SEQ ID NO: 183007 - DNA, 581 bp, Homo sapiens
  misc_feature: GYAE6OF01A2LEP.13.76.G10.1.454.CMB.1.raw
  modified_base (446)..(446): a, c, t, g, unknown or other
  misc_feature (446)..(446): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctcgtgggttcaccgtcagtcacacctacatgagcgtgggtccgccaggcctccgaggggaagggctgggagtgcgttcttcttttattatagtagtggtagtacatacctccgcagacctccggtggacggggccattccaccatcctaccagacgacaattaccaagaacacgtcttgtttctacaaatgaacngcctgagacgccgatacgaccgacggtccgtagttacttacgtgtacgcgagagaggtcggggaccctaaggtaaccgttacaccgtacgttacgtacgggaccgttacggcgggggaccgaacggggtaccccg

SEQ ID NO: 183008 - DNA, 613 bp, Homo sapiens
  misc_feature: GYAE6OF01DLIJ4.13.76.G10.1.454.CMB.1.raw
  modified_base (302)..(302): a, c, t, g, unknown or other
  misc_feature (302)..(302): n is a, c, g, or t
  modified_base (477)..(477): a, c, t, g, unknown or other
  misc_feature (477)..(477): n is a, c, g, or t
  modified_base (493)..(493): a, c, t, g, unknown or other
  misc_feature (493)..(493): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaaggtgcccagtgtgaggtgcagctggtggagtcgtggaggaggcttgatccgaggccgtggggggtccctggagactctcctgtgcagcctcgtgggttcaccgtcagtcacacctacatgagccgtcgggtccnccgaggcctccggaaggggacgggctagggagtcgccgttctttcttttaagtttagtagttagtggtagtacatacctcgacacgtacgtccggtggacggggtccagttccaaccatccacgtaagacgaactaacttaccaaagtaacacgtcttgtttactacaatgaacncgctagacgacgacgngacgccgaccggtcgttagtaatttacgtggacgcggaggacgtaggtccggggaccctaacggtaaccgttacgaccgtactaggtcggacggtccggacggggcgaacgggtaccccg

SEQ ID NO: 183009 - DNA, 620 bp, Homo sapiens
  misc_feature: GYAE6OF01DNM49.13.76.G10.1.454.CMB.1.raw
  modified_base (246)..(246): a, c, t, g, unknown or other
  misc_feature (246)..(246): n is a, c, g, or t
  modified_base (415)..(415): a, c, t, g, unknown or other
  misc_feature (415)..(415): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctctgtncagcctcgtggttcaccgtcacgtcacacctacatgagcgtcgggtccgccgaggcctacggagggaagtggcgtggagtcgtcgtttcttcgttttattagtagtagtggttagtactatactccgcaagtctcggtggacgggtccagttccactactctacaaganaactaacttccgaaagaaccgtcgtctttagtttacctaataaatcgaaactcgtaccgtagacgtacgccgaatcgaacgtcggacgttagttattacgtggtacgacgaagtacggacggtcccggggaacccaaacggttaccgttaaccgtacgcgttagggacgtacgggtaccgggtacggggtacccgaaaccggggg

SEQ ID NO: 183010 - DNA, 608 bp, Homo sapiens
  misc_feature: GYAE6OF01BAVBH.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccaggccgtccgaggggaggggctgggagtgcgtcttcttttattatagtgtggtagtacatactcgacagaccgtcggtggacggggcctattccaccgactcctaccagacgaactaacttacccgaaagaaccacgcttagtcctctaacaaatgaacacgcctagacgagccgatcgaccgcgggtaccttgttaacttacgtggtcgacggagacggtacggtcggggacccctaagggttaacccttaccgtacgtacgttacgtacgggtaccggttcggtaccggggacccgtaaaccgggg

SEQ ID NO: 183011 - DNA, 639 bp, Homo sapiens
  misc_feature: GYAE6OF01DGA6L.13.76.G10.1.454.CMB.1.raw
  modified_base (614)..(614): a, c, t, g, unknown or other
  misc_feature (614)..(614): n is a, c, g, or t
tcagtcacgtactacacgaccggtgctcgatttagtcactcatacagggggggagaggagcccagcactgggattccgaggtgtttccattcggtgatcaacactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccgaggcctaccgaaggggaacggggcgtgggagtcgcgttcttctttttatttatagtaggtggtagtactataccgtccgacagtacctccggtggacggggtcccgtatttccaacccgtattccctaccaggaacgaacctaaacgtttacccaaagaaacccaccgtcttagttttacctactaaatcgaaacctagcccttaggagacgacccgagtcgaccgacggtacccgttgttaacttacgtgtgacgagtaagcggtcggggaccctaacggtaaccgttactaccgctagtcgggtacgttacggnggggacccaaggggccctaaccggg

SEQ ID NO: 183012 - DNA, 630 bp, Homo sapiens
  misc_feature: GYAE6OF01C1WR0.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgtccagtgtgaggtgcatctggtggagtcgtgggggaggcttgggtaaaggccggggggtcccttcggactctcctgtgcagcctcgtggatcactttcagtgacgcctggatgaacgtgggtccgcgaggcctccgagggggaacggggcgtgggaggtggtagttcgggtaccgttaagttaaaaaggtgacggtcctggacgtgggtacgggacaacgagactacgctgccaccgtgaggcagacttcgacctatctaccagacgatagtacttacgaaacgaaaccgacgtacgttcggtttactacgtaactaaagtcgaaacgaccgtccgtagaccgtcgggacccggggtactaccgtcgtaccgtgttacttacgtcgtcgccgagcgagccgtacgtaccgtacggcttaactttagttttattttttcgccgtttcggtaccgggg

SEQ ID NO: 183013 - DNA, 660 bp, Homo sapiens
  misc_feature: GYAE6OF01D7Z0Q.13.76.G10.1.454.CMB.1.raw
  modified_base (285)..(285): a, c, t, g, unknown or other
  misc_feature (285)..(285): n is a, c, g, or t
  modified_base (302)..(302): a, c, t, g, unknown or other
  misc_feature (302)..(302): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgatccaggccgtggggggtccctgagactctcctgtgcacgcctcgtgggttccaccgtcagtccacaccctanatgagcgtcgggtcccnccgaggcctccggaaggggaacggggcgtgggagtcggtcgttctttcttttatttataggtagtggtagtacataccgccgcacgactccggtaggacggggcctagttaccacctacttcctaccgagaacgaacctaacttacccgaaacgaaccacgtctttacgtttactacaaatcgaacagccctaggacgacgacgaagtcgaccgaccgggtaccttaggttaacttacgtgggtcgacggaagtacggtacggtccgggggtaacccctaacgggtaaccgtttaccgtaaccggtacgtaaggttacgggaccgttcgggaccgggaccggaaacggggtaaccccg

SEQ ID NO: 183014 - DNA, 583 bp, Homo sapiens
  misc_feature: GYAE6OF01A2IMV.13.76.G10.1.454.CMB.1.raw
  modified_base (448)..(448): a, c, t, g, unknown or other
  misc_feature (448)..(448): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccaggctccgaggggagggctggagtgcgtcttcttttattatagtagtgtatacatactccgcagactccggtagacggggcctattcacctatcctccagacgaacaacttaccaaagaacacgtcttcgtttactacaaattcgaaacncgcctagacgacgccgatacgaccgacgggtccgttagttattaccgtggtcgacgaggagtacggtccggggaccctaacggtaaccgttacacgtctagtcggacgtacggtcggggacccgaaggggacccg

SEQ ID NO: 183015 - DNA, 627 bp, Homo sapiens
  misc_feature: GYAE6OF01EYQOV.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctacatgagctgggtccgccaggctccgaggggaaggggctggagtgcgtcttcttttatttatagtagtggtagtacatactcgcagactccgtggacgggccgattcacctatcctaccagacgactaacttaccaaacgaacaacgtcttgtttaccttacaaagtcgaaaccacgtaccctaggaacgacgaccgtatacgacccgtacgggacccgttaggttacttacgtgttcgacggtagacggtagtaccgggggacccctaacgtaaccggtttaccgaaccgtacgttacgtacggggtaccgttaccggtcgggggtaccccgaaaggggtaaccccgg

SEQ ID NO: 183016 - DNA, 641 bp, Homo sapiens
  misc_feature: GYAE6OF01DVT3Q.13.76.G10.1.454.CMB.1.raw
  modified_base (382)..(382): a, c, t, g, unknown or other
  misc_feature (382)..(382): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgcttattttaaaaggtgcccagtgtgaggtgcagctggtggagtcgtgggaggaggcttgatccagccgtgggggtccctgagactctcctgtgcagcctcgtgggttccaccgtcacgtccacacctacatgacgctcgggtccgccgaggcctaccggaggggaaggggctgggagtcgtcgttctttcttttatttatagttagtggtagtacatactccgnacgtccgtccggtggacggggtcctagttccaacctattcctccgaagtacgaactaacttaccaaagaacctcgtacttacgtttacctactaaatcggaaactacgtccctaggacgtacgaccgtaagtacgaaccgtaccgggtccgttattaacgttcgtgtacgacggaagcggaggtccggggacccctaacggtaaccgttcgaccgtgtaacgtcggaccgttcggacggggacccaacggggtaacccc

SEQ ID NO: 183017 - DNA, 824 bp, Homo sapiens
  misc_feature: GYAE6OF01BO9AM.13.76.G10.1.454.CMB.1.raw
  modified_base (235)..(235): a, c, t, g, unknown or other
  misc_feature (235)..(235): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccagcactcacctgctctaggaaataatggcagataaatntacttctaggtatcagcagaagtcgaggcctacgtcccctgtcgcgtcggtcatctatacgaagactcgaccaacggccggtacccctacgacgggtactacccgtagacggtacggtaactttccgtaccgttacgggtcccttaacccgaaaccgtttaccggtacggggtaaaccccgttcgtaaccgggtaccccttaaccttcccggttaaccgaaccccgtaacgttacccggaacccgggtaaccccggggaaccccgtaacggggtaccctttaagggtacggggttaacgtaccggggtaacggttaccgttacggtaacgttttaaccggttacggttaaccggttaccggtaacgggggttacccgggttacggggtaacctaaccgggaccgtaccgggtacccgtaaccggttaccccggtaccccggttaccgttaaacgggtttccgggtttaccccggtttaaccgggtaaaccggggtttacccggggaaaccccggttaaaaccgggtccccgttaaaccccgggttacccgtttaaaccggtaccccggtaacccggtaaaccccccggg

SEQ ID NO: 183018 - DNA, 706 bp, Homo sapiens
  misc_feature: GYAE6OF01B7O1Q.13.76.G10.1.454.CMB.1.raw
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctccgtggagggacagtcacactcacttgtggcttgagatacggctcagtctctagtacgttacctacccagctggtaccaacacgacccaggccaggctccgcgcacgctcatctacaacacaaacactcgctcttcgtcgggtccctcatcgcttctctcggtctccacttccgttagggaaaccaaaagccttacgtacccgtttaactcctaacgtccggaacccggggggacccctaacggggacctaacgggaaacgtacgtagtaaacttacttaggtaacttttaagtttacgtttcggtttacgtttttaccttttaagttagtttacggggttaacgttcggtaaccctttacgtttttcgttcgtcggtttggttacggtttcggggacggggtacgggcccggtaaccccgggtccgttacgggtacccccggttcccggtcccgggttacccgaaccggtaccccggaacgggtcccgtcccggtcccccgtacggtttacccccggg

SEQ ID NO: 183019 - DNA, 605 bp, Homo sapiens
  misc_feature: GYAE6OF01AKIRR.13.76.G10.1.454.CMB.1.raw
  modified_base (383)..(383): a, c, t, g, unknown or other
  misc_feature (383)..(383): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtctgggaggaggcttgatccagccgtggggggtccctgagactctcctgtgcagcctcgtgggttcaccgtcagtcacacctacatgagcgtggggtcccgccgaggcctaccgagggggaacggggctgggagtgcgttcttcttttattatagtagtggtagtacatactcgcagactcggngacggggcctattccacatcctacagacgactaactaccaagaacacggtcttagtttctacaatcgaactagcctgagacgcgtatcgaccgacgggtccgttagttacttacgtggtcgacggaggacgtacggtcgggggaccccaaggtaaccggttaccaccggtacttacggtgggacccggttaccgggtcggggacccgaacgggggtaccccg

SEQ ID NO: 183020 - DNA, 614 bp, Homo sapiens
  misc_feature: GYAE6OF01D8N8J.13.76.G10.1.454.CMB.1.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccacctcagtgtccgtgtccccaggacagacagccagcatcacctgctctaggaaataattggcagataaatatacttcctggtatcagcagaagtcagccagtcccctgtgctggtcatctatcaagatcgcaagcggcctcgagggactcccgtgacgcgtattccgtcgtggcctaccaaccgtcgtcgggaaccttcgaacgtccctactccgtcgaaccctagtacccgaggccgggaaccccagggtaccgtagtcggtaattacgggacggtcgtacgaaccgtttacgtttaacgtggttaaccgacggggtaccggttagggaaccacggccgacggtccacgtccggcccgtagttacgttcgttaccgttaccggtaacgtacggggtacccgaaacggtccgaacccgttacgttaaacgccgaacggtaacccccg

SEQ ID NO: 183021 - DNA, 687 bp, Homo sapiens
  misc_feature: GYAE6OF01ECZW1.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtggaggaggcttgatccgagccgtgggggtccctgacgactcctccgtgtgcacgcctcgtggtccaccgtcagtcacacctacatgacgcgtcgggtcccgcgacggcctccggaggggaacggggcgtagggagtggtccgttctttacgtttttaagtttagtaggttaggttaggtagtaactagtacccgtccgacgaacggtacgtccggtagggaccggggtccgtattccgacctacgtcctaccgaagaacgactaaacttacccgaaagtaaccgacgttctttacgtttacctaacgaaatacggaacctacgaccgttaggacggtaccgacccgtaagtaccggaaccgtaccgggtccgttagttaccttacgtggtacgtacggaagtaggtaccgggtacgggaacccctaaggtaaccgttacgtaccgtgttacgtcgggtaccgtcggccggggtaaacccgg

SEQ ID NO: 183022 - DNA, 552 bp, Homo sapiens
  misc_feature: GYAE6OF01EI6QB.13.76.G10.1.454.CMB.1.raw
  modified_base (385)..(385): a, c, t, g, unknown or other
  misc_feature (385)..(385): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacagccagcatcacctgctcagaaataatggcagataaatatacttctgtatcagcagaagtcaggccacgtcccctgtcgctggtctatctatacaagatcgaccaagccggaccctcgacgggtctccctgacgtcttacttctcgtcggcctaccactcgtacggaactcgacgcctactctacgaccntacgacgccggaccaggactagtggagtcggaggtctagtacttagttacgtcgtacgaggtcggtagggacaggacacgccgacgtcgacccgtcttacgtcgttaccgttacggaacgtcgggaacctaacggtcccacccgttactaacgtccgacgaaccccg

SEQ ID NO: 183023 - DNA, 744 bp, Homo sapiens
  misc_feature: GYAE6OF01ENLE1.13.76.G10.1.454.CMB.1.raw
  modified_base (273)..(273): a, c, t, g, unknown or other
  misc_feature (273)..(273): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctcagtgtccgtcgtccccaggaccagacagccagcatcacctgctctaggaataatggcagataaatatacttctgtatcagcagaagtcaggccacgtcccctgngctggtcatctatacaagactcgaccaagccggaccctcgacgggacctcccgtgacgcgtaattccgtacgtcgggtacctacccgtaaacctccgtacggggtaaacccttccgaacgtacccgtacctccgtacgaacccgtacgtaccgaacgggacccgggaaccccgtagggtacccttaagggtcgggtaacgtcgggtaacggtccgttaacggttaaccctttaacgtttaaccgtggttaccggtaacggggtccggggttaacggggaacctacggggaccgtaaccggtaccgtaacccggtttccgggtacccccgtacggtttaacgttcccggggttttaccccgtttaaccgggggaaaccggttacccggggggaaacccttaaaaccgggggttccccaaaccccgggtttaccccgtttaaaacggtcccgaaccccgggtaaaccccccgg

SEQ ID NO: 183024 - DNA, 633 bp, Homo sapiens
  misc_feature: GYAE6OF01AO5H4.13.76.G10.1.454.CMB.1.raw
  modified_base (421)..(421): a, c, t, g, unknown or other
  misc_feature (421)..(421): n is a, c, g, or t
  modified_base (491)..(491): a, c, t, g, unknown or other
  misc_feature (491)..(491): n is a, c, g, or t
  modified_base (546)..(546): a, c, t, g, unknown or other
  misc_feature (546)..(546): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaggtgtccagtgtgaggtgcagctggtagagtcgtgggggaggtgtggtacggccgtggggggtccctcgagactctcctgtgcacctctggattcacttagctaactatcgccatgagcgtcgggtccgccgacggcctccgagggggagggcgtgggaggtgggtctacaacttattaggtgtacgtaggtggtcgaccaccaacactaaccgtacgcaagaccgttccggtaggaacgggccgtacttcgaaccntaccgtccaaggtacgtaacctaacttaccaaagaaccacgtactgtaatcctagaccaaagtcgaaacncgtacctagaacgacgaccggtacggaccgtaccggtaccgttaatacgttacgngtacgacgtaaaggtaaccctttcccgtaattagttacgacgttacggtacggggacctaacgggtaccctggacctccgtctaccg

SEQ ID NO: 183025 - DNA, 681 bp, Homo sapiens
  misc_feature: GYAE6OF01AX16B.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagntgccaaagccggcccctgacgggactccccgtggacgcgtatttcctcgttcgggcctacccgaaactccgtagggaacctcgaacgccctaactccttacgaccctagtccgaacgggcccgggaaccctaggccttaagtacgggtaacgttcgggaacggtccttacggacttaagtttaccgtaggttacccggaaggggtcccgggtttaggggaacccgtagggtacccgaacggtcccgtaaacccgttcggacccccggttacgttacggttacccggttaccggtttaacccgggaaacgttccgggggaaacccttaacggggtaaccctaccccggttaccctaaacgggtcccgtaacccgggtaaacccccccgg

SEQ ID NO: 183026 - DNA, 652 bp, Homo sapiens
  misc_feature: GYAE6OF01CYWE1.13.76.G10.1.454.CMB.1.raw
  modified_base (314)..(314): a, c, t, g, unknown or other
  misc_feature (314)..(314): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataaattggcagataatatacttcctggtatcagcagaagtcaggccagtcccctgtgctggtcatctatcaagatgaccaagcggccctgacgggntacccctggacgcgtattcctctaggcctccaacttcgtagggaacctcaacgccctaactctacggacctataccgaggcccgggaaccccagggtaccctagtcgggaattacggaggtcctaggaacccttaatttaaccgtcggttacaagggtcggtagggaaccaggccaacggtccaacgttccggaccccgtagttaaccgttcggttaccgttaacccggggtaaaaccgttcggggggaaaccccgtaaacggggtttaccccgtaaccccggttaacccgttaaacgggttaacccgtaaccggtaccccccggaaaaaccccgggg

SEQ ID NO: 183027 - DNA, 765 bp, Homo sapiens
  misc_feature: GYAE6OF01DG8VK.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcagtcaccacctacatgagcgtgggtccgccgacggcctaccggaaggggaacggggcgtgggaggttcggcgttcctttacgtttttaatttagtaagttagttggttaagtactaataccgtaccgcaagtaccttcccggtaggacggggggtccctaagttcccgaacctacttaccttcccaaggaacgaaccgtaaacttacccgaaaaggtaaaccctaacgtcctttacggttttaccttacgtaaaagttacggaaacctaacgtccgttagaacggaacggacccgtaagttaccgaacccgtaccggggtacccgttagtttaaacgtttaccgttagggttacggacggtaagggaaacggtacggtaccggggggacccccttaaacgggtaaacccggttttaaccgtaacccggtaccgttaaggttaccggggtaaccggttcgggttaccgggggaacccgtaaacggggggtaacccccgg

SEQ ID NO: 183028 - DNA, 657 bp, Homo sapiens
  misc_feature: GYAE6OF01AE5N7.13.76.G10.1.454.CMB.1.raw
  modified_base (299)..(299): a, c, t, g, unknown or other
  misc_feature (299)..(299): n is a, c, g, or t
  modified_base (472)..(472): a, c, t, g, unknown or other
  misc_feature (472)..(472): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcacgcctcgtgggttcaccgtcagtcacacctacatgagcgtgggtcccnccgaggcctccgaggggacgggctgggagtcgcgttcttcttttattagtagtaggtggttaacgtacatacctccgacagtcctccggtggacggggtcctattccacctatcctaccagacgaacctaattaccaagtaaccacgtcttcgtttactactaaatcgaaccncgtccgtaggacgacgaccgtagtacggaccgtacgggtccgttagttaacttacgtggtacggacggtaaggacggtacggtccgggggtaccccaacgggttaacccggtttaccgaccggtacgttaacggtacgggttaccgtccggggtaccggggaacccggaacggggtaacccccgg

SEQ ID NO: 183029 - DNA, 716 bp, Homo sapiens
  misc_feature: GYAE6OF01CPIXH.13.76.G10.1.454.CMB.1.raw
tcagtcacgtactacacgaccggtgctcgatttagtcactcatacagggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctgggtccgccagggccgtaccgggggaagggctgggagtcggcgttcttcttttatttataggttagttaggtatactataaccgtccgacacgacctcggtaggacgggggtcctactttccgaacctacgttcctacccgaaggacgtaaacctaacttacccgaaaagaacccgtacgtacctttacgttttacctactaaaagttagaaacctaaggtcccgttaggaacgacggacccgtaagtacggaaccgaccgggtcggttacgttaacttacgtaggtcgaccggtaagtaagggacggtccgggggaaccccctaaacgggaaaccgtttaacccgtacggtaccgttaacggttacggggtaacccggttcgggaccgggggtaaccccggaaaacgggggtaccccgtaacccggggg

SEQ ID NO: 183030 - DNA, 689 bp, Homo sapiens
  misc_feature: GYAE6OF01A7RU8.13.76.G10.1.454.CMB.1.raw
  modified_base (300)..(300): a, c, t, g, unknown or other
  misc_feature (300)..(300): n is a, c, g, or t
  modified_base (639)..(639): a, c, t, g, unknown or other
  misc_feature (639)..(639): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttccaccgtcacgtccacacctacatgagcgtcgggtccncgaggcctccggaggggacgggctggagtcgcgttcttacttttattagtagttagtggtagtacattacctcgacagtaccgtccgtaggacgggtccgtattccacctatcctaccgaagtaacgaacctaacgttacccaaaaggaaaccctaccgtacgtttacgttttaccctaacgtaaaattccggaaacctacgggtccttagggaacgtaccggtcccggtaaagttccggaacccggtaccggggttaccgtttacgttaacttaccggtggttacggaccggtaaagcgggtaacggtccggggaccctaaacggtaccggtttaacncgtactaggttcggacgttccgggacggggtaaccgaaggggtaaccccg

SEQ ID NO: 183031 - DNA, 835 bp, Homo sapiens
  misc_feature: GYAE6OF01EI2J6.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaattttaaaggtgccagtgtgaggtgcagcgtggtggagtcgtgggaggaggtcttgactccgacggtccggtcggggggtccctggacgtacctctccgtgtgccgacgtcctcgtcggttaccaccgtcacgtacacctacctacatcggacgtcgtcgggtcccgccgacggtccgtaccggaagggggacgggtcgtagggacgtcgtccgttactttacgttttagtttacgttaggttaggttaggtaacgttaccgtattacccgtccggtacgtaacggtacccgttaccgggtacggggtaccggggtacctacgttacccgaacctacgttcccgtaaccgaaggaaccgtaacttaaaccgttaaccccgaaaaggtaacccgtacggtttaccctttagttttaaccctaacgtaaaacgttcgaaacccgtcgtacccgtaagaaccggtaccgaaccgtaacggtaccgaacccggtaccgggttaccgtttaagttaaccgttacggtacggtacggtaaccgggtaaaggtaccgggtaaccgggtaccccggggtaacccgtaaaaccgggttaacccgttaacccgtaccggttaaccgttaacggggtacccgggtaacccgggttcccgggtaagggggtaaacccccggg

SEQ ID NO: 183032 - DNA, 667 bp, Homo sapiens
  misc_feature: GYAE6OF01D4VQT.13.76.G10.1.454.CMB.1.raw
  modified_base (289)..(289): a, c, t, g, unknown or other
  misc_feature (289)..(289): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataatatacttctggtatcagcagaagtcaggccagtcccctgtgctggtcatctatcaagntgccaagccggccctcgagggacctcccgtgacgcgtattctcgtcggcctaccaacgttcgtacgggaaccttcgaacggtccctacttccgtacgaaccctagtaccgacgggacccgggaaccctaagggtccttaaggtcgggatacgggagggtaccttacggtaacttacgtttaccgtcggttaccggaggggtacccgggttaggggaaccgtacggaccgacggccgtacccgttccggccccgtacgttacggttcggtttacccggttaccgggaaacccggttacggggtaaaccccgtaaacgggttaccccgtaaccccgggttacccgttaaaccgggtcccgtaacccggtaaaccccccgg

SEQ ID NO: 183033 - DNA, 762 bp, Homo sapiens
  misc_feature: GYAE6OF01ANPIC.13.76.G10.1.454.CMB.1.raw
tcagtcacgtactacacgaccggtgctcgatttagtcactcatacagggggggagagggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtgggggtccctgagactctcctgtgcagcctcgtgggttccaccgtcagtcacacctacatgagtcgtcgggtcccgccgacggctaccggaggggaacggggtcgtgggaggtcggtcgttctttactttttagtttagttaggttaggtacggttagtaacctacttaccgtcccgacgtaacggtacccgtccgggtacgggacgggggtccctaacgtttcccgaaccctacgttaccctacccgtaaggaaccggtaaacctaaactttaaccccgaaaacggtaaacccctaccggttaccgttttacggtttttaccttaaccgtaaaagttacgaaaacccgtacggtacccgttagggaacggtaccggtacccgtaagtaccggaaccgtaccggggttaccgttagtttaacttacgtggtacggtacggaaggacggtaggtccggggacccctaacgggtaacgttaccgtacgtacgtacggtcgggaccgttagggaccgggggacgtaacggggtaccccg

SEQ ID NO: 183034 - DNA, 602 bp, Homo sapiens
  misc_feature: GYAE6OF01CH81C.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctcagtcgtccgtgtcccccaggacagacagccagcatcacctgctctaggaaataagttggacagataatatacttctgtatcagcagaagtcaggccacgtcccctgtcgcgtggtcatctatcaagntgaccaagccgacctcgagggctccgtgagcgtatcctcgtcgcctccaactcgacgggactcgacgcctactcctcgaccagtaccgacgggaccggacccaggtactagtggagtggagtctagtactatttacgtggtacgaggtcggagggtacacggtacacggacctaccggtccgtacccgtctacgttccggtaccggttaccgggtaacggttaccggggaaccccgtaacgggttaccccgtaaacccggtttacccgtaaaggccccgtaacccggaacccccgtaaacccggg

SEQ ID NO: 183035 - DNA, 719 bp, Homo sapiens
  misc_feature: GYAE6OF01AE2EL.13.76.G10.1.454.CMB.1.raw
  modified_base (522)..(522): a, c, t, g, unknown or other
  misc_feature (522)..(522): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtgggggtccctgagactctcctgtgcacgcctcgtggttccaccgtcacgtcacacctacatgacgcgtcgggtcccgccgaggtcctccggaagggggaacggggtccgtgggaggtcggtccgtttctttctttttaatttagttaggttaggtggttaacgtaactacttaccgtccgcacggtaccgttccggtggtacggggcccgtagttccaccctactcctaccgaggaacgaacctaacttacccgaaacgtaactacgtctttagttttactactaaattcgaaaccncgtaccgtagaacggtacgaccgatacggaaccgtccgggtaccgttagttacttacgtggtacggaccgaaggacggtacgggtaccgggggtacccctaacggggttaaaccctttaaccgaccggtacgtttaacgggtcggggttaacccggttcgggtaccgggggaaccccggtaaacggggtaaccccgg

SEQ ID NO: 183036 - DNA, 682 bp, Homo sapiens
  misc_feature: GYAE6OF01EJGA1.13.76.G10.1.454.CMB.1.raw
tcagtcacgtactacacgaccggtgctcgatttagtcactcatacaggggggggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggactccctctcttcctcggcgtccttgccttactgcacaggactccgtggcctcctatcgagctgactcacgccaccctcagtcgtccgtcgtccccgaggacacgacacgccagcatccaccgtgcctacgtacggtaaaataagttcggactaaaggtaattaaaacgtactttaaccgtttacccgttacgggttaacttaccgtaacgtacgtaaaggtaaacgtaccgtaacggaccccgtaacggttccccccgttaggtacggtacgttcggttactacgttactaacgttacgaacgtacgtacggtacccgtaacggcccggtacccgtaccgtacgggtacccttcccggtaggtaaccggtaccggttacgtttcccgttaccgttccgggacccttacccgaaacccgttccggtaacgggtaaccctaccgtaccgtcccgtaaccccg

SEQ ID NO: 183037 - DNA, 838 bp, Homo sapiens
  misc_feature: GYAE6OF01BVV61.13.76.G10.1.454.CMB.1.raw
tcagtcacgtactacacgaccggtgctcgatttagtcactcatacgaggggggagaggagcccagcactgggattccgaggtgtttccattcggtgatcagcactgaacacagaggactcaccatggtagttttggctgagtcgttgggttttccttgttgcttaattttaaaaggtgcccagtgtgaggtgcagcgtgggtggagtcgtgggagggaggtcgttgactccgacggtcccggttcggggggttcccctggacggtaccttccgttcccgttggtcgccgacggtccccgttccggttcggggtttaccctacccggttaccgtaacggtacccaaaccctaaccctaaccagtacggtaccggtccggttccggggtcccccggaccgaccggtcccgtaccgggaagggggaacggggtccgtaggggacgttcggtccgtttcgttttacgtttttaagttttagtaaggttacggttaggttaacgtactacgtaccgtcccgacgtacggtaccgttccggtcggaccggggtaccgtacttacccaccgtacttacccgtaccgtaagacgtaaacctaaccgttaaccaaacgtaacccgtacgttcgtttacgtttacctaactaaagtaccgtaaccacgtaccgtaggacgtaaccggtcgaaagtccggaaccggtaccggtaccgtttagttaacgtccgttggtacgacggaagtacggtaaccgtccggggtacccctaaacgggttaaccgttacgaccgtagttaacggtcggtaccggttggtaaccggggaaacccgaaccgggtaccccg

SEQ ID NO: 183038 - DNA, 683 bp, Homo sapiens
  misc_feature: GYAE6OF01A2MNJ.13.76.G10.1.454.CMB.1.raw
  modified_base (372)..(372): a, c, t, g, unknown or other
  misc_feature (372)..(372): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtgggtcaccgtcagtcacacctacatgagcgtgggtcccgccgaggctccgaggggacgggcgtgggagtgccgtcttcttttattagtagtaggttggtacgtactagtacnccgacacgacctccggtaggacggggccgtattccgacctacttcctacgaaggaacaacctaattaccccgaaagtaaccgaccgttctttacggttttacctaacgaaagtcggaaacctcggtacctagggaacgaccggacccgaagttccgaacccggtaccgggtaccgttagttacttaacgtggaccgggaacggaaggtaacggtcgggtacccggggggaacccctaacgggttaaacccggtttaccaacgggtcttaaggtccgggggtaccttccgggtaccggggggtaaaccccgg

SEQ ID NO: 183039 - DNA, 735 bp, Homo sapiens
  misc_feature: GYAE6OF01EWC1H.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggacctcaccatggagttttggctgagcttgggttttccttgttgctaattttaaaaggtgcccagtgtgaggtgcagctggtggagtcgtggaggaggcttgatccagccgtgggggtccctgagactctcctgtgcagcctcgttcgggtcaccgtcagtcacacctacatgagtcgtcgggtccgccgaggccgtaccggagggggaacggggcgtgggagtcgtcgttcttactttttattagttagttaggtggtagtactactacgtccgacacgtaccgtccggtaggacgggggtacccgtaactttcccaacctactccgtaccgaagtaaccgtaacctaaacgttacccaaaagtaacccaaccggttctttacgttttaccctaactaaacgttacggaaacctacggtacccgtagggaaccgaccggacccgtaagttccggaacccgtaccggggtcccgtttaagttacgtttacgtggtacgggacggtaaggtaacggtacggtcccgggggaacccctaaaggttaacccgtttaccgtaccggtacttaacgggtcgggaccggttacgggaccgggggtacccgtaacggggtaaccccg

SEQ ID NO: 183040 - DNA, 692 bp, Homo sapiens
  misc_feature: GYAE6OF01ELG69.13.76.G10.1.454.CMB.1.raw
  modified_base (172)..(172): a, c, t, g, unknown or other
  misc_feature (172)..(172): n is a, c, g, or t
tcagtcacgtactacacgaccggtgctcgattttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtccccaggacagacacgccagcactccacctgcctctaggaaattaagtggacaagaataaatacttacttcctagtatcagacaagaagtcgacgccgacgtccccctgtcgcgtggtctactactagtacaagtagtcgaccgaacggccgacctacgacggacctccgtgacgtcgtacttcctcgtcgtacctaccgtaaccgtcggtacggtaacctcgacgtacctaccgtcgtaccgacctacgtaccgacgggtacccggaaccgtacggtaccgttaaggtcggtaacgtcgggtacggtcgtacgttaacgtttacgtaccgttaggtccggtacgggtacgggtacgggaccgtacggacgacgtaccgtaccggttccgtacccggttaccggttaccgggtaaaccggttaccggggaaccctacgggtacccgtacccggtaccggttaccggaaccgtacccgaacccggtacccggaaccccgtaaccccgg

SEQ ID NO: 183041 - DNA, 546 bp, Homo sapiens
  misc_feature: GYAE6OF01BD7YW.13.76.G10.1.454.CMB.1.raw
  modified_base (267)..(267): a, c, t, g, unknown or other
  misc_feature (267)..(267): n is a, c, g, or t
  modified_base (293)..(293): a, c, t, g, unknown or other
  misc_feature (293)..(293): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtnagtcacacctacatgagctgggtccnccaggcctccgagggaagggctggagtgcgtctcttttattatagtagtggtagtacatactcgcagactccgtggacggggccaattccaccgatctccgagagacaattccaagacacgctgtttctcaaatgaacngcctganagccgaatcgacacggccgtagtacttctggtgcggtaagagacgtcggggcccaggtaaccgttacacgcttaagtcggaccgttgtcggggccaaaggggacccc

SEQ ID NO: 183042 - DNA, 669 bp, Homo sapiens
  misc_feature: GYAE6OF01EYWE4.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgagcgtcgggtcccgccgaggccgtcccggaggggaacgggggcgtgggagttcggtcgttctttcgtttttaattttagttaggttaggtggttagtaactactaccgtccgcgagtaccgtccggtggacggggtacccgtagttcccaacctacgttcctaccgaaggaacgtaacctaacttaccgaaaggtaaacccacggtacctttgttttaccttacgaaagtcgaaaccgtacgtaccctaggacgacgccgaatcgaccgtaccgggtccgttagttacttacgtaggtcgacgtagacggtacgtccggggaccctaacggtaaccgttcgacgacttacggtacgggtacgttcgggcggggacccgtagggaccccg

SEQ ID NO: 183043 - DNA, 743 bp, Homo sapiens
  misc_feature: GYAE6OF01ECXO5.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagcttgggttttccttgttgcttaattttaaaaggtgccctagtgtgaggtgcagctggtggagtcgtgggaggaggcttgactcccgaggccggtcggggggtcccctggacgtaccttcctccgtgtgcacgtccttcgtcggttcctaccgtcgtacgtccaccgtaccctacagtacggacgtccggtcgggtccccgaccggacggtccgtaccgggagggggaacgggtcgtagggagtcgtcgtttacgtttacttttagtttagttaggttaggtaggtaacgtaactacgttaccgtccgacgtaacgtccgtaccggtagggacggggtacctacttccactacctacgtaccgaagaaccgtaactaactaccgaaaacgtaccctacgttacttttgtttaaccctaagtaaagttcgaaactcgtacaggaagtccgacgaagtcggaaccgtcggtacgttagttactacggtgtccgaaggaggtaacggtaccgggccgggtaacccctaaacgggttaaccgttacgaccgttacgtagggtacgggtaccggtaccgggtaaccggggccgtaaacgggtaccccg

SEQ ID NO: 183044 - DNA, 759 bp, Homo sapiens
  misc_feature: GYAE6OF01EDYV9.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggttttccttgttgtcttaattttaaaaggtgcccagtgtgaggtgcagcgtggtggagtcgtgggaggaggcttgactccgaggccggtcggggggtcccctggacgtaccttcctccgtgtcgcacgtccgtcgttcggttccgtaccgtcacgtccaacctaacctacagtgacgtccggtcgggtcccgccgacggccgtaccggaaggggaacgggcgtagggagtcggtcgtttcgtttactttttagtttagtagttaggttaggtaagtactacgtactccgacgacgtacgtccggtacggacgggtccgtactccacctactcctaccgaagtaacaacctaactaccgaaagtaacctcgttctttacgttttacctaacgaaaacgttcgaaaccgtcggtaccgtaaggaaccggacgtacccgaagtaccggaacccgtccgggttcctttaagttaacttacggtgtcggaacggaagtacgtacgggtacccggggaaccccttaacgggtaaaccgtttacccgaacggttaccgtaagggttcccgggtaccggttaccggggaacggggaaccccgtaaacggggtacccccg

SEQ ID NO: 183045 - DNA, 635 bp, Homo sapiens
  misc_feature: GYAE6OF01BTRJX.13.76.G10.1.454.CMB.1.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
  modified_base (349)..(349): a, c, t, g, unknown or other
  misc_feature (349)..(349): n is a, c, g, or t
  modified_base (484)..(484): a, c, t, g, unknown or other
  misc_feature (484)..(484): n is a, c, g, or t
tcagtcacgtactacacgaccggtgctcgatttagtcactcatacaggggagaggagcccagcactgggattccgaggtgtttccattcggtgatcagcactgaacacagaggactcaccatggagtttttggctgagcgtgggttttccgtgtaggcgtattttaaaaggtgccagtgtgaggtgcagctgggtggagtcgtggaggaggcttgntccagccgtggggggtccctgagctctcctgtncngcctctgggttcaccgtcagtcacacctacatgngcgtgggtccncaggctccgaggggagacggccggtaggtcgggtctacgtagttttatttagnggttcggacggtccgacctatactactaccgcagtacccgtcggtcgggacggggtccgttccaccatccgtccaggaacgactaattaccgaaacgaacgtaggtacgtattacgttacaaagtcgaactacgngaaggtagtacggacgaccgtacgggcccttacgttaattaccgtaggtagaccgtaaagcgtacgacgagggaacgtccgggtaaccccggagggttcgggtaccgtgggttacgggtacggtttcgtttatttacggcgtggtccgggg

SEQ ID NO: 183046 - DNA, 582 bp, Homo sapiens
  misc_feature: GYAE6OF01AEQOC.13.76.G10.1.454.CMB.1.raw
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
  modified_base (455)..(455): a, c, t, g, unknown or other
  misc_feature (455)..(455): n is a, c, g, or t
  modified_base (465)..(465): a, c, t, g, unknown or other
  misc_feature (465)..(465): n is a, c, g, or t
  modified_base (496)..(496): a, c, t, g, unknown or other
  misc_feature (496)..(496): n is a, c, g, or t
tcagtcacgtactacacgaccggtgctcgatttagtcactcatacagggggggagaggagcccagcactgggattcccgaggtgtttccattcggtgatcagcactgaacacagaggactcaccatggagttttggctgagctgggttttccttgttgctattttaaaaggtgcccagtgtgaggtgcagctggtggagtctggaggaggcttggatccagccgtggggggtccctgagtctctccctgtcgcagcctgtgggtttccaccgtcagtccacacctacatgagcgtgggtccgccagggcctccgaggggaagggctgggagtgcgtcttcttttatttagtagtagtgttagtacatactccgcaagccgtccggtggacggggcctattccactactctcagagacaattccaaagacacgtcgttntttactacaatnaaacngtcctagagngtaccgatacgacgacggtccgtataagttntggtagcgagacgtagccgggtacccacggttaacgttcctacgtccgtaagtcggtacttccggagggccgaacgggtaccccgg

SEQ ID NO: 183047 - DNA, 640 bp, Homo sapiens
  misc_feature: GYAE6OF01BTORX.13.76.G10.1.454.CMB.1.raw
  modified_base (299)..(299): a, c, t, g, unknown or other
  misc_feature (299)..(299): n is a, c, g, or t
  modified_base (374)..(374): a, c, t, g, unknown or other
  misc_feature (374)..(374): n is a, c, g, or t
  modified_base (566)..(566): a, c, t, g, unknown or other
  misc_feature (566)..(566): n is a, c, g, or t
  modified_base (603)..(603): a, c, t, g, unknown or other
  misc_feature (603)..(603): n is a, c, g, or t
  modified_base (607)..(607): a, c, t, g, unknown or other
  misc_feature (607)..(607): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttcctgttgctattttaaaggtgcccagtgtgaggtgcagctggtggagtcgtggaggaggcttggatccagccgtggggggtccctgagactctcctgtgcagtccgtctgggttcaccgtcacgtcaccactacatgacgcgtcgggtccnccacggcctccgagggacgggctggagtgcgttcttcttttagtttatagtaggtggtacgtacagtactccganagtacctccggtggacggggtaccctagtttccgaccctattccgtaccgaaggtactaaccgtaacgttaccccgaaaagtaacccgtacggtcttaggtttttaccctacgtaaaacttcggaaactaccgaccgtaggaacggtacgacccgtagtacggacccgacgggtccgttagttacttaccgngtacgcgagagacgtcgggaccctaaggtacccgttnacgnttagcgtacgtgcgggtacccgaagggtacccg

SEQ ID NO: 183048 - DNA, 734 bp, Homo sapiens
  misc_feature: GYAE6OF01CL0EP.13.76.G10.1.454.CMB.1.raw
  modified_base (332)..(332): a, c, t, g, unknown or other
  misc_feature (332)..(332): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggacagataaatatacttcctgtatcagcaagaagtcaggccagtcccctgtcgctggtcatctatcaagatcgaccaacgccggccctacgacgggactcccgngacgcgtacttccgtacgtcggcctacccgaaccgttccggtacgggtaaacccttccgaaccggtaccctaccgttaccgtaccggaacccctaacgttacccgaacgggtaccccggggtaaccccgaacgggtccgttaagggtcgggtaacgtacgggtaacgggtccgttacggttaacctttaacgtttaaccgttcggtaccggacggggtaccgggttacggggaacctacgggaccgacgtacccgtaaccgtcccggtaccccgtacgttacgtttccggttacccggttaaccgggtaacccggttaccggggtaaacccgttaaccgggttaccccgttaaccccggttaacccgttaaacggtccccgtaacccgggtaaaccccccgg

SEQ ID NO: 183049 - DNA, 697 bp, Homo sapiens
  misc_feature: GYAE6OF01CD098.13.76.G10.1.454.CMB.1.raw
  modified_base (241)..(241): a, c, t, g, unknown or other
  misc_feature (241)..(241): n is a, c, g, or t
  modified_base (281)..(281): a, c, t, g, unknown or other
  misc_feature (281)..(281): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttctgtgctatttaaagtgccagtgtgaggtgcagctggtggagtcgtggaggaggcttgatccagccgtgggggtccctgagactctcctgtcncgacgcctcgtgggttccaccgtcacgtccactaccctanatgagcgtcgggtccgccgaggtcctaccggaggggaacggggtcgtagggagtcggtcgttctttacgttttatttagtaggttaaggttggtaactacgtaacgtaccgtcccgtagacgtaccgttccgggaggaccggggcctacttccaccgtactccgtaccgaaggaacgtaactaaacgttaccaaaaggtaccacggttcttagttttcctaagaacttaggaaacctgaccgtagacgacgtaccgagtaccggacgaccgggtccgttagttacgttacgtgggtacgaacgggtacgaacgggtacgggtacccgggtaaccccaaacgggttaacccggttaacctcggtacgtacggtacggggtacctcggggtacgggaaccccggtaaagggtaccccg

SEQ ID NO: 183050 - DNA, 847 bp, Homo sapiens
  misc_feature: GYAE6OF01DJ69R.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctctatgagctgactcacgcccaccctcagtcgtccgtcgtcccgaggacagacacgccagcatccactgctacgtaagaaataagttgacaagtaattaaactacttacttcgtagtatacgagacaaggacgtacgacgccgtacgtccccgtgtcgcttaggtctacttacgtatacgaacgtactacggacccaacgggtccccggtacccgttagggaacggtaccctttacccggtaggtaacggtaccggttacctttacggtccggttacccggtacccttaacccgtaaccggttaccgggttaaaccgggtaacccttaccgggtacccctacccgtaaccgttacccgtaccgtaaaccccgtacgttacccgggaaccggggtacccccggtaacggtaacgggttacgttacgggtacgggacgtttacggggaaccggttcgttaaacggttaacccgtttaagttacccgggtacgggttaaccgggacgggttacccgggtacggggaaccttaacgggaccccgtacggtaccccggttaccggtcccgggtaaacccgttaggttcccggtttaccggggttacccggttaaccgggtaaccggttaccgggaaaacccgttaccggtacccgttaaacccgggtaccgaaaccggttacccggaaaccccggtaaacccccggg

SEQ ID NO: 183051 - DNA, 511 bp, Homo sapiens
  misc_feature: GYAE6OF01BGBVT.13.76.G10.1.454.CMB.1.raw
  modified_base (239)..(239): a, c, t, g, unknown or other
  misc_feature (239)..(239): n is a, c, g, or t
  modified_base (440)..(440): a, c, t, g, unknown or other
  misc_feature (440)..(440): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatntacttcctggtatcagcagaagtcaggccagtccccctgtgctggtcatctatcaagatgccaagcggccctcgagggactcccgtgagcgattctctggctccaactctgggaacctcacgccactctcgaccatcgagccggacccaggctagtggatgagctgactattactgtcgacggcgtgggacagcagcacgngcccgtatagtcgtagttcggaacgtcgggaacctacgggtcacccgtacctaacgtccgacgtaaccccg

SEQ ID NO: 183052 - DNA, 629 bp, Homo sapiens
  misc_feature: GYAE6OF01CCORI.13.76.G10.1.454.CMB.1.raw
  modified_base (302)..(302): a, c, t, g, unknown or other
  misc_feature (302)..(302): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctcagtgtccgtgtccccaggacagacagccagcatcacctgctctaggaaataagttggacaagataaactatacttcctaggtatcagacagaagtcaggccagtcccctgtcgcgtaggtcatctatcgaagntgaccgtaagccggccctacgacgggactcccgtagacgtcgtaacttcgtcgtacggcctacccgaaacgttcgtacggggtaccttacgaccgtccctaacgtcctacgaccctataccggaacggccggaacccgagggtcctaagtcggagtacggacggtcgttacggtaacttacgttacgtcgtaccggaagggtccgggttagggacacggtacgagtcccaacggtccgccccgagttacgtccgttacggtaccgggtaacggacgggtaaccctacggtccctaccgtaccgtaacgtccgaaccggtaacccccg

SEQ ID NO: 183053 - DNA, 762 bp, Homo sapiens
  misc_feature: GYAE6OF01CYSEC.13.76.G10.1.454.CMB.1.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (431)..(431): a, c, t, g, unknown or other
  misc_feature (431)..(431): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggtttttccttggttgcttaattttaaaaggtcgcccagtgtgaggtgcagcgtggtggagtcgtggagggaggtcttgatccgaggccgttcgggggtccctaggacgtacctctccgtgtcgcacgtccgtcgtcgggttcacccggtanacgtaccacacctacntcggagcgttcgggccgccgtaggccgtaccggaggggaacgggtcgtagggagtcgtcgtttctttactttagtttaagtaggttaaggttggttaacgtactacgtacgtacccgngaacgtcgtccggtcgggaggggtcctacttaccgaacctacttaccaaccgtaaggaacgtaaaccttaacgttaaccgaaaacggtaaacccgttacgggtttaactaaactttcgtttaaaccaaagttaccggaaacccgtaccgttagggaaacggacggtaaccgggtacggaacccgtacggttaccccgttattaaacggttacgtaggtaccgaagaaacgttgcgtaccggaaggacgggaccccggggttaacccgagggttccggggcgttaggggtcggttacggtttacgtgtttacggacgttcggtacccggggg

SEQ ID NO: 183054 - DNA, 617 bp, Homo sapiens
  misc_feature: GYAE6OF01ETWLQ.13.76.G10.1.454.CMB.1.raw
  modified_base (441)..(441): a, c, t, g, unknown or other
  misc_feature (441)..(441): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataaatatactcctggtatcagcagaatcgagcctagtcccctgtgctggtctatctaatcaagactgaccaagccggccctcgaacgggtactcccgtaggacgcgttacttcgttcgtcggtccctaccgtaaccgtcggtacgggtaaccctcgacgaccctactcgtacgacctagttccgacggccgggaacccaggtactacgnggtacgtcggtaggtccttaggaacttagttacgtcggacggacgggtacggtgggtaaccacggctacggctaccgtccgacccgtattcggtcgttacggtaaccggtacgtaccgggaacccgtaacggttcccaacccggttaccgtaaacgtcccgaaccggtaacccccg

SEQ ID NO: 183055 - DNA, 516 bp, Homo sapiens
  misc_feature: GYAE6OF01DYALQ.13.76.G10.1.454.CMB.1.raw
  modified_base (144)..(144): a, c, t, g, unknown or other
  misc_feature (144)..(144): n is a, c, g, or t
tcagtcacgtactacacgaccggtgctcgatttagtcactcatacaggggggggctgagcccttctctggaaaccacacagctcctcctgcagcagcccctgactgctgatttgcatcacgggccgctctttccagcaaggggntaagagaggcctggaagaacctgcccagcctgggcctcgaggaagcagcatcggaggtgcctcagccatggcatggatccctctcttcctcggctccttgcttactgcacaggatccgtgcctcctatgagctgactcagcccacctcagtcgtccgtcgtccccaggacagacagcagcatcacctgctctaggaaactaatggactagaataaatattacttctagtatcagacagaagtcagcctacgtccctgtgctgtcctatcctatacaagatacgaccacgccgcctcgagggtactccgtagacgtcgtacttctctcggaccctaccaaccgttctacggggtacctcgacgcccgtaaccg

SEQ ID NO: 183056 - DNA, 674 bp, Homo sapiens
  misc_feature: GYAE6OF01C5EG7.13.76.G10.1.454.CMB.1.raw
tcagtcacgtactacacgaccggtgctcgatttagtcactcatacagggtctgggagaggagcccagcactgggattccgaggtgtttccattcggtgatcagcactgaacacagaggactcaccatggagttttggctgagcttgggtttttccttgttgcttaattttaaaaaggtgcccagtgtgaggtgcagcgtggtggagtcgtgggaggaggcttgatccaggtccgtcggggggtccctggacgtactctcctgtgcacgtccttcgtcgggttccacccgtcagtccacaccctacatgagcgtgggtcccgccgaggcctccgaaggggagggcgtggagtgtcgtcttcttttattatagtagtggtagtactataccttccgactagaccgtccgtgggacggggcctaatttcccaacctatccctacccgaggtaacgaacctaacttaaccgaaaacgaacctacgtacctttcgttttaccttaacaaaacgtacggaaacctacggtaccctaggaacgtaacggacccgtattaccgggaacgaccgggtcgttaagttacttacgtgtacgacgagtagacggtccggggaacccctacggtaaaccgtttaccgtaccgtcttagtgggtaccgtcgggcgggggtaaacccgg

SEQ ID NO: 183057 - DNA, 764 bp, Homo sapiens
  misc_feature: GYAE6OF01DANQE.13.76.G10.1.454.CMB.1.raw
  modified_base (576)..(576): a, c, t, g, unknown or other
  misc_feature (576)..(576): n is a, c, g, or t
tcagtcacgtactacacgaccggtgctcgatttagtcactcatacaggggagaggagcccagcactgggattccgaggtgtttccattcggtgatcagcactgaacacagaggactcaccatggagtttggctgagctgggttttccttgttgctatttaaaaggtgcccagtgtgaggtgcagctggtggagtcgtggaggaggcttgatccgagccgtgggggtccctgacgtactctccgtgtcgcacggtcctcgttcgggttcaccgtcacgtccaaccacctacatgacgcgtcgggcccgtccgaacgggtcctacccggaagggggtaacggggcctaggggacggttcggccggtttacctttcgttttaatttacgtaagttacggttaggtaacggtactacgtacctccggacgtaacggtaccgttccgggtaaggtaaccgggggtcccgtaacgttcccggtaaccctaaattccgtacccgtaaggtaccgaaactaaccgtttacgaaacgttaacgtccgtacgtttacggtttacttaacgaaacttacggaaaccncggtaccgtaggaaacgccggaaccgtagtaccggaaccgtccgggtcttaagttacgttaccgtgggtacgtaccggaaagggtgtaagggtcccggggaaaccctaacccggtaaaggtttaccaacccggtcgttaaggtacccgggtaccgtggttaccggggggaaccctaaggggtaccccg

SEQ ID NO: 183058 - DNA, 772 bp, Homo sapiens
  misc_feature: GYAE6OF01DES9Y.13.76.G10.1.454.CMB.1.raw
tcagtcacgtactacacgaccggtgctcgatttagtcactcatacaggggctgggcctcaggaagcagcatcggaggtgcctcagccatggcatggactccctctcttcctcggcgtccttgcttactgcacgaggatccgtggcctcctatgagctgactcacgcccaccctgagtcgtccgtcgtccccgaggacagacacgccagcatccacctgcctcgtaaggaaaattaagtggacaagaattaaatacttacttccgtaggtactacagacgtaagaacgtcgaacggtccctacggttccccgtggtcggtccgtacggtacctacttacctaagtacgaaagtcgtacggacccgaacgggtccccggtaccccgtaggaaccgggtaccttcccggtaggacggtaccgttacgtttcccgtaccggtttacggttaccctaacgttcggtaaacgggtaaccttaaccgaccgtacccgttacgttaaccgtaaccggaaccctaaggtaacccggaaaccgggtactacggaacggtctacgggtacggagtacgggtaccggtagttacgttaacttacgttagtcggtacggacgggtcggtacgggacgtcgacgtacgacccgtacgtcccggacgtacttccggttcgttaccgggtaccgggtaaccggtaccggggtaacccgtaaccggggtacccttaacccgggttaacccgtacggtaacccgaccccggtaaccccggtaaaccccgg

SEQ ID NO: 183059 - DNA, 706 bp, Homo sapiens
  misc_feature: GYAE6OF01ERF9X.13.76.G10.1.454.CMB.1.raw
  modified_base (530)..(530): a, c, t, g, unknown or other
  misc_feature (530)..(530): n is a, c, g, or t
  modified_base (673)..(673): a, c, t, g, unknown or other
  misc_feature (673)..(673): n is a, c, g, or t
tcagtcacgtactacacgaccggtgctcgatttagtcactcatacagggggggagaggagcccagcactgggattccgaggtgtttccattcggtgatcagcactgaacacagaggacctcaccatggagttttggctgagctgggtttcctgttgctattttaaaaggtgcccagtgtgaggtgcagctggtggagtcgtggaggaggcttgatccagccgtgggggtccctgagactctcctgtgcagcctcgtgggttcaccgtcagtcaccaccgtacatgacgcgtcgggtcccgccaggcctaccgagggggaacggggctgggagtcggtcgttcttctttttagtttagtagttaggtggtaagtactattacctcgcacgtcctaccggtggaacgggggtcctacttcaacccagtccctaccgaaggacgtaaacctaacttaccccgaaaggaaccctaccggtcttacgttttaccgtacaaaattcgaaactcgtaccctgaacggcgacccgtanaaccggacccacggggtaccttagttaacttaccgtggtcggaaccgtaaggacggtaacggttccgggggaccccctaaaagggttaaacccgttaccgtaacgggtaccttaaagggttccggggaaacgttccccggggnggggggtaaacccccaaaacgggggggtacccc

SEQ ID NO: 183060 - DNA, 733 bp, Homo sapiens
  misc_feature: GYAE6OF01D9L9O.13.76.G10.1.454.CMB.1.raw
  modified_base (303)..(303): a, c, t, g, unknown or other
  misc_feature (303)..(303): n is a, c, g, or t
  modified_base (463)..(463): a, c, t, g, unknown or other
  misc_feature (463)..(463): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactcctcctgtgcagtcctcgtcggttcaccgtcacgtcaccacctacatgagcgtcgggtcccnccgacggctccggagggggaacggggctgggagtgcgttcttactttttatttagtagttagtggtagtacagtacctccgacagtacctcggtggaacggggccctaattccaccctattcctaccgaagataaccctaattccccgaaaagaaacccngtctttacgttttacctaactaaaaggttcgaaacctcggtaccgtaggaacggaccgtacccggaagtccggaaacccgtacggggtcccgtttaagttaacctttcgtgggttacgaggtaacggtaagggtaccgggtaccccggggggaaccccttaaaacgggtaaacccggttttaacccgaccggtaacgtttacgggtccggggttaaaccccgggttggggtaccccgggggtaacccgtaaaacccgggggtaacccccg

SEQ ID NO: 183061 - DNA, 551 bp, Homo sapiens
  misc_feature: GYAE6OF01A9QTW.13.76.G10.1.454.CMB.1.raw
  modified_base (350)..(350): a, c, t, g, unknown or other
  misc_feature (350)..(350): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgaactggtccgccaggctccgagggaacgggctgggagtgggtagtttcagttaggagcaagttcncatgatggaacaacagaatacgcgcgtcgtagtaaacggcaagacttccaccatactacgaagagtactaggacgtccgaagtaacgcctatcccgtcctttcgagcagactggagtacgacctgaacgaccgacggaccacgacgtccagttccgtaattcgtgtacgactaagtacgtagttatcgcgtagttaccccg

SEQ ID NO: 183062 - DNA, 763 bp, Homo sapiens
  misc_feature: GYAE6OF01DXWNF.13.76.G10.1.454.CMB.1.raw
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgagtcgttgggttttccttgttgtcttaagttttaaaaaggtgcccagtgtgaggtgcagcgtggtggagtcgtggaggaggtcttgactccgacgtccggtcggggtcctgacgctctctgtgcacgtcgtcgtcggtccaccgtcacgtaccacacctanacgtgacgcgtcggtccncgacggccgtacggaaggggacggcgtaggagtcgtcgttactttacgttttaagttagttagtaggtacggttaactactaactaccgtccgactaacggtaccgtcggtacgggacgggtacctacgtacccacgtaacgtccgtaacgaacggtaacctaactaaaccgttaaacgaaacgtaacccgtacgtttacgtttaccgtttaactaaacgtaaacgtacggtaaaccctacgtacggaacggtaacgaaccgggtaacccgtaaggacccggttaaacccggaacgggttcccgtttaagttacgttacggtacggtaacgacgggaaaggtaaccgggtacgggtaccccggaaccgttaaaacgtaaccggtttaacgacgttacggttacggaaccggtaaccgggttacggacccggggtaaacccgg

SEQ ID NO: 183063 - DNA, 633 bp, Homo sapiens
  misc_feature: GYAE6OF01D42T4.13.76.G10.1.454.CMB.1.raw
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttgggactgagctggattttccttttggctattttaaaggtgtccagtgtgaagtgcagctggtggagtcgtgggggaggtcttggtacagcctggcaggtccctgagctctcctgtgcagcctntggtattcattctttgattgattancgacctatcgctacgtcgggtccgacgaacgccgtaccggaggggaacggtccgtaggagttcgggtactcgaggttagttaggtaggtaataggtagtaaactagtaggctagcgacggtactcgtggtagaacggtcctattcaacctatactcgaagacgaactaacgaccaacgtacctccgtatactctacgactaactagaactagtacgtgaagtacgaccgtaggacggacctacgggtcctttaaggttacgttacgttagtaacggtaaccgtaaaaggttcctaacgtttacggacgttacgggttaccggtaccttcccgggttcccttcccggttaacccg

SEQ ID NO: 183064 - DNA, 620 bp, Homo sapiens
  misc_feature: GYAE6OF01A6AT9.13.76.G10.1.454.CMB.1.raw
  modified_base (294)..(294): a, c, t, g, unknown or other
  misc_feature (294)..(294): n is a, c, g, or t
  modified_base (323)..(323): a, c, t, g, unknown or other
  misc_feature (323)..(323): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatcacctgctctggaaataatggcagataaatatacttcctggtatcagcagaagtcaggccagtcccctgtgctggtcatttatcaagntgccaagcggaccctcgagggactcccgngagcgtattcgtctcggcctccgaacttcgtacgggaactccgacgtccctaactcctacgaccctactcgaggtccgggaactccgagggtaccttagtacggtacgtgacgggtactacgtaacttacgttacgtcgtacgtacggggtcggtaacggggtaccacggtaccgtacggtccgtaaccgtccggccccgttacgttacgtcggttacccgttacgggaacccggttacggggaaccctaacgggtcctaacccggttaccgtaacgtccgaacccggtaaccccgg

SEQ ID NO: 183065 - DNA, 728 bp, Homo sapiens
  misc_feature: GYAE6OF01B3S94.13.76.G10.1.454.CMB.1.raw
  modified_base (454)..(454): a, c, t, g, unknown or other
  misc_feature (454)..(454): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtcgccagtgtgaggtgcagctggtggagtcgtgggaggaggcttgatccagccgtcgggggtccctgagcctctcctgtgcacgtcctcgttcgggttccaccgtcacgtccactacctacatgacgcgtcgggtcccgcgaggccgtaccggaggggagggctgggagtcggtcgttctttacgttttagtttacgtaggttaggttggtaagttactacgttaccgtcccgacgtaacgtccgttccgggtaggtaacggggtcctacttccaacccgtnttaccgtaccaagtactaacctaacgttacccaaagaacccgtcgttctttagttttaccttaacgaaattcggaactacgcctaggacgacgaccgtagtaccggaacgtccgggtaccttacgggtttactaccggtggtacgacggtaacggacggtaacggtccccggggaacccttaacggttaaacccggttcgtaacccgggcgttttaacgggccgggttaccggtacccgggtacgggggtaaacccggaaccgggtaccccggg

SEQ ID NO: 183066 - DNA, 628 bp, Homo sapiens
  misc_feature: GYAE6OF01BEO7O.13.76.G10.1.454.CMB.1.raw
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccagcatcactgctctagaaataatggacagataatatacttctgtatcagcagaagtcagcctacgtcccctgtcgcgtcggtcatctatacaaggactcgaccaacggccggaccctcggacgggtacctcccgtaggacgtcgtacgttcctcgtcggtcctacgtaccgttcgtacgggaacctcgacgtccctactctacgacctactcgacggaccggaccaggtctagtcggtacgtaggtacggctacgtacttaagttccgtcgtacgacgggtcggtagggacacggacgacgcctacggtccgtaccccggtacgttacgtccggttcgtaacccggtaacccgggtacgggtaaacccgtaccggttacccggaacccgttacccgtaaacggtcccggaacccggtaacccccgg

SEQ ID NO: 183067 - DNA, 602 bp, Homo sapiens
  misc_feature: GYAE6OF01BOTVD.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagcgtgggtcccnccgaggcctccgagggggaaggggctgggagtggcgttcttcttttatttataggtagtggtatacatactccgcagtacctccggtggacggggcctattccacctattccaccgagacgacctaacttccaaagacctacgtcttgtttacctacaaattcgaactgcctagacgacgccgatcgacgaccgggtcgttagttacttacgtgtcgacgagtacgacggtcggggaccctaaggtaaccgttacgtacgtacttacggtcgggacgtcggacgggggacccaaggggtaccccg

SEQ ID NO: 183068 - DNA, 768 bp, Homo sapiens
  misc_feature: GYAE6OF01C9XOW.13.76.G10.1.454.CMB.1.raw
  modified_base (232)..(232): a, c, t, g, unknown or other
  misc_feature (232)..(232): n is a, c, g, or t
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (358)..(358): a, c, t, g, unknown or other
  misc_feature (358)..(358): n is a, c, g, or t
  modified_base (450)..(450): a, c, t, g, unknown or other
  misc_feature (450)..(450): n is a, c, g, or t
tcagtcacgtactacacgaccggtgctcgatttagtcactcatacagggggggagaggagcccagcactgggattccgaggtgtttccattcggtgatcagcactgaacacagagactcaccatggagtttggctgagcgtggtttctgtaggctagtttaaaggtgccagtgtgaggtgcgagctggtggagtctgggaggaggcttgactccgagtccggtgggggtccngaacgctctccgtagtgacncggtcttcgtcggtaccaccgtnacgtccactaccgatagcgacgtccgtcggtccgaccgaggtccgtaccggaagggggttacggccggttaaggacgggttcncggtttccttttagtttttagttaaggttaggttggttaaggtaactacgttaaacgtccggttaccgacgtaaacgtccggtttaccgggnggggtaaccggggtccgttaaacttccaacccggttatttaaccccgacgaaccggtaaacgtaaccgtaaccgttaacccgaacgtaaaaccggtccgttaacgtttcggtttttacaaacgtaacgttagaaaccgtcgttccgtaaggaacgtccggaaccggttcaggtaccggacccgggtttacaggttttaccgtagtcggacggtacgtagggaaccgggttacggacccggtaaccgtaaactttacggactttacccggagtcgtaccgggagtttccgggaacgggtaccccggaaggttaccccgg

SEQ ID NO: 183069 - DNA, 819 bp, Homo sapiens
  misc_feature: GYAE6OF01DNPUX.13.76.G10.1.454.CMB.1.raw
  modified_base (341)..(341): a, c, t, g, unknown or other
  misc_feature (341)..(341): n is a, c, g, or t
  modified_base (355)..(355): a, c, t, g, unknown or other
  misc_feature (355)..(355): n is a, c, g, or t
  modified_base (604)..(604): a, c, t, g, unknown or other
  misc_feature (604)..(604): n is a, c, g, or t
tcagtcacgtactacacgaccggtgctcgatttagtcactcatacaggggtcgtgggaggacggagcccagcactgggattccgaggtcgtttccattcggtgacccctcgacgcactgaacacagaggtactcaccagtgggtagttttggctagagtcgttagggttttacctttgttgtacttaagttttaaaaggtcgccctaagtcgtaggacggtgcgacgccgtaggtgtacgtcgtagggaggaggtacttagacgtccgacggccggttacgggggtcccgtgacgtccttcgttccgtgtcgactacgtccgtcgtcgggttaccaccgtnacgtcacctaccanatcgacgcggtcgggtccgaccgaggtccgtaccggaaggggtacgggtactaggtacgtcgtcgttactttacttttagtacgtaggttacgtaggtaaggtacagttaccgtaccgacgaacggtacgtacgggcggtacggggtacgtacttaccggacgtaacctaccgtaacgaacggtaaccgtaaccgttaacgttaacccgaaaagtacccggtacggttacttacccggttttacctaanaaaccgtcggtaaccgtacccgtacggttaccgaacggttaccgaccgggtactacgggaaaccccgtgggttaccgttacggttaaacgttccggtaaggtccgggtaacgtaagggtaaccgggtaaccggttcccgggggaaacctacggttaaaaccggtttcaccgggttaacgtaggtacccggtacggttcgggacgggaaaccccgg

SEQ ID NO: 183070 - DNA, 631 bp, Homo sapiens
  misc_feature: GYAE6OF01BE2HT.13.76.G10.1.454.CMB.1.raw
  modified_base (425)..(425): a, c, t, g, unknown or other
  misc_feature (425)..(425): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccaggcctccgaggggaaggggcgtggagtgcgtcttcttttatttatagtagtggtagtacatactcgcagctcgtggacggggccattccacctatcctccaagacgactaattcccaaagaaccncgtacttgttttactacaaatcgaacacgcctagaagacgaccgatacgaaccgacgggtacccgttagttaactttacgtggtaggaccggaagtaggacgggtccggggacccctaacgggtaaaccgtttaccgtaaccggtaccttaaggtacggggaaccgttccgggtaccgggggacccgaaacgggggtaacccccgg

SEQ ID NO: 183071 - DNA, 716 bp, Homo sapiens
  misc_feature: GYAE6OF01CABI1.13.76.G10.1.454.CMB.1.raw
  modified_base (292)..(292): a, c, t, g, unknown or other
  misc_feature (292)..(292): n is a, c, g, or t
tcagtcacgtactacacgaccggtgctcgatttagtcactcatacaggggctgggcctcaggaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctcgtggagataaagttgggggataagttgcttcgtgtatcagaagagccaggccacgtccccgtgtcggtggtactatttancgtaagacgtaaccaaaccggccctacgaggtactcccgtaggacgcgtattccgtcgtcggtcctaccgaacgtcgtacggtaacctcaccgcctactccgtacgaaccgtactacgacggacccggggaaccctagggtaccgtagtacgggtactcggtaacggcgtacggttaacttaagtttaccgtaggttaccgacggggtccggtacggggaaccgtacgacgacgtacccgtaccgtaccggtaccccgtacttaccgtttacgggttcccgttaaccgggtaaaccggttacgggtaacccgtaaacgggttaccccgtaccggttaaccccgtaacggtccctaacccgggaccccgaaacccgggaccccctaaacccccggtaaccttcggtacccttaaccgttaccccg

SEQ ID NO: 183072 - DNA, 579 bp, Homo sapiens
  misc_feature: GYAE6OF01B0QUW.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctcgggtccgccaggctccgaggggaaggggctggagtgcgtcttctttattatagtagtggtagtacatactccgctagacctcggtaggacggggccattcacctatccctacagacgacaacttaccaaagaacacgcttgtttaccttacaaatacgaacacgccctagacgagcccgagtacgaaccgacgggtccgttgttaattacgtgtggccgaggagaggtacggggccctaaggtaacgttaccacgtactagtcgggacgtcgcggggcccaaggggtacccg

SEQ ID NO: 183073 - DNA, 327 bp, Homo sapiens
  misc_feature: GYAE6OF01AM1VU.13.76.G10.1.454.CMB.1.raw
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (317)..(327): a, c, t, g, unknown or other
  misc_feature (317)..(327): n is a, c, g, or t
tcagtcacgtactacacgaccggtgctcgatttagtcactcatacagggcttctaatcgggactctggggtcccagagagattcagcggcagtgggtcaggcacttatttcacactgaaaatcgacagggtggaggctgaggatgcgtggggtctattactgcatgcaagctacacacgtcggccctccgctcacccgttcggccgaagggacacgactggagatagaacgactgtggctgcaccntctgtctcactcctcccgccatctgatagtacgngacgtgacggcgggctcggacgacggtcgcaagtagnnnnnnnnnnn

SEQ ID NO: 183074 - DNA, 583 bp, Homo sapiens
  misc_feature: GYAE6OF01DY1W5.13.76.G10.1.454.CMB.1.raw
  modified_base (288)..(288): a, c, t, g, unknown or other
  misc_feature (288)..(288): n is a, c, g, or t
  modified_base (404)..(404): a, c, t, g, unknown or other
  misc_feature (404)..(404): n is a, c, g, or t
  modified_base (488)..(488): a, c, t, g, unknown or other
  misc_feature (488)..(488): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctagaaataatgacagataaatatacttctagtatcagcagagtcaggccacgtcccctgtcgctggtctatctancaagatcgacaagccgtcctcgacggactccgtgacgcgtattctcgtcggcctacctaactcgtacggactcgacgcctactctacgacctacgtacgacggacccgggaacccncggtacctaggtggacgtggacggtctagtaacttagttacgtgtacgaggtcggtgggacacgcgacgcctacccgtcccgtntacgtccgttaccggtacggtaacggtcgggtaaccgtacggtcccgtaacccgttacgtaaccggacccaccggacccgaacccggtaaccccc

SEQ ID NO: 183075 - DNA, 622 bp, Homo sapiens
  misc_feature: GYAE6OF01AVNR9.13.76.G10.1.454.CMB.1.raw
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
  modified_base (449)..(449): a, c, t, g, unknown or other
  misc_feature (449)..(449): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactcgtcctgtgcagcctcgtggttcaccgtcagtcacacctanatgagctgggtccncaggcctacgagggaacgggctggagtgcgtcttacttttatttagtagtagtggtactacactaccgtccgactagacgtccggtaggacggggcctataccgacctntcctacgagagaactaacttaccaagaacacgtcttagtttctaanaaatgaacacgtcctaggacgacgccgaatacggaaccgccgggtaccgtagttacttacgtcgtacggacgtagacggtaggtaccggggacccctaacgggtaaccgtttacgaccgtacgttacgtacgggaccgttcgtacgggggtaacccgaacggggtaaccccgg

SEQ ID NO: 183076 - DNA, 637 bp, Homo sapiens
  misc_feature: GYAE6OF01AWIVF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccagccgtggggggtccctgagactctcctgtgcacgcctcgtcgggttcaccgtcagtcacacctacatgagcgtgggtccgccgaggcctccgaggggaagggcgtggagtgcgttcttcttttattagtagtagtggttagtactatacctccgctagaccgtccgtggacggggtcctattccgaccatcctaccaagacgtaacaacttcccaaagaacctacggtcttacggttttactacgtaaatcgaaacctacgccttaggacgtaacggaccgatacgggaaccgaccgggtccgttagttacgtttaacgtggtacggacggtagtacggaggtccggggacccctaaggtaaccggttacacggtactacgtcgggtacgtacgggacgggtaccgaaggggtaccccg

SEQ ID NO: 183077 - DNA, 678 bp, Homo sapiens
  misc_feature: GYAE6OF01DEJR4.13.76.G10.1.454.CMB.1.raw
  modified_base (287)..(287): a, c, t, g, unknown or other
  misc_feature (287)..(287): n is a, c, g, or t
  modified_base (403)..(403): a, c, t, g, unknown or other
  misc_feature (403)..(403): n is a, c, g, or t
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
  modified_base (657)..(657): a, c, t, g, unknown or other
  misc_feature (657)..(657): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatgggagttttggctgagcttgggtttttccttgttgtcttaattttaaaaggtcgtcccagtgtgaggtgcagcgtggtggagtcgtgggaggaggcttgatccagccgtgggggtccctgacgactctcctgtgcacgccttcgtgggttaccaccgtnacgtccaacctacctacagtgacgccgtcgggtccgcccaggcctaccggaaggggagggctgggattgcgttacttcttttaagttataggtagtggtagtacagtacctccganaacgctccggtaggcgggacctatccaaccgtntcctaccgagaacgtactaaacgttccaaanaaaccgtagtccctttagtttactaaccgtaaagtacgtaaccgacgtaccgtaggacgtaacgcccaaagtcgaaccgtaccggtcgttaacgttacttcgaggttacgacgggtaagaacggtacggaccgggtacccgtaaaacgggtaaacctttaaccgacgtacggttaacgtagggttaccgngggtccggggaaaaccccggg

SEQ ID NO: 183078 - DNA, 883 bp, Homo sapiens
  misc_feature: GYAE6OF01ANG5L.13.76.G10.1.454.CMB.1.raw
tcagtcacgtactacacgaccggtgctcgatttagtcactcatacaggggggaggaggagcccagcactgggattccgaggtgtttccattcggtgatcagcactgaacacagaggactcaccatggagttttggctgagctgggtttccttgttgctattttaaaggtgcccagtgtgaggtgcagcgtgggtggagtcgtgggaggaggcttgatccagccgtgggggtccctgagacctctccgtgtcgcagcctcgtgggttccaccgtcagtccacacctacatgagcgtacgggtccccgcgaggtccgtccggaagggggtaacggggtccgtggggacggttcggaccggttccgtttacgtttttaatttacggttaaggttagggttagggttagtaaccgtacgttaaccgtcccggtacgtaaccggtacccgttaccgggtacgggtaaccgggggggtacctaaccgtttacccgtaaacccgtaccttacccgtaacccgtaaggtaacgaaacccgttaacgtttaaccccgaaaacggtaaacccgtaaccggtaccgttttaccgttttaccgtaaccgtaaacgtacgtaaaccgtacgaccgtttaagggaacgaccgggtacccgtaaggtaccggtaacccggaacccggggttacccggttacggtttaaacttacccggttaggtacgggtaaccggtaaggaaaccgggttaccggggtaaccccgggggtaacccccgttaaacgggttaaacccggtttacccgtaaaccggttacccttaagggttaccggggtaacccgggtttacccgggacccgggggtaacccgggttaaacccgggggtaaccccccggg

SEQ ID NO: 183079 - DNA, 853 bp, Homo sapiens
  misc_feature: GYAE6OF01DLHBS.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgctattttaaaaggtgcccagtgtgaggtgcagctggtggagtctggaggaggcttgatccagccgtggggggtccctgagactctcctgtgcagcctcgtgggttccaccgtcacgtcaccacctacatgacgtcgtcgggtcccgccgaggcctaccggaagggggaacggggcgtagggacgtcggtccgtttcttttactttttaatttagttaggttaggttgggttaacgttactaacgtaccgtacccgacgacgtacccgttccgggtacgggacgggggtccctaacgtttcccaacccgtacttcccgttacccgaaggtaaccgtaaccttaaacgtttacccgaaaacggtaaacccgtaccggttacttttacggttttacctttaaccgtaaaagttaccggaaaaccgaccggtacccgttaggaaaccgggtaccggtacccggtaacgttaccgggaaaccccggtaccggggttacccggtttaaggtttaaccttttaaccggttgggttacggaaccgggtaaacggtaacgggtaacgggttacccggggggaaaccccctaaaccgggtttaaaaccccggtttaacccggttaaccgtaccggtttaaacggttccggggtaaacccggtttccggggtaacggggggaaccccgaaacgggggtaaacccccgg

SEQ ID NO: 183080 - DNA, 830 bp, Homo sapiens
  misc_feature: GYAE6OF01EWEW6.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagtttttggctgagtcgttgggtttttccttgtttgtacttaagtttttaaaaaggtcgccctagtgtgaggtgcagcgtggtggagtcgtgggaggaggtcttgactccgacggccggttcgggggtccctggagtacctctccgtgtgcgacgtcctcgttcggttccaccgtcacgtaccaacctacctacagtcgacgtcgtcgggtcccgccgacggccgtaccggaagggggaacggggtcgtagggagtcggtcgtttctttactttttaatttaagttaaggttaggttaggttaacgtacgtacttaccgtcccgactacgtaccgtccggtagggacggggtaccctacgtttaccaaccctacttacccgtacgaagaccgtaaacctaacgttaacccgaaaacgtaaccctacgttccgtttacgttttacccttaacgtaaaagttaccggaaacctacggttaccgtaagggaaccgtaccgaccggttaacgtaccgggaacccgtacccggggttacctttaaggtttaaccgttaaccggttggtacggaaccgggtaaggtaacggtaccgggtaccccggggtaaccccttaaaacggggttaaccctttaaccggaccgttaccgtacggttcgggtacccgttacgggacccggggaaacccgtaaaccggggtaccccg

SEQ ID NO: 183081 - DNA, 628 bp, Homo sapiens
  misc_feature: GYAE6OF01DXYBH.13.76.G10.1.454.CMB.1.raw
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcaccacctacatgacgcgtcgggtcccgcgacggcctaccggaaggggaagggggctgggacgtgcttcttctttttaattataggtagtggtagtacatactccgcagactccgtggacggggctatcgaccatcncagaanactaatacaaagacacgtcttgtttacttacaaattcgaaacacggtacctaggacgtaacgccgtaatacggaaccaacgggtccgttaggttaacttacgtgtcgacggaagaaggtaggtccgggggacctaaaccggtaaccggtttaactacggtactaacggtcgggaaccgttggtacggggggacccgtaaacggggaaaccccg

SEQ ID NO: 183082 - DNA, 673 bp, Homo sapiens
  misc_feature: GYAE6OF01CXCM1.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccgaggacagacacgccagcatccacctgctctaggaaataagtggacagataaatactacgttcctagtatcagacaagtaacgtcgacggccacgtcccctggtcgtaccgtggtctactacgtactacaagactcgaacccgtaacggcccgggtccccttacggaacgggtacctcccgtaggtaacgtcggtaaccttcgtcgtcggtcccttaacgaaccgttcgtacgggtaacctccgacgtcctaactccgtacgaccctaacgtccgaacggtccccgggtaaccgtacggtacgtacgtagggacgtacggacggtctacgtacttacgttacgtcgacggtaggtacgggtaggacgacgacacgtccgaccgtcgccccggttatacgttccggtacccgttacggaaccggtcgggtaaccgtaccgggtaccctaacccggttacctacggtccgaacccggtaacccccg

SEQ ID NO: 183083 - DNA, 735 bp, Homo sapiens
  misc_feature: GYAE6OF01AYJGL.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtcttattttaaaaggtgccctagtgtgaggtgcagctggtggagtctgggaggaggcttggactccgaggccgtggggggtccctggacgtactctcctgtcgcacgcctcgtcgggttcaccgtcacgtcacactacatgagcgtcgggtccgccgaggcctaccggaggggaacgggcgtgggagtcggtcgttacgtttacttttagtttagtagttaggtaggttacgtaactaattaccgtccgacgtaacgtaccgttccggtaggacgggggtaccctacgtttcccgaaccgtactacccttaccgaacggtaacgtaacctaaaccgttaacccgaaaacgtaaccctaccggttctttacgtttttaccctaacgtaaaacgttcggaaacctacggtacccgtaaggtacgaaccggccgtaacgtcggaacccggtaccgggttccgttaagttccgtttaacgtggtacgacgaggtacgacggttaccgggacccgtaaggtaacccgttacgtacgtacgttacgtcggtaaccgttcggtacgggaccgtaacggtacccgg

SEQ ID NO: 183084 - DNA, 649 bp, Homo sapiens
  misc_feature: GYAE6OF01CG3R9.13.76.G10.1.454.CMB.1.raw
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctacatgagcgtgggtccgccgaggcctccgaggggaggggcgtgggagtggcgttcttcttttatttagtagtagtggtagtacatactccgcagtactccggtggacggggcctattccacctatcctccagacgaactaacttaccaaagaacctacgtccttagtttacttacaaaattgaaaccgagtcccgttagaacggaccgacgacgtacggaaccggtaaccgggtcccgtagtttaacgttactcgggtacgacggtaggaggtacggtacggggtcccccaaacgggttaaaccgttacgtaccgtcgttaaggtccgggaaccggttccggtacgggggaccgtaacggggtaaccccg

SEQ ID NO: 183085 - DNA, 774 bp, Homo sapiens
  misc_feature: GYAE6OF01DN9W3.13.76.G10.1.454.CMB.1.raw
  modified_base (298)..(298): a, c, t, g, unknown or other
  misc_feature (298)..(298): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataatggacaagataaatatacttcctggtatcagcagaagtcaggccagtcccctgtgctggtcatctatcaagntgaccgaagcccgccctacgacggtactcccgtggacgtcgtactttccgtacgtcggaccttaccgaacgttccgtagggaaaccttcgaaccggtccctaccgttacctaccggtaacccaacgttacccggaaccggggtaccccgggaacccgtaacggggtaccctttaacgggtacggggtaaacgtacgggtaaccggggccgtttaacggtaaccctttaacgtttaacccggttaccgggttaccggtaaccgggggttccggggtacggggtaaccgttaacgggacccgtacgggacccgttaaaccccggtccggtaccccggttacgtttaacggttaccggttttaccccgggtacccgggttaaaaccggttcccggggtaaacccggttaaaccgggtaccccggttaaccccgttaacccggttaaccggttacccgaacccgggtaaaacccccccgg

SEQ ID NO: 183086 - DNA, 650 bp, Homo sapiens
  misc_feature: GYAE6OF01DVNEW.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtctggaggaggcttgatccagccgtgggggtccctgagctctcctgtgcacgcctcgtcgggttcaccgtcagtccactacctacagtgagtcgtcgggtccgccgacggccgtaccgggaggggaacggggcgtgggagtcggtccgttctttacttttaatttagtaggttaggtggtacgtactatacctccgactaggtaccgtccggtaggacggggtccgtattccaacctactaccgtcgaagtaacgaactaacgttaccaaagaactcgtaccttgtttactacaaatcgaactacgtccgtagaggacgacgatacggaccgtacggtccgttagttacttacgtggtacgacgaaggacgtaggtcccggggaaccctaaggtaaccttacgacgtacttaggtcggaaccggtcgacgggggaccaacgggtacccg

SEQ ID NO: 183087 - DNA, 762 bp, Homo sapiens
  misc_feature: GYAE6OF01EL6O0.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctcctgtgcagcctctgggtcaccgtcagtcacacctacatgagcgtgggtccgccgaggcctccgaggggaaggggctgggagtgcgttcttctttttattagtaggtagtggtagtactatactccgcacgacctccggtaggacggggtccgtaactttccgaaccctacttccctacccgaaggaacgtaacctaaacttaccccgaaaagtaacccaccggttaccttttacgttttaccttaaccgaaaagttcgaaaccgtacggtaccccgtagggaacggaccggacccggtaagttaccgggaacccggtaccggggttccgttaaggttaacgttttaccgtagggttaccggacgggtaaacgggacgggttaacccgggtaccggggggtaacccccccttaaaggggttaaaaccccggttttaacccgaacccgggttaccctttaaacggggttaccggggtaacccgggtttcccggggtaccggggggtaaaacccccgggg

SEQ ID NO: 183088 - DNA, 697 bp, Homo sapiens
  misc_feature: GYAE6OF01AE2KM.13.76.G10.1.454.CMB.1.raw
  modified_base (270)..(270): a, c, t, g, unknown or other
  misc_feature (270)..(270): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgctattttaaaaggtgcccagtgtgaggtgcagctggtggagtctgggaggaggcttgatccagccgtgggggtccctgagactctcctgtgcagcctcgtgggttcaccgtnacgtccacacctacatgacgccgttggggtcccgccgacggcctccggaaggggacggggcgtgggagtgtccgttctttcttttaatttagtaggttaggtggttacgttaaccgattaccgtccgaccgtaggtacccgttccggtagggacggggtcccgtactccgaccctactcctacccgaagaccgtaaacctaattaccccgaaagtaacccgtaccgttctttacgttttaccctaacaaaagttcgaaaccgtacgtcccgtaggacgtacgccgtagccgaccgtaccggtcgttagttacttacgtggtcgaggagtacggtagggtcccggggacccctaacggtaacggttaccgtaccggtacgttaggtacgggtcgtacgggtccggggaacccggaacgggtaccccgg

SEQ ID NO: 183089 - DNA, 665 bp, Homo sapiens
  misc_feature: GYAE6OF01BQXKG.13.76.G10.1.454.CMB.1.raw
  modified_base (486)..(486): a, c, t, g, unknown or other
  misc_feature (486)..(486): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttctaccgtttagtacgctagttggatgagcgtgggtcccgccgaggcctccgaggggaaggggcgtgggaggtggggtcggaccaaacgaataaaggcgtaaaggttggaagtgaagtaaatactaagtggtggacttgtggtaggaacgggccgtattccacgtactctccaagacgaacaacgccaaagaactcactgtactcgtagaacctaaagtcgaaacncgaccgtagaacgacggtacccggaagggacccgtacgggcctttaggtccttaaagtttccggtaggttgacgggtaagggtcggtaaggggttttagggggggaacccgggtaaaagggtttaagaacgggcgtaacggggtagggtacccctaaaacggttttacccggtttaaag

SEQ ID NO: 183090 - DNA, 593 bp, Homo sapiens
  misc_feature: GYAE6OF01BQIWY.13.76.G10.1.454.CMB.1.raw
  modified_base (357)..(357): a, c, t, g, unknown or other
  misc_feature (357)..(357): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaagggctggagtgcgttctcttttattatagtagtgtagtacatactcgnagactcgtgacggggccattcgaccatctccagagacaattccaagaacacgtcttacgtttctacaaatgaaacacgtcctagagacgaccgagtacgaccgacgggtcccgtagttaacttacgtggtacgacggtaagacggtagtccgggggacccctaagggtaaccgtttaacctaccgcgttaacgtcgggacgttcggtacggggggccctaaacgggggaacccccg

SEQ ID NO: 183091 - DNA, 682 bp, Homo sapiens
  misc_feature: GYAE6OF01BONGH.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctgagactctcctgtgcacgcctcgtcgggttcaccgtcagtcaccacctacatgacgcgtcgggtcccgccaggcctccgaaggggaaggggcgtgggagtgcgttctttacttttatttagtagtagttggtagtacactacgtccgcagaccgtccggtaggacggggtcctagttccaacctactcctaccgaggaacgtaacctaaacgttacccgaaaacgtaactaccggtctttagttttaccttacgaaaattcgaaacctacgtccgtaaggacgacggcccgaagttccgaaccgtacgggtccgttagtttaacgttcgtaggtagaccggtagaggtacggttacccggggaccctaaaccggtaaccggtttaccaaccggtctaacggtcgggtaacccggttccgggtacgggggacccgaaacgggggtaacccg

SEQ ID NO: 183092 - DNA, 812 bp, Homo sapiens
  misc_feature: GYAE6OF01CB8BI.13.76.G10.1.454.CMB.1.raw
  modified_base (284)..(284): a, c, t, g, unknown or other
  misc_feature (284)..(284): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttggggtttttccttgtttgtcttaagtttttaaaaggtgcccagtggtgaggtgcagcgtgggtggtagtcgtgggaggaggtcttgactccgacggtccggtcggggggtccctgtacgtccttcctccgtgcgacncgtccttcgttcgggttccaccggtcacgttaccacctacctacagtcgacgtcggtcggccgccgacggcgtaccggagggacgggtgtagggtagtcgtcgttctttacgtttttaattacggttaggttaggttaggttaacgtacgtaaccgttaccgtaccgtacgtaaccggtaccgttacgggtacgggtacggggttacctaaccgttacctaccgtaacttccgtaccgaaggtaaccgtaacgttaaaccgttaacccgaaaacgaaccgttaccgttcgtttactttaaccgtaaacctaaacgttacgaaacctcgggtactacgggtaacggtaacgtaccggtaacgttaacccgaccggttaccggttacgtttaagttacgtttacccggtagtaccgggaccggtaagttaacggggacccggtttcccgggaaacccggtaacgttaacccgttaccggtacgtaacgtacgggtaccgggtcggttaccgggtcggggtaaaccccggg

SEQ ID NO: 183093 - DNA, 616 bp, Homo sapiens
  misc_feature: GYAE6OF01C4MWK.13.76.G10.1.454.CMB.1.raw
tcagtcacgtactacacgaccggtgctcgatttagtcactcatacaggggagaggagcccagcactgggattccgaggtgtttccattcggtgatcagcactgaacacagagactcaccatggagtttggctgagctgggttttccttgttgcttattttaaaaggtgcccagtgtgaggtgcagctgggtggagtctgggaggaggcttgatccagccgtggggggtccctgagactctcctgtgcagcctcgtgggttccaccgtcagtcaaccacctacatgacgtcgtgggtccccgccgagggcctccggaaggggaaggggctgggagtggtccgttctttctttttaattagtagtggtaggtatacatactccgacagtacctccggtggacgggggcctaagttccacctatcctacaagacgaactaacttaccaaagaacacgtcttacgtttcttacaaatacgaacagcctagacgagccgatacggaccgacggtcgtagttacttacgtcggtcgacggagagtacggtaccggggaccctaacggtaaccgttacgtacgtctaggtacggacgtagacggggcccgaacgggtaacccg

SEQ ID NO: 183094 - DNA, 954 bp, Homo sapiens
  misc_feature: GYAE6OF01B2W5J.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagagactcaccatggtagttttggctgagtcgttgggtttttccttgttgtactttaaagtttttaaaaagggtcgacccgtaggttggttaggaagggtcgcgaggtcgttgggtggtagtcgtgggaggaggtcgttgactccgacggtccggtcgggggtccctaggacgtacctcctcgtgtcgcacgtcctcggttcggttaccaccgtcgacgtccaactaacctacagtacgacgtccggtccgggtccgaccgacggtccgtaccgggaagggggacgggtcgtagggtacggtcggtaccgtttacttttacgtttttaagtttaagttaaggtttacggtttaggttaaccgttaacttaacgtacccgtacccgtacgtaaccggttacccggttaccggggtacggggtacccggggtacccgttaacctttacccgaaacccgttaccgttacccgtaaccggaacgggtaaccgtaaaacttaaacccgttaacccggaaaacgttaaaccccgtccgggttttacttttacgtttttaaccccgtaaataaaacggttaccgaaacgtaccccggtaccgttaaggggaaacggtaccccgggtaacccgtaaggtttaacccggtaaaccccggtcccggggttttaaccggttattttaaacccgtttggggtacggttaccggggaaagtaacggggttacccggaccgggggttaaccccgggaaacccgtaaacggtttaacccgttagaaccccggttgtaaacgggtacgggttacccgggtacggggtaccggaaacccgggtaaacccgggtaccccgg

SEQ ID NO: 183095 - DNA, 637 bp, Homo sapiens
  misc_feature: GYAE6OF01D21QX.13.76.G10.1.454.CMB.1.raw
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttttaaaaggtgcccagtgtgaggtgcagctggtggagtctggaggaggcttgatccagcccgtggggggtccctgagacctctcctgtgcagccttcgtgggttccacccggtcacgtccaccacctacatgagcgtgggtccgccgaggcctccgaggggaacggggctgggagtgcgttcttcttttattatagtagtgtagtacatcgtccgnacgcctcggtggaggggcctatccaacctntcctacagtaacactaacttacccaaagaaccacgtcttcgttttacctactaaagtcgaacgacgtcgtagaacggacgaccgaagtcgaaccgaccgggtcccgttagttacttacgtgtacggacgtaaggacggtacgggtaccgggacccaaaccggttaaaccgttaccgtaaaccgtcgttaagttccgggaaccggttccgggtcggggaaaccccggg

SEQ ID NO: 183096 - DNA, 655 bp, Homo sapiens
  misc_feature: GYAE6OF01CCQOY.13.76.G10.1.454.CMB.1.raw
  modified_base (105)..(105): a, c, t, g, unknown or other
  misc_feature (105)..(105): n is a, c, g, or t
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (252)..(252): a, c, t, g, unknown or other
  misc_feature (252)..(252): n is a, c, g, or t
  modified_base (274)..(274): a, c, t, g, unknown or other
  misc_feature (274)..(274): n is a, c, g, or t
  modified_base (317)..(317): a, c, t, g, unknown or other
  misc_feature (317)..(317): n is a, c, g, or t
  modified_base (347)..(347): a, c, t, g, unknown or other
  misc_feature (347)..(347): n is a, c, g, or t
  modified_base (538)..(538): a, c, t, g, unknown or other
  misc_feature (538)..(538): n is a, c, g, or t
  modified_base (559)..(559): a, c, t, g, unknown or other
  misc_feature (559)..(559): n is a, c, g, or t
tcagtcacgtactacacgaccggtgctcgatttagtcactcatacaggggctgggcctcaggaagcagcatcgggaggtgcctcagccatggcatggactccctntcttcctcggcgtccttgcttatgcacaggactccgtggcccttcctagtgacgctgactcacgcccacctcgagttcgtccgtcgaccccaggacagacagccagcattcaccgtgctntaaggaataatcggacanaataaactntacgttcagatcagctaagaanccgaaggcctcgtccctgtcgcttaggccattcatcggaaagntcgaccgagccggttccacggagggttccnccgtgaacgtcgtactttccgtagcggaacctacccgaatttccggtaacgggaactcaaccgccttcccttacacgggaccttaacgcgaacgggacccggaacccgaaggttcgtaggttagggtaagtccgaacgggtcctaggtaactttaccttacgcgggttagcgggtaacccggtggggaacnccgacgacgccgtttaaccgnggccccttatacgtttacggttccccgtaagggtccggaacgggaccttaaccgggttcctaacccgtaccgttacgccgggaccaaacccccggg

SEQ ID NO: 183097 - DNA, 638 bp, Homo sapiens
  misc_feature: GYAE6OF01EC17F.13.76.G10.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgactccgaggccggtcggggggtccctgacgaccgttcctccgtgtgcacgtccgtcgttggttccaccgtcacgtccacacctacangacgtcgtcggtccgcgacggccgtacggaggggacggngtggacgtgtcgttcttattttagttatagtagtgtacgtacatcctcgcagctcgnggacggcntaccactactcacgaagactaacaacttacccgaaagaactcgtacgtttcgtttactaacgtaaagtcgaaaccgtcgtcctaggaaggtacaccggtatacggaccgtacggtccgttgttaatcgtggcggaagtcggagtcgggtacccgggaccttaaacgtacgtttacccgagtacccggttaggcccggtaaacggtcggtaaccggggacctaaccggggg

SEQ ID NO: 183098 - DNA, 651 bp, Homo sapiens
  misc_feature: GYAE6OF01C2FRU.13.76.G10.1.454.CMB.1.raw
tcagtcacgtactacacgaccggtgctcgatttagtcactcatacaggggggcctggggcctcaggaagcagcatcggaggtgcctcagccatggcatggatccctctcttcctcggcgtccttgcttactgcacaggactccgtggcctcctatgagctgactcacgccacctcagtcgtccgtcgtacccgaggacacgacacgccagcctactccaccgtgtacctacgtaaggtaaaattaagttcgggacaagtaattaaaatacttactttccgtaggtactacaagacgaagaacgtacgacggtaccacgtcccctgtcgtcgtagtctatactatacgaagtacgtacgaccgaacggcccggtacccgtacggacggtacctccggtacgacgtcgtacttcgtacgtcgacctaccgtacgttacgacggtactcgacgtacctacgtacacgacctacggtacgaccggaccggaccgtaggtcgtaggtcgtaaggtggtacgtcttacgtaactttacgtcgtacggacggtacgggtacggtacggacgacgacgacgcgtaccgtcgaccgtatcggtactacggtacggaccgtacggacgtaccggtcctaacgtcgacgccgaaccgtaccg

SEQ ID NO: 183099 - DNA, 730 bp, Homo sapiens
  misc_feature: GYAE6OF01BWVXT.13.76.G10.1.454.CMB.1.raw
  modified_base (170)..(170): a, c, t, g, unknown or other
  misc_feature (170)..(170): n is a, c, g, or t
tcagtcacgtactacacgaccggtgctcgatttagtcactcatacagggggggaagcctgggaacacttagccttcatgagtgtccccaccatggcctggatgatgcttctcctcggacttccttgcttatggatcaggagtggattctcagactgtggtgacccagganccatcgttctcagtgtctccgtgggaggacagtcacactcacttggtgcttgagatacggctcagtctctagtacgttacctacccagctaggtaccaacacgaccccaggccaggcctccgcgcacgctcactacctacaacaacaaacacctctccttcttcgtcgggtccctcactcgtcttctcgtcggtcctcctacttcccgttagggaaacctaaacggtccttaccggtaccctttacgtacctaacggtcccgggaacccgggggtacccgacgggtacgaaaggaaacgtacgtaggtaacttacgtagtttaatttaactttacgttgtttacgtttttactttaagttaggtttacgggttacgttacgtcctttagtttcgttacggtcgttgggtttcgggtaccggggtacgggacccgggtaccccggtacccgggtccggttacccggtaccccggtttcccggtacccggggttacccaaaccccgggtaccccggtaaacgggtccccgttacccggtcccccgttacgggttaccccggg

SEQ ID NO: 183100 - DNA, 783 bp, Homo sapiens
  misc_feature: GYAE6OF01CTV06.13.76.G10.1.454.CMB.1.raw
  modified_base (209)..(209): a, c, t, g, unknown or other
  misc_feature (209)..(209): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgcttatttaaaggtgcccagtgtgaggtgcagctggtggagtcgtgggaggnggcttgactccgacgtccggtcgggggtccctggacgtaccttcgtccgtgtcgccgacgtccgttcggtcggttaccgacccgtcgtacgttcaaccgtacctacagtcgacgtccgtcgggtcccgaccgacggccgtaccgggaaggggaacggggcgtgggaggtcgtccgttctttacgttttaatttacgtaggttacggtaggttaacgttactaacgttaccgttccggacgtaacggtacccgttcgggtacgggacggggtccctattcccgacctacgtcctacggaagaacgtaccttaaacgtaccaaacggtaacctccgtcgttttacgtttacctacgtaaaaagttccgaaaccgcgttacccgtaggaacgaccgtcggtaaactaccggaaccgacccgggttcgttagttacccgttaggtcggaggtaaccggaaggtaccggtagggtccccgggtaaaccccgtaagttaaacccgtttacggtaccgttccgtaacggttcccgggtaacggtccgggtaaccggggaacccggtaacggggtaaccccg

SEQ ID NO: 183101 - DNA, 573 bp, Homo sapiens
  misc_feature: GYAE6OF01ETZUP.13.76.G10.1.454.CMB.1.raw
  modified_base (170)..(170): a, c, t, g, unknown or other
  misc_feature (170)..(170): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctggaaataatggacagataaatatacttcctggtatcagtcagaagtcaggccacgtcccctagtgctggtccagtctatcaagntgaccaagccggcctgacgggtactcccgtgacgcgtacttcgtctggcctaccaacgtcgtacggacctcgacnccctactctacgaaccatccgacggtcccggggaacccagggtacttacgagggatggacggtctaggtaccttagtactgtacgaggtcgtaggactggcgacgcctagcccgacccgattcgtcgttaccgttaccgggaactacggggaaccctaacgggtcctaacccggtaacctacggccgaacgtaacccccgg

SEQ ID NO: 183102 - DNA, 784 bp, Homo sapiens
  misc_feature: GYAE6OF01CK1O0.13.76.G10.1.454.CMB.1.raw
tcagtcacgtactacacgaccggtgctcgatttagtcactcatacgagggggggggggctgagcccttctctggaaaccacacagctcctcctgcagcagcccctgactgctgatttgcatcacgggccgctctttccagcaaggggataagagaggcctggaagaacctgcccagcctgggcctcaggaagcagcagtcggaggtcgcctcagccagtggcagtcggactcccctctcttccgtcggccgtccttgcttactcgtcacgaggtactccgtcggtccctaccgtagtgacgtctgacctcacgccctaccctcacgtcgtccggtcgtccccgaggaccagacacgccagcactccacctcgctcgtcggagtaacgttaaaggtacggggtaaataaagttagtgttacgttcggtacgtaggttacgtacgaagtaccgaaaggtaaaccgacccggtaaccgggtacccgtaacccgggtttcccccgttacgggttaccggtacccggtttacgggttacccttaacgtttaacccgtttaaacgtttaaaccgaaacggtttaaacccgtaaaccccggtaaacgggtacccccggtaacccccggttaccgggtaaacccgggttacccggttaccccgtacgggtaaccggtcccggttaaccgttttcccgttaccggttcccgggtaaccccgttaacccgtaaacccggttcccggttaaccgggggtaaaccctaacccggaaccggtacccccgttaacccg

SEQ ID NO: 183103 - DNA, 647 bp, Homo sapiens
  misc_feature: GYAE6OF01B3TNW.13.76.G10.1.454.CMB.1.raw
  modified_base (248)..(248): a, c, t, g, unknown or other
  misc_feature (248)..(248): n is a, c, g, or t
  modified_base (483)..(483): a, c, t, g, unknown or other
  misc_feature (483)..(483): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctatttaaaaggtgccagtgtgaggtgcagctggtggagtcgtggaggaggcttgatccgagccgtcgggggtccctgagactctcctgtcgcngcctcgtcggtcaccgtcacgtccacacctacatgacgcgtcgggtccgcccgaggccgtccggagggggaacggggcggtgggaggtcggtcgttcgtttcttttagttttacgtagttagttggtagtacactacgtccgacacgtacctccggtaggacgggtccgattccgaccactcctaccgaagacgaacctaattacccaaagaacctacgtcttagtttacctaanaaacgtagaaccacgtacctggaacgacgacccgaagtacgaaccgtaccgggtcgttataacgttcgaggtcgacgtaagacggtagtccggggaccctaagtaacggtttccacggtcttacgggtcggtacggtggacggggaccgtaacgggtaaccccg

SEQ ID NO: 183104 - DNA, 595 bp, Homo sapiens
  misc_feature: GYAE6OF01BMSWF.13.76.G10.1.454.CMB.1.raw
  modified_base (292)..(292): a, c, t, g, unknown or other
  misc_feature (292)..(292): n is a, c, g, or t
  modified_base (388)..(388): a, c, t, g, unknown or other
  misc_feature (388)..(388): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctcgtgggttcaccgtcagtcacacctacatgagctgggtccncaggctccgagggagggctggagtgcgtctcttttattatagtagtggtagtacatactccgcagactccgtgacgggccattcaccatctcaganacaattccaagaacacgtcttgtttacctacaatgaacagccctagacgacgccgaatcggacacgggtcccgttagttactttacgtgttaggacggtagaagtacggtccgggggtaccccgaacggttaaacccggtttaccgtaccgtaccgttagtccgggacggttcccgtaggggggaccccgaaggggtaaacccccgg

SEQ ID NO: 183105 - DNA, 608 bp, Homo sapiens
  misc_feature: GYAE6OF01D9GE2.13.76.G10.1.454.CMB.1.raw
  modified_base (294)..(294): a, c, t, g, unknown or other
  misc_feature (294)..(294): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtcacacctacatgacgctgggtccnccgaggcctccgaggggaaggggctgggagtcgcgtcttcgttttattagtaggtagtggtaagtacatactccgcagacctccggtggacggggccattccacctatcctccaagacgaccaacttccaaagaaccncgtacttgtttcctanaaacttcgaactacgccctaggacgacggccgaagtcgaacccgccggtccgttgtacttacgtggtgacgaagcgagtccggggaccctaaggtaacccgtttacgaccggtcttaaaggtcgggaaccggtcgttacgggggcccacgggggtacccc

SEQ ID NO: 183106 - DNA, 633 bp, Homo sapiens
  misc_feature: GYAE6OF01CT9JN.13.76.G10.1.454.CMB.1.raw
  modified_base (170)..(170): a, c, t, g, unknown or other
  misc_feature (170)..(170): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggcagataaatatacttctggtatcagcagaagtcaggaccagtcccctgtcgctggtcatctatcaagatcgaccaaggccggtacccctacgacgggtactccccgtaggacgtcgtacttcctcgtcggccttacccgaacgttcgtacggggaaccttccgaacgccctaacctccgtacgaacctacgtaccgacggccgggaacccgaggtccgttacgtggtagtcggacggtctaggaaccttatttacgtgtaccggagggtccgggtagggaccgaggtaccgagacgtaccgtcggcccgtcgtaacgttcgtaccggtttaccgggaaccgttcggggtaaccctaaacgggtcccgtaaccggttacccgtaaacgtcccgtaaccgtaacccccgg

SEQ ID NO: 183107 - DNA, 580 bp, Homo sapiens
  misc_feature: GYAE6OF01A2ORH.13.76.G10.1.454.CMB.1.raw
  modified_base (400)..(400): a, c, t, g, unknown or other
  misc_feature (400)..(400): n is a, c, g, or t
  modified_base (411)..(411): a, c, t, g, unknown or other
  misc_feature (411)..(411): n is a, c, g, or t
  modified_base (511)..(511): a, c, t, g, unknown or other
  misc_feature (511)..(511): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgaggggaacggggctgggagtgcgttcttcttttatttatagttagtggtagtacatactccgcagactccggtggacggggcctattccacctntcctaccaganacaattaccgaaagaaccacgcttgtttacttacaaatcgaaccagcctaggagacgccgatcgacaccgggtccgtgttacttaacgtgtgcgagacgnggtccggggccctacggaaccgttcacggctaagtcgggacgttcggcggggacccgaagggtacccgg

SEQ ID NO: 183108 - DNA, 593 bp, Homo sapiens
  misc_feature: GYAE6OF01EVET7.13.76.G10.1.454.CMB.1.raw
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
  modified_base (339)..(339): a, c, t, g, unknown or other
  misc_feature (339)..(339): n is a, c, g, or t
  modified_base (430)..(430): a, c, t, g, unknown or other
  misc_feature (430)..(430): n is a, c, g, or t
  modified_base (485)..(485): a, c, t, g, unknown or other
  misc_feature (485)..(485): n is a, c, g, or t
tcagtcacgtactacacgaccggtgctcgatttagtcactcatacagggggggaagcctgggaacacttagccttcatgagtgtccccaccatggcctggatgatgtcttcctccgtcggaccttccttgtcttagtggatcgaggagtggtattctcagacttgtggtcgacccgaggacncctatcgttcnctagtgtctccgtgggaggacctagtcactactctacgttggtggtcttgagtacgtacggctcagtctcgtagtacgttaccctacccgagctcggtaccaacacgacccgacggaccgacggcctccgcgccacgcctacactnaacaaccaccaaaaaccaccttacgccttctttcctggggtcccctcgactcgcttctctggctccatccttgggacaaagctgcccttantcatcgaccggggcccgacgacgagaagatgatctgtattattacttgttgtttntttattagtgggtagtcgtctactttcgttgtcgtggttggtcggtacggtcggccgacccggtccgtcgtaccgtcccgtccggtacgacgacccgtacggcgtccg

SEQ ID NO: 183109 - DNA, 616 bp, Homo sapiens
  misc_feature: GYAE6OF01DONKG.13.76.G10.1.454.CMB.1.raw
  modified_base (493)..(493): a, c, t, g, unknown or other
  misc_feature (493)..(493): n is a, c, g, or t
  modified_base (511)..(511): a, c, t, g, unknown or other
  misc_feature (511)..(511): n is a, c, g, or t
  modified_base (513)..(513): a, c, t, g, unknown or other
  misc_feature (513)..(513): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
  modified_base (584)..(584): a, c, t, g, unknown or other
  misc_feature (584)..(584): n is a, c, g, or t
  modified_base (590)..(590): a, c, t, g, unknown or other
  misc_feature (590)..(590): n is a, c, g, or t
tcagtcacgtactacacgaccggtgctcgatttagtcactcatacaggggggagaggagcccagcactgggattccgaggtgttccattcggtgatcagcactgaacacaggagactcaccatggtagttttggctgagtcgtgggttttccttgttgacttaagttttaaaaggtgccctagtgtgaggtgcagctgggtggtagtcgtggaggagtcttgactccgagccggtcgggggtccctggacgtacctcgtccgttgtcgcgacgtcctcgtacgggtttccaccggtacagtaccactacctacagtggacgtcgtcggtccgcgaggccgtacggaggggtacgggtcgtggacgtcgtcgttactttactttaattagtaacggtgttaggtaacgtactactaccgtccgacgacgtacgtcggtggacgggcctatccactactcgtacgataacgaactagtacaaacgctcgtacttnttactataatcgaactcncngagacgcgagtcgacgtcgtctatactgtcggtnacggtanacggtgcgggacccaggtaacttcgacgtntacggngtaccgtggacggacgtcggtaaccg

SEQ ID NO: 183110 - DNA, 663 bp, Homo sapiens
  misc_feature: GYAE6OF01CVRT0.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtccacacctacatgagcgtgggtcccgccgaggcctccggaggggaacggggctgggagtcggcgttcttctttttaatttagtaggttagttggtaacgtactataccgtccgacacgacgttccggaggacggggccgtacttccacctactcctaccgagaacgaacctaacttaacccgaaacgtaaacctaccggtccgtttcgttttaccttaacgtaaagttacgaaacctacggtacccgtaggaacgacggacccgtagtacggaccgtacggtccgttagttacttacgtgtacggacgaggaacgtcggtacggggaccctaacggtaaccgttaaccgtacgtacgtacgtagggtaccggtcggtcggggtaaccgg

SEQ ID NO: 183111 - DNA, 757 bp, Homo sapiens
  misc_feature: GYAE6OF01AVT1Y.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgaacttattttaaaaggtgcccagtgtgaggtgcagcgtggtggagtcgtgggaggaggcttgatccgaggccgtgggggtccctgacgactctcctgtgcagtcctcgtgggttccaccgtcacgtcacacctacatgacgcgtgggtcccgccgaggcctccggaggggacgggcgttgggacgtgccgttcgtcgtaagtttatttacgtcggtaccggtacggtcgaccctaacgtacttccgtacgcgtaacggtaccgttccgggtagggtaccggggtcccggttaccaaccgtaacgttccctaccgaagaaccggtaacctaaacgttaccgaaaacgtaaccgtacggttacgtaacttaccttaacgaaagtcgaaaccgaccgttaggaaggtacggttaaccggaacggtaaccggtaccgggtaccgttacgttaacgtttacgtaggtaacggtaaccggaaagtacgtacggacgtaacgggaccgggtaacccggggtacccccggttaaagggcccgggggttaccgttacgggggttacgggttaacgggtttcctttacggtttacggtaccggttccgggg

SEQ ID NO: 183112 - DNA, 645 bp, Homo sapiens
  misc_feature: GYAE6OF01AQ8AS.13.76.G10.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (279)..(279): a, c, t, g, unknown or other
  misc_feature (279)..(279): n is a, c, g, or t
  modified_base (334)..(334): a, c, t, g, unknown or other
  misc_feature (334)..(334): n is a, c, g, or t
  modified_base (466)..(466): a, c, t, g, unknown or other
  misc_feature (466)..(466): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgttggtttcttgttgctagtttaaaggtgccagtgtgagtgcagctggtgagtntggagnggcttgatccagccgtcgggggtcctgagctctcctgtgcacgcctgtcggtccaccgtcagtacactacctacngtgacgtcgtcggtcccgccgaggccaccggaggggaggcgttggagtcgcgttntttcttttagttagtagtaggttaggtagtaactacgttccaccggctaacggtcctccgggtagccgggtacctctaaccgacctacttcacgactaagaacctacttaaccaagaaccgtcttaccgttntttaaccccgtataaaccgtgtaaccggacttaccgagtaagtcccgtaccgtagtaccgtacggtaacccggtcttacgtaacggttttcccaggtgaccgttaaggcggtacggtcccggacgtaacgttaccggtaatacggtactggtacggtaccgttcggcggtaaccccggg

SEQ ID NO: 183113 - DNA, 766 bp, Homo sapiens
  misc_feature: GYAE6OF01EGFCT.13.76.G10.1.454.CMB.1.raw
  modified_base (170)..(170): a, c, t, g, unknown or other
  misc_feature (170)..(170): n is a, c, g, or t
  modified_base (345)..(345): a, c, t, g, unknown or other
  misc_feature (345)..(345): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagcccaccctnagtcgtccgtcgtccccaggacagacagccagcatccacctgcctacgtaggtaaaacttaagttgggactaagtaattaaaattacttaaccttccgtaggttatccgagacaagtaacgtcgtacggaccctacggttcccccgtggtcgtcgttcggtactactaccgttanacctaattacgtacgacccgaaacggcccgggtacccctaggtaccgggtaccttaccccggtaggtaccgtaccggttactttccggtaccgttccgggtacccttaacccgtaaccgttccggtaacggtaaccctccggtaaccgccctacctaccgtacgaaccctacgtaccggtaaccgggcccgggaacccgtaggtacctagggtaggagtcgggtacggtaccgtagttaactacgtttacgtaccggtataacgtcggggtcccggttaacgggaacgtcggtaccgacgcccgtaccggtccggaccccgttagttccgtaggtttaccccggttacggtaacccggtacgggtaacccctaaccggttacccgtaaccccggttaccgtaaccgtcccggaaaccccgg

SEQ ID NO: 183114 - DNA, 810 bp, Homo sapiens
  misc_feature: GYAE6OF01DO5DV.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagcgtgggttttccttgttgcttatttaaaggtgcccagtgtgagtgcagcgtggtggagtctgggaggaggcttgactccgagtccggtcggggggtccctgacgacctcctccgtgtcgcacgtccttcggttcggttaccgaccgtcgacgtccaaccctaacctaactagtacggacggtccggttcgggggtccccgccggtaacggggtcccgtacccgggaaggggggaaccgggggtcggtggggtaggttcggtccggtttacttttacttttaagtttaagttaggttaaggttaggttacgtactaacttaccgtcccgacgtacgtaccgtcggtacgggaccggggacctaccgttaccacctactcctaccgaaggtaaccgaaacctaacgtacccaaaacgtaaccgtaccgttcttttaccgttttactaactaaacgttacgaaacccgtcgtaccgtaggaccgaacgtcccgaagttcggaccgtacccgggtcggtttaagttactttacggtgttacggacggtaaacggtcgggtaacgggtcccgggggaacccctaaaccgggttaaaccggtttaccgacccgttaacggtaacggttaccgggtaacccgggttcgggacccggggaaacgtaaaccccggggg

SEQ ID NO: 183115 - DNA, 716 bp, Homo sapiens
  misc_feature: GYAE6OF01B5EZK.13.76.G10.1.454.CMB.1.raw
  modified_base (500)..(500): a, c, t, g, unknown or other
  misc_feature (500)..(500): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccggtcggggggtccctgagacctcctccgtgtcgcacgcctcgtgggttcaccgtcacgtcaccacctacatgacgcgtcgggtccccgcgaggccgtccgggaggggaacggggtcgtgggagtcggtcgttcctttctttttaatttagtaggttaaggttaggtaagtactaacgttacgtcccgacacgtccgtccgggtgggaccggggtccgtacgtttaccacctacgtcctaccgaagaacgtaacctaacttaccgaaaacgtaaccncggtctttcgttttaacctaactaaaagtccgaaaaccgtcgaccgttaaggaacggacgtaccgaagttacggacccggtacggtccgtaagtttaccgtacgtggacggtcggaaggacgtaacgggccggtacccgtaacgtaacgtttacgaccgtacgtttaggaccgggttacggaccgggtacgggggaacccctaaacgggggtcccc

SEQ ID NO: 183116 - DNA, 888 bp, Homo sapiens
  misc_feature: GYAE6OF01DK3QS.13.76.G10.1.454.CMB.1.raw
  modified_base (319)..(319): a, c, t, g, unknown or other
  misc_feature (319)..(319): n is a, c, g, or t
tcagtcacgtactacacgaccggtgctcgatttagtcactcatacgagggggggagaggagcccagcactgggattccgaggttgtttccattcggtgatcagcactgaacacagagactcaccatggtagttttggctgagcttgggttttccttgttgtacttaagttttaaaaggtcgcccagtgtggaggtgcagcgtgggtggagtcgtgggaggatgtcttgactccgacggccggtcgggggtccctgacgtacctctccgtgtcgacacgtcccttcgttcgggttaccaccgtcacgtaccaccacctanatcgacgtccggtcgggtcccgccgacggtccgtaccgggaagggggaacggggtccggtgggacggttcgtccgtttcgttttacgtttttaagtttagttaaggttaagggttaggttaaacgttacctaacttaccgtacccggtactaacggtaccgtaccgggtggggtaccggggtacccgtacttccctaacccgtacgttaccctaccgaaagggtaaaccctaaaccgtttaaaaccgttacccgaaaacggtaaacccgtaaccgtttcggttttaaacccgttttctaaaaccgtaaaaagtccggtaaaaccgtaaccggttccctaaaggggaaccgacgggtacccgtaacggtaccgggtaacccggtacccggttccgggtttaagttaaccgtttaccggtgggtaacgacggtaaacgggcgggttaaccggtaccccgggggtaaaccctaaaccgggttaaacccggttaaacctaccgggttacgttacgggttaacccgggtacccgggttacggggtaacccggggtaacccggaaaacccggggg

SEQ ID NO: 183117 - DNA, 654 bp, Homo sapiens
  misc_feature: GYAE6OF01D0LF2.13.76.G10.1.454.CMB.1.raw
  modified_base (320)..(320): a, c, t, g, unknown or other
  misc_feature (320)..(320): n is a, c, g, or t
  modified_base (452)..(452): a, c, t, g, unknown or other
  misc_feature (452)..(452): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctgggagggacagtcacactctacttgtggcttgagatacggctcagttctcttagtacgttacctaccccagctggtaccaacgacgaccccaggccacggctccgcgcacgctcatctacaacacaaacnctcgctcttcgtcggggtccctcactcgtcttctcgtggctcctactccgttagggaacaaagctcgtacccttatcagtcggaccggggccgaggacagaagatggaatcgtagtattactttactgtttnttttactttataggttaggggttatcgtaccgttattttcgtcggttacgttcggtttcgggttcggggtaacggggtacgggtacccggtaaccccgggttccgttaccgggtaccccggtttcccggtacccgggttaccgaacccggtaccccgggtaaacgggtccccttcccgggacccccgttcggttaccccggg

SEQ ID NO: 183118 - DNA, 801 bp, Homo sapiens
  misc_feature: GYAE6OF01BFKQG.13.76.G10.1.454.CMB.1.raw
  modified_base (217)..(217): a, c, t, g, unknown or other
  misc_feature (217)..(217): n is a, c, g, or t
tcagtcacgtactacacgaccggtgctcgatttagtcactcatacagggggggagaggagcccagcactgggattccgaggtgtttccattcggtgatcagcactgaacacagagactcaccatggagttttggctgagcttgggttttccttgttgcttaagttttaaaaggtcgccctagtgtggaggtgcgagcgtggtggagtcgtgggaggnggtcttgactccgacggtccggtcggggggtccctggacgtacctccgttccgtgtcgctacgtccgttcggtcgggttccaccggtccacgtccacctaaccgtacagtcgacggtcgtcgggtccgccggacggtccgtaccggagggggaacgggtcgtgggtacgtcggtaccgtttctttacttttaagtttaacgttaggttaggttaggtaaacgtacgtaacgtccgtaccggactaaccggtaccgtcggtacggggaccggggtacctacgttccaacctacttacctaccgaagaaccggtaaaccctaacgttaaccccgaaaagtaaaccccgtacggttccttttaacgtttacctaaacgtaaacgtaacgaaccgtacgacctcgggaacgtacggaccgtagtaacccgacggtaccggttcgttaagtacgttagtcggtacggacgaagggtacgaccgggttaccggggaaaccctttaacgggtaaaccgttaccgtaaccgttgttaaccgggtcggtacccgggtacgggtacccgggtaaccggaacccgggtaaccccg

SEQ ID NO: 183119 - DNA, 809 bp, Homo sapiens
  misc_feature: GYAE6OF01EFN8U.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtctgggaggaggcttgatccagccgtgggggtccctgagactctcctgtgcagcctcgttggttcaccgtcagtccaacacctacatgagtccgtcggggtcccgccgagggccgtaccggagggggaacgggggcttggggagttcggtcggttctttaccgttttttaatttaacgtaggttaacggtttggttaacgttaacgtacttaacccgtccgactaacggtaccgtcccgggtgggaaccgggggtccctaagtttcccaacctaacgttcctacccggaaaggaacgaaccttaaaactttacccgaaaacgtaaacccgacgtccttttacgtttttaccctttaacgtaaaacgttacggaaacctacggtacccgttaagggaacgtaaccggtacccgtaagtaccgggtaaaccccgtaccggggtaccccgttttagtttaaccgtttaccgtggttacgggaccggtaaagggtacggtaaccgggttccggggaaccccctaaaccgggttaaacccggtttaaaccgacccggttagttaacgggtaccggtaacccgggttccgggtaccgggggaaacccccggg

SEQ ID NO: 183120 - DNA, 852 bp, Homo sapiens
  misc_feature: GYAE6OF01DEPTS.13.76.G10.1.454.CMB.1.raw
tcagtcacgtactacacgaccggtgctcgatttagtcactcatacgaggggggggggctgagcccttctctggaaaccacacagctcctcctgcagcagcccctgactgctgatttgcatcacgggccgctcttccagcgaaaggggataagagaggcctaggaacgaacctgacccagccctgggccctgaggaacgcagcagtcggaggtcgcctcgacgccagtcggcagtcggacttccctcttccttccgtcggcgttccttgtcttacgtgcctacgaggaccttccggtcggtcccttacctagttcgacgtccgtagacctccgacgtcccctaacccgttcgtacggtccggttccggtccgtacccccgagggaaccacggaccgacgccaagtccaacgtccaaccgttgaccttacgtaaacgggtaaaacttaacggtcgggaactaaaggtaaactttaaaacttaacgtttacccgtttacgttagggttaaccttaccgtaacggtactaaaggttaacgttacccggaaccgggtaccccgttaccgggtttccccgttagggttaccgtacctttacggggtaacctacggtttactttaacggtaacgtaaacgtaccgttaccggaacccgttaaaccgggtccccgggtaaccccgttaccggggaaccggttaaccccgttacccgggtaaccgggtacgtaccccggttaagttttaccccggttacccggttcccgggttaccccgttaaccccgttaaaccccgggttacggttaaccccggggtaaacccctttcccgggaacccggttaccccgttaaccccggg

SEQ ID NO: 183121 - DNA, 706 bp, Homo sapiens
  misc_feature: GYAE6OF01AFS3F.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgactccgaggccgtcgggggtccctgacgactcctcctgtcgcacgtcctcgtcgggttccaccgtcacgtccacaccgtacagtgagtccgtcgggtccgccgacggccgtacgaggggaggcgtggagtgtcgttcttacttttaagttagtacgttaggtaggttagtactactacctccgactacgtaccgttccggtggacggggcctacgttaccactactcctacgagacactaacgttacccaaagacctacgttcttagttttacctaactaaacgttacgaaccgacggtacctgggaacgacccggaccgtagtaccgggaacccgtacggggttacccgtagttttaaccgtaaggttcggacggtaccggtagggaccgtacgggtccccgggaaccctaaccgggttaacccttacggtacctacgttacggtacgggtaccgttacgggacggggacccgttaacgggacccccgg

SEQ ID NO: 183122 - DNA, 651 bp, Homo sapiens
  misc_feature: GYAE6OF01EXIGN.13.76.G10.1.454.CMB.1.raw
  modified_base (167)..(167): a, c, t, g, unknown or other
  misc_feature (167)..(167): n is a, c, g, or t
  modified_base (237)..(237): a, c, t, g, unknown or other
  misc_feature (237)..(237): n is a, c, g, or t
  modified_base (520)..(520): a, c, t, g, unknown or other
  misc_feature (520)..(520): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtgcctctatgagctgactcagccaccctnagtcgtccgtcgtccccaggacagacagccagcatcacctgctcgtaggaaataatggacagaataaatntacttctgtactcagcagagtcagccacgtccctgtcgcgtggtctagttactactacgaagatcgacctaaggccggtcctacgaggactccgagagtacgtattctcgtcggtacctaccgaacttccggacggtaacctacgaccgtacctaccgtaccgtacgaaccctataccgacgggtacccgggaaccaacggtccgttaagtacggaacgtacggaacggtacttacgtaactttacgttacgtaggtaccgtaacgggtacggtagggtaacncggtacacggtacctacgtcccgacccgtagttacttacgggtaccgttacgggaaccggttacgggaacccgtaacggttcccgtaacccgttacgtaaacggcccgaaccgtaacccggtaaaccccgg

SEQ ID NO: 183123 - DNA, 860 bp, Homo sapiens
  misc_feature: GYAE6OF01APMDS.13.76.G10.1.454.CMB.1.raw
  modified_base (242)..(242): a, c, t, g, unknown or other
  misc_feature (242)..(242): n is a, c, g, or t
tcagtcacgtactacacgaccggtgctcgatttagtcactcatacgaggggggaggaggagcccagcactgggacttccgaggtgtttccattcggtcgatcagcactgaacacagaggactcaccatggagttttggctgagctgggttttaccttattacttattttaaaaggtgcccagtgtgaggtgcagctggtggagtcgtgggaggaggcttgatccagccgtcggggggtcccnggacgactctcctgtacgcacgtccttcgtcgggttccaccgtcacgttaccgaccaacctacacgtggacgtcgtcggggtcccgccgtaggccttccggaggggacggggcgtcggggacggtcggccgttcctttacgtttttaagtttacgtaaggttacggttagggttagtaacgtacgtaaccgttccggacgtacggtacccgttaccggtaggggacgggggtacccctaacgttcccgtaacccctaattccccgttaccgaacggtaaccgtaaccgtaaacccttttacccggaaaaggtaaacccttacccgggtaacttttcgggttttaaccctttaacgtaaacttaccggtaaactacgggtacccggttagaacggccggtaaaccgtagtaaacggacccgtacccggggtaccggtttacgttaaaccgtttcggttacggggttaccgaaccgggtaagggtaacgggacggttaacccgggggaacccccgtaaaacggttaaacccgggtttaccggttaaccggtacgtttaacggacgggttacccggttcgggtaccggggacccgtaaacggggtcccgtaaaccccgggg

SEQ ID NO: 183124 - DNA, 673 bp, Homo sapiens
  misc_feature: GYAE6OF01DSM34.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtcgggggtccctgagctctcctgtgcacgctcgtggttccaccgtcagtcacacctacatgacgcgtcgggtcccgccgaggccgtaccggaggggaacggggcgtgggagtcggcgttctttacgttttatttaagtaggttaggttggtaacgtactacgtaccgtccgcgtaacgtccgtccggtggacggggctacttaccgacctatccgtaccaagacgtaactaaccttacgaaacgtaaccctacgttctttacgttttacctactaaaagttacgaaacgtacggtaccctaaggacgacgtaccggagtaccggaaccggtaccgggtaccttagttacttacggtggtacgacggagacggaacggtccgggaaccctaaggtaaccgttacgacgttagtagtcggtacgttcggaacggggccgaacgggtaccccg

SEQ ID NO: 183125 - DNA, 760 bp, Homo sapiens
  misc_feature: GYAE6OF01CGDLS.13.76.G10.1.454.CMB.1.raw
  modified_base (177)..(177): a, c, t, g, unknown or other
  misc_feature (177)..(177): n is a, c, g, or t
  modified_base (281)..(281): a, c, t, g, unknown or other
  misc_feature (281)..(281): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgtcttaagttttaaaaggngcccagtgtgaggtgcagcgtggtggagtcgtgggaggaggcttgactccgagccgtcgggggtcctgacgactctcctgtcgcacgcctcgtcggtcaccgtnacgtcacctacctacagtgacgcgtcgggtcccgccgacggcctaccggaaggggacggggcgtagggagtcgtccgtttctttacttttaattagtagttaggtaggtaacgtacagttacctccgacgacgtaccgtcggtagggacgggtcctacttccgaaccctattcctaccgagtaaccgtaacctaacgttacccgaaagaaccctacgttacgtttacgtttacctaacgaaagttcgaaaccgtacggaccttagggaacgtaccgtaccgtagttaccggaacccgtaccgggttacccgttaagtttaactttacggtacggtacggtaaccggtaagggtaaccggtacgggtaacccgggggaacccctaaacgggtttaaacccgtttaccgaaccggttacgttaacggttacggggtacccgttaggggtacccggggtaacccgaaaccggggtacccccg

SEQ ID NO: 183126 - DNA, 716 bp, Homo sapiens
  misc_feature: GYAE6OF01C7MP2.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcacctgctctggaaataatggcagataatatacttcctaggtatcagcagaagtcgagccacgtcccctgtcgctggtcatctatcaagatcgaccaaggccgaccctcgacggtactcccgtagacgaccgtacttcgtacgtcggacctacccgtaaccgttccgtacggggtaaacctccgaacggtaccctaccgttacgtaccggtaacctacgttacccggacgggtccccggggaaacccgtacgggtacccgttaaggtacggtaacggttacggggtaccggtaccgtttacggtaaccgttttacgtttaaccggtcggttacccgggtaacgggtccggggttacgggaccggaacggtacgaccggtaccgtacccgtcgggtaccccgtacgttaacggttccggttaccggttacccgggtaacggttaccggggtaacctaaacgggtccccgttaacccggttaccgttaaccggcccgtaccggtaaacccccgg

SEQ ID NO: 183127 - DNA, 641 bp, Homo sapiens
  misc_feature: GYAE6OF01BYJWM.13.76.G10.1.454.CMB.1.raw
  modified_base (450)..(450): a, c, t, g, unknown or other
  misc_feature (450)..(450): n is a, c, g, or t
  modified_base (475)..(475): a, c, t, g, unknown or other
  misc_feature (475)..(475): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctgagactctccgtgtgcagcctcgtcgggttcaccgtcagtcacacctacatgagcgtcgggtcccgccgaggcctaccggagggggaacggggcgtgggagtcgcgtctttcttttattagtagtagtggtaagtacataccgtcgacagtaccgtccggtggacggggcctacttccaacctatcctaccaagacgaactaataccaaagtaacncgtcttcgtttactacaaatcaacncgtcctagacgacgcgatcgaaccgacgggtccgttagttattaccgtggtcgacggtaagaggaccgggttccggggaacccctaacgggttaaccgttaccgtacggtccgttaaggtccgggtacgttaccgggtaccggggaccgtaaaccggggtaccccg

SEQ ID NO: 183128 - DNA, 707 bp, Homo sapiens
  misc_feature: GYAE6OF01DVNZ8.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtgggtgggagtcgtgggaggaggcttgatccagccggtgggggtccctgagactctcctgtgcacgcctcgtgggttccaccgtcagtcaccacctacatgacgcgtcgggtcccgaccagggcctaccggaggggaacggggcgtagggaggtcggtccgttctttactttttaatttagttaggtaggttggtaagtaactactacgtccgacgacgtactccggtggacggggccgtacttccaacctacttacctaccgaagtaacgaacctaaacttaccgaaacgaaccctacgtctttacgttttacctaactaaagttacgaaactcgacccgttgaacgacggacccgaagtacggaacccgtacgggttacccgttaggttaactttacgtggttacgaccggtaaggacggtacgggtccggggaaccctaacgggttaaccgttaccgtacggtactacggtacgggtacgtcgggtaccggggccgtaacggggacccgg

SEQ ID NO: 183129 - DNA, 737 bp, Homo sapiens
  misc_feature: GYAE6OF01BM7VL.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagcgtggtggagtcgtgggaggaggcttgatccgagccgtgggggtccctgagactctcctgtgcacgcctcgttgggttccaccgtcacgtccaccacctacatgagtcgtcgggtccgccgaggccgtaccggagggggaagggtctgggagtcggtcgttcgttacttttattagtaggttagtggtagtactagtacctcgacgagtaccgtcggtacggacggggcctaacgttccacctacgtaccctaccgaaggaacgaacctaacgttacccaaaacgaacctaccgtccgtttacgttttaccgttaacgtaaacgttacgaaacctacggtacccttagggaacggaccgtacccgaaagttccggaaccgtaccgggtacccgttagttaaccgtttaccgtaggttacggacggtaaagggacggtaaccggggtccggggtaaccccccgtaaacggttaaaccccggtttaaccgaaccggttaccgttaaggtacccggggtaaccggttccgggtaacggggggaaaccccgg

SEQ ID NO: 183130 - DNA, 788 bp, Homo sapiens
  misc_feature: GYAE6OF01DO1HN.13.76.G10.1.454.CMB.1.raw
  modified_base (226)..(226): a, c, t, g, unknown or other
  misc_feature (226)..(226): n is a, c, g, or t
  modified_base (374)..(374): a, c, t, g, unknown or other
  misc_feature (374)..(374): n is a, c, g, or t
  modified_base (691)..(691): a, c, t, g, unknown or other
  misc_feature (691)..(691): n is a, c, g, or t
  modified_base (764)..(764): a, c, t, g, unknown or other
  misc_feature (764)..(764): n is a, c, g, or t
tcagtcacgtactacacgaccggtgctcgatttagtcactcatacaggggggagaggagcccagcactgggattccgaggtgtttccattcggtgatcagcactgaacacagaggactcaccatgggagttttggctgagcgttgggttttttccgttgttgtactttaagttttaaaaggtcgccctaggtgtgaggtgcgagtcgtggtggtagtcgtggaggnggcttgactccgacgccggttcgggggtcccgtgagtacctcgtccgtgtgcgtacgccgttcgtcgggttccacccgtcgtacgtccaccaacctactagtggacggtccgtcggtcccgccgacggccgtacggaaggggacgggngtacgggagtcgtccgtttacgttttacgttttatttaggttagttaggttaggttacttaactcgtaacccgttccgaccgtaacggtaccgttccggtagggaccggggttccctaaccgttaccgtaccccgttaacgtccccgttaccgaacggtaacgtaaacccttaacgtaaccccgaaagtaacccgtacccgttagttttcccgttttaaacctactaaaacggtacgtaaacccggtaccgtacgtacggtaaggacccgtacgtacgtacggaacccgttccgggtacccgtttagttacgttagnggtacggacggtagacggtacggcccggaacccgtaacgtaaccggttaccgacgtgttacgacggttccggnggtaccgggcgaccgggtaacccg

SEQ ID NO: 183131 - DNA, 588 bp, Homo sapiens
  misc_feature: GYAE6OF01CSMI2.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagataaatatacttcctggtatcagcagaagtcaaggccagtcccctgtgctggtcatctatacaagatgaccaaggccgacctcgagggactccctggagcgagttctctggcctcctaaacgtccgttagggaaacctcacggcccaactcctgaccatacgacgacggacccgagactagtaggacgtggaggctacgtacttacgttaactgtaccgaggtccggtagggaacaggaccaggaccaccgtgacccccgtagttacgttcggtaccttacgggaaccgttacggggaacccgtaaacgggtccctaacccgttacccgtaaacggttaccgaacggtaacccccgg

SEQ ID NO: 183132 - DNA, 572 bp, Homo sapiens
  misc_feature: GYAE6OF01B278G.13.76.G10.1.454.CMB.1.raw
  modified_base (171)..(171): a, c, t, g, unknown or other
  misc_feature (171)..(171): n is a, c, g, or t
  modified_base (356)..(356): a, c, t, g, unknown or other
  misc_feature (356)..(356): n is a, c, g, or t
  modified_base (448)..(448): a, c, t, g, unknown or other
  misc_feature (448)..(448): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (503)..(503): a, c, t, g, unknown or other
  misc_feature (503)..(503): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtgtccgtcgtccccaggacagacagccagcatccacctgctacgtaggaaaattaagttggacaagtaattaaatacttacttccgtaggtatcagcaagagtcgacggcctacgtccccgtggtcgcgttcggtctagtcctatacaagtactcgaccgacggccgcctcgacggactccgngacgcgtacttcgtcgtcggtcctaccgtacgtcgtacggaacctcgaccgaccctactcctacgaaccacgtccgaaccggcccggaaccnggtactaggtagtagtggacgtctagtacttattcgngtacggnggccgtggacngcagccgtacgcgtccgtactcgtgtcgtacggcgtacggacgtacgtccacgtacacgccacgacccg

SEQ ID NO: 183133 - DNA, 741 bp, Homo sapiens
  misc_feature: GYAE6OF01CHPXQ.13.76.G10.1.454.CMB.1.raw
  modified_base (600)..(600): a, c, t, g, unknown or other
  misc_feature (600)..(600): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgactccaggccggtcgggggggttcccctggacgacttcctccgtggtcgcacgccttcgtgggttccaccgtcacgtccacaccctacatgacgcgtcgggtccgccgacggctccggaagggggacggggcgtagggacggtcggtcgtttcgtttacttttttatttagttaggttaggttaggttaacgtactacttaccgtcccggacacggtacccgtccgggtagggaccgggggtaccgtacttaccgaaccctactccgttacccgaagaacgtaacctaacgttaacccgaaacgtaaccctacggtaccttttacggtttaccttaacgaaacgttacgaaaccgtacggacccttagggacgaacgacccggtaanaccggaccgtaccgggtaccgttgttaacttacggtcggtacgacggtagaggtacggtccggggacccgtaacggtaacccggttcgtacgtacgtacggtcggtaccggttacggaccggggaccggtacggtacccgg

SEQ ID NO: 183134 - DNA, 652 bp, Homo sapiens
  misc_feature: GYAE6OF01CVKOP.13.76.G10.1.454.CMB.1.raw
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
  modified_base (460)..(460): a, c, t, g, unknown or other
  misc_feature (460)..(460): n is a, c, g, or t
tcagtcacgtactacacgaccggtgctcgatttagtcactcatacagggggggagaggagcccagcacgtgggattccgaggtgtttccattcggtgatcagcactgaacacagaggactcaccatggagtttggctgagctgggttttccttgttgcttattttaaaaggtgcccagtgtgaggtgcagctggtggagtcgtgggaggagggcttggactccgaggccggttcgggggggtcccctggacgtacctctcctggtgcngtcctgtagggttccaccgtnagtcacacctacatcgagcgtggtcccgcaggcctccggagggacgggctggagtgcgttctttcttttattagtagtagtggtagtacatactccgcagactccggtggacggggcctattccactactctcagacgactaaacttcaaacgacncgtcttagttcctanaaatcgaacacgtcctagacgacgccgtaatcggaaccgtaccgggtccgttagttaacgttcgtggtacggacgtaacggagggtacggtaccggggtaaccccgtaaaggtaaaccgtttacggaaccgtacgttaacggacgggttaaccggcggttaaccgggggaccgtaaacgggggtaacccccg

SEQ ID NO: 183135 - DNA, 738 bp, Homo sapiens
  misc_feature: GYAE6OF01A30AZ.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaggtgcccagtgtgaggtgcagctggtggagtcgtgggaggaggcttgactccagtccgtcgggggtccctgagactcctccgtgtgcgcgcctcgtcggtccaccgtcagtccaccacctacatgacgtcgtcgggcccgccgaggccgtccgaggggaagggcgtggagtcggtcgttcttcgttttatttagtagttaggtaggtacgtaactacgttacctccgacgacgtaccgtccggtcgggacggggtaccgtagtttacccgaactactaccgtacccgaaggaacaaccgtaacttacccgaaaacgtaacccgaccgttctttaccgttttactaacctaaagtacgaaaccgtacgaccgttaggaacgacgtccgaacgttacggaccgtacccgggtaccgttattaaccgtttgtacggttcgaccggtaaggaccggtacgggtacccggggtacccctaaaccgggttaacccgggttaccctacgggtacccgttaaggttccgggacccggttaccgggacgggggtaccccgtaaacggggtacccccggg

SEQ ID NO: 183136 - DNA, 651 bp, Homo sapiens
  misc_feature: GYAE6OF01DTEGM.13.76.G10.1.454.CMB.1.raw
  modified_base (409)..(409): a, c, t, g, unknown or other
  misc_feature (409)..(409): n is a, c, g, or t
tcagtcacgtactacacgaccggtgctcgatttagtcactcatacaggggctgggcctcaggaagcagcatcggaggtgcctcagccatggcatggatccctctcttcctcggcatccttgcttactgcacgaggctccgtggcctctatgagtctgactcacgcccaccctcagttcgtccgtcgtccccaggacagacacgccagcatccactcgctataaggtaaactaagtcggacaagaataaatctacttcgtaggtactccgagcgaagtaagtcgacggtacctaccggttccctgtcgcgtcggtactagtctaactacaagactcgaccgaacgccgtccgaggtaccgcctcgagtagtcctattcgtaccgtacgtacctacgacgtcgtacgaccncgctcctactctacgactcgtaccggcggacccgacgtacgtacgacggttcggagtacggacgttacgttaccttagttacgtaggtcggtacggtcggggacgtacggacacggtaccgaccgtccacccggttaccgtccgttaacgttccggttacccggtacggttacccgggaaaccggtacgaacccgggttaaccgttacccggttaacgtccctaaggtccccggaaacccgg

SEQ ID NO: 183137 - DNA, 804 bp, Homo sapiens
  misc_feature: GYAE6OF01CM57R.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcagcctcgtgggttcaccgtcagtcacacctacatgagcgtcgggtcccgccaggcctccgaggggaagggcgtggagtgcgttcttcttttattatagtagtggtagtacatacctcgcacgctccggtggacggggccgtacttccgacctactccgtaccagaacgaacctaacttacccgaaaagaacccgtacgttccgtttacgtttttacccttaacgtaaaacgttacggaaaaccctacggtacccgttaacgggaacggtaacgggaaccccgtaagttaccgggaaacccggtaccccgggggttaccgtttaacggttttaaacttttaacccgggttggtacccgggaacgggtaacgggtaaacggggttaccgggttaccccgggggggtaaacccccccttaaaagggggttaaaacccccggttttaacccggttaaacccggtacccggtttaaacgggttaccggggtaaaccccgggttttcggggaaccccgggggggggtaaacccccggtaaaacccggggggtaaaccccccggg

SEQ ID NO: 183138 - DNA, 683 bp, Homo sapiens
  misc_feature: GYAE6OF01DKN97.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccaggccgtcgggggtccctgacgactctccgtgtcgcacgcctcgtcgggttccaccgtcacgtccaccacctacatcgacgtcgtcgggtcccgccgacggcctaccggagggggaacgggcgtagggacgtgtcgttctttcttttatttagtagtagtggtatacactacctcgcacgcgtcggtggacgggtccgtattccactactcctaccgagtaacgtactaaacttacccgaaagtaactccgtctttagtttactaacaaagtcgaacgtcgcgtagacgacgccgtagtaccggaccgtacggtccgttagttaaccgtttaggtcggttacgacggtaagggacggtaacgggtcccgggggaaacccctaaccgggttaaacccgtttaccgaaccggttagttaacggtaccggggttaaccggtcggggtaccggggtaaaccccggg

SEQ ID NO: 183139 - DNA, 586 bp, Homo sapiens
  misc_feature: GYAE6OF01EGNCG.13.76.G10.1.454.CMB.1.raw
  modified_base (333)..(333): a, c, t, g, unknown or other
  misc_feature (333)..(333): n is a, c, g, or t
  modified_base (345)..(345): a, c, t, g, unknown or other
  misc_feature (345)..(345): n is a, c, g, or t
  modified_base (380)..(380): a, c, t, g, unknown or other
  misc_feature (380)..(380): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (452)..(452): a, c, t, g, unknown or other
  misc_feature (452)..(452): n is a, c, g, or t
  modified_base (520)..(520): a, c, t, g, unknown or other
  misc_feature (520)..(520): n is a, c, g, or t
  modified_base (551)..(551): a, c, t, g, unknown or other
  misc_feature (551)..(551): n is a, c, g, or t
tcagtcacgtactacacgaccggtgctcgatttagtcactcatacagggggggagagggagcccagcactgggattccggaggtgtttccattcggtgatcagcactgaacacagaggactcaccatggagttttggctgagcttgggttttccttgttgcttattttaaaaggtgccagtgtgaggtgcagctggtgagtcgtggaggaggcttgatccgagccgtggggggtccctggacgtctcctccgtgtgcagtcctcgtggttcacgtcagtccacactacatgagcgtcggccgccgaggcctaccggaggggacgggtcgtggngtcgcgttcttnttttattagtagtagtggtagtacaagtcctcganacgtctcggtggacgggcatcacntcncaganacaatccaagaactgtcttacgtttctaacaagtcgaacngtacctaggaacgcgttccgagtacggaacgtaccgggtcttagttaacttcgaggtgccgtaagcgnggtacccgggactaaggtaacttcgaccgtntaagtcggaacgtcggaggtacccacgggtacccg

SEQ ID NO: 183140 - DNA, 672 bp, Homo sapiens
  misc_feature: GYAE6OF01A1A2E.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctgggaggaggcttgatccagccgtggggggtccctgagactctcctgtgcagcctctgggttcaccgtcagtcacacctacatgagctggggtccgccaggcctccgagggaaggggctgggagtgcgtctcttttatttatagtagtggtagtacatactccggcagacctccggtgaggggccgattcaccatctccagagacaattacccaagaacccacgtcttcgttttactacaaattcgaaacctaggccctagaggacgccgaattcggaaccgtaccgggtccgttagttaacgtttaccgtgggtaggtaccgggtaaggaacgtacgggttccgggggggaacccccctaacggggtaaacccggttttaacccgaacccggttaccgttaacggttacggggtaacccggttacccgggtacgggggggtaccccgtaaaacggggggtaaccccccgg

SEQ ID NO: 183141 - DNA, 723 bp, Homo sapiens
  misc_feature: GYAE6OF01CKE9T.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaagttttaaaaggtgcccagtgtgaggtgcagctggtggagtcgtgggaggaggcttgactccgaggccggtcggggggtcccgtggacgtactcctcctgtgcgacgtcctcgttcggtccaccgtcacgtcaaccacctacatcgagtccgtcgggtccgccgacggccgtaccggaggggacgggcgtagggaggtcgtcgttctttactttagtttagtagtagtggtagtaactacgtactccgcgtacgccgtccggtggacgggcgtacttccaccgtactccgtaccgaagaacgtaactaaactacccgaaagaacctacgtctttaccgtttaccttaactaaaagtcggaaaccctacgtacccgtaagggaacggtaaccgtacccggtaagtacgggtaaacccgtaccggggtaccgttaggtttaacgtttaccgtgggtacggaagggttaacgacgggtaaccggtccggggaacccttaaaccggtaaccgttacgaccgttacgtacgtagggtaacccggttcggaacggggaaacccg

SEQ ID NO: 183142 - DNA, 631 bp, Homo sapiens
  misc_feature: GYAE6OF01BGJ3L.13.76.G10.1.454.CMB.1.raw
  modified_base (234)..(234): a, c, t, g, unknown or other
  misc_feature (234)..(234): n is a, c, g, or t
  modified_base (297)..(297): a, c, t, g, unknown or other
  misc_feature (297)..(297): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtcgtccgtcgtccccaggacagacagccagcatcactgctctagaaataagtgacagataatntacttctgtatcagcagaagtcacgcctacgtcccctgtcgtcgtcggtcatctatcaagacncgaccgaagccgtcctacgacggactccgtgacgacgtactcctacgtcgaccctaccgtacgtcgtacggtaacctcgaccgtcctaccttctacgaacctacggtaccgaccggtccggaacccgacggtactagtacggtactacggacgtaccgtacgtaacgttacgttacgtcggtaacggtaggtccgggtaggtaccacggtcgacgtcgtccgtcgcccgttacgttacgtccgtttaaccggtacgggtaaccggtaccggtaaaccgttaacccgggttccgtaccgttaaccggtaaccgtaccggaccggtaaacccccgg

SEQ ID NO: 183143 - DNA, 888 bp, Homo sapiens
  misc_feature: GYAE6OF01D9AF0.13.76.G10.1.454.CMB.1.raw
  modified_base (172)..(172): a, c, t, g, unknown or other
  misc_feature (172)..(172): n is a, c, g, or t
tcagtcacgtactacacgaccggtgctcgatttagtcactcatacaggggggagaggagcccagcactgggattccgaggtgtttccattcggtgatcagcactgaacacagagactcaccatggagttttggctgagtctgggttttccttgttgacttattttaaaaggnccagtgtgaggtgcagctggtcggatctggaggaggcttacgatccgagccggtggggtccctgacgtacctctcgtgcgctacgtcctaggttccgtaccgtaccgtcgtaccacacccttaccgtatagttacgcggtccggtaccggtaccccgacggacggtaccggtaaccggggtaaggggggaccgggttcgtacgggtagtcggttaccgtttaccttttaagtttttaataacggttaggttaccggttaggtaaccgttaaccgttactaacccgtccggtaaccgtaacggtaaccgggttccgggttaaggggacccgggtaccttacggtaaccctacggtacttaccccgtaacgaaccgtaaacggtaaacccttaaccttaacggaaacgtaacccggttaccggtactttttaccgttaaacccgttacggaaaattaccggaaacccgggtcttaccggggaagttaccggggacctaaccggtaagttccccgggaaaggcccgggtttaacgttacgtttttaaaccgggacctaggggtacccgtaaggggtaacgttaacgggtaccccgggggttaacccggtaaaccccggttaaacgggtttaacccgtaccggttaaccgtaaaccgtcgggtaaaccggttcgggtaaccccggtacggggttaaaacggtaccccgtaaaccccgggg

SEQ ID NO: 183144 - DNA, 623 bp, Homo sapiens
  misc_feature: GYAE6OF01DCA1Z.13.76.G10.1.454.CMB.1.raw
  modified_base (169)..(169): a, c, t, g, unknown or other
  misc_feature (169)..(169): n is a, c, g, or t
  modified_base (243)..(243): a, c, t, g, unknown or other
  misc_feature (243)..(243): n is a, c, g, or t
  modified_base (308)..(308): a, c, t, g, unknown or other
  misc_feature (308)..(308): n is a, c, g, or t
  modified_base (519)..(519): a, c, t, g, unknown or other
  misc_feature (519)..(519): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctnagtcgtccgtcgtcccaggacagacagccagcatcactgctactagaaatagttggacagataaatctacttcnggtatcgagcagaacgtcacggcctacgtccccgtgtacgcgtacggtctaatctatacgaagtncgacccgtaaggcccggtaccctaggacggaccttccgaggacgtctagttcgcgtcgtacctaccgacgtcgtacggaactcacgtaccctaacgttcgaccactacgacgaccgggcccggtacctaaggtccttaggtaggcttacggggacgtcttaacggtactttaagttccgtcggtaacgacggggtacggcggggtaaaccncgacgtacgctaccggccgtctcgttagttccggtaaccgtacggaacggtccggtaaccgtacgtacccgtaccgtactaccggccgaaccgacccgtaaccg

SEQ ID NO: 183145 - DNA, 728 bp, Homo sapiens
  misc_feature: GYAE6OF01DU2XS.13.76.G10.1.454.CMB.1.raw
tcagtcacgtactacacgaccggtgctcgatttagtcactcatacagggggcctgggcctcaggaagcagcatcggaggtgcctcagccatggcatggactccctctcttcctcggcgtccttgcttactgcacaggactccgtggcctctatgagctgactcacgcccaccctgagtcgtccgtcgtaccccgaggaccagacacgccagctactcacctgtctagtaaggaaaattaagttcggacaataaattaaaattacttaccttccgtaggtactacaacggacaaggaaccggtacgaaccggtccctacggttccccgttaggtacggtaccgttaggtacctaacgttactaaacgttacgaaagtaccgtaccggaaccaacggtccccggtacctacgggacggttacccttacccggtaggaaccgtccgtttaactttaccggttccggaccggttacctaacccgtaaacgttccggtaaacggtaaacccttcgaccgtacccttaccgtacgttaacgaaccgtacgtaccgaacggaacccggtaccgtaggtaccgttaaggtaggaacgtacggtacgtacgtaacgttaccttaatcggttcgacgtagggaccgtagggaccacggacgcgacgcgtaccgccgtattcgtacgtacgacgtaacggtacgaccgaacgtaccacgtaccacgtccgacgaacccg

SEQ ID NO: 183146 - DNA, 874 bp, Homo sapiens
  misc_feature: GYAE6OF01BJPNM.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacaggggctgggcctcagtaagcagcatcggaggtgcctcagccatggcatggatccctctcttcctcggcgtccttgcttactgcacaggatccgtggcctcctatgagctgactcagcccaccctnagtgtccgtcgtccccaggacagacagccagcatcacctgcctctaggaaataatggacagaataatatactctgtatcagcagagtcaggccacgtcccctggtcgcgtggtctagtctatacaagtactcgaccaaggcccggcctacggacgggactcccgtaggacgtaccgtacttccgtacgttccggtaccctacccgtaacccggtaccggttaacggggtaaccccttaccgtaacggtcccccttaaccgttacccgtaccgtaacccctaacggtttacccgggacccggggtaaaccccggggaccccggtaaccgggttacccgttaacggttacggggtaacttaaccggggacggggttaccctttaaccggggttaacctttaaaccgggttttaacccggtttacgggttaacccggggtaacgggggttaccccggggtaacgggggtaaaccgtaccgggaacccggtaacggaccccggttaaacccggtccccgggtacccggttaacccggtttacgggtacccggtttttaccccggggtaaacccggggttaaccccgggttaacccgggggttaaaaccgttaacccccgggtttaaccccgggtaaaccccccggttttaaacccgggtaaaacccggtttacccccggaaacccccggggttaaaacccccccccg

SEQ ID NO: 183147 - DNA, 1017 bp, Homo sapiens
  misc_feature: GYAE6OF01DV7GP.13.76.G10.1.454.CMB.1.raw
tcagtcacgtactacacgaccggtgctcgatttagtcactcatactaggggtgggagaggagcccagcactgggattccgaggtgtttccattcggtgatcagcactgaacacagaggactcaccatggagttttggctgagtcttgggttttccttgttgacttaagttttaaaaggtgccctagtgtgaggtgacagcgtgggtggagtcgtagggaggaggtcttagactaccgacggtcccggttcgggggggtacccctaggaacgtaccttccgttccgtcggtcgaccgtacgtcccgttccgttcggggttaccaacccggttcgtaacggttccgaaccctaaccgtaactagtcggaacggtccggttccggggttacccgaccggtaacgggtccgttaacccggggaaggggggtaacgggggtccggtacggggtacggttccggttccgtttacccgttttaacgttttttaaggtttaacggttaacgggtttaacgggtttacggtttaaacggttaaccgtaacgttaaccccgtcccggtacgtaacggtaacccggttacccggggttagggaccgggggtacccgttaacttaccccgaacccgttaacttcccgtaaaccggaacggtaacccgtaaaccccgtaacccggtaacccccgtaaaggttaacccgtacccgggttaccgtaaacggtttaacgtttacccgttaccggtaaacggtaacccgttaaaaggttccgggggaaaccggttaacccgggtcccggttaaacggggaaccgggtttaccggtaacggggtaccgtaaccggttaacccgggtaacctttaaccgttaaacggttttaaacgtttacggttacggtttaaccggtaagggttaaacctttaaagtttacgggttaaacccgttttaccgggtttaacggaacccggggtaaacccggtacgttaacccgggtttacgtttccggggtcccgggtaacggggg

SEQ ID NO: 183148 - DNA, 769 bp, Homo sapiens
  misc_feature: GYAE6OF01DNAQE.13.76.G10.1.454.CMB.1.raw
  modified_base (303)..(303): a, c, t, g, unknown or other
  misc_feature (303)..(303): n is a, c, g, or t
  modified_base (626)..(626): a, c, t, g, unknown or other
  misc_feature (626)..(626): n is a, c, g, or t
tcagtcacgtactacacgaccggtgctcgatttagtcactcatacaggggagaggagcccagcactgggattccgaggtgtttccattcggtgatcagcactgaacacagagactcaccatggtagttttggctgagtcttgggtttttccttgttgtcttaatttttaaaaggtcgcccagtgtgaggtgcagctgggtggagtcgtggaggaggtcttgatccgaggccggtcggggggtccctggacgtacctcctcctgtgcacgccttcgtggttccaccgtcacgtcaccacctacngtgagtccgtcgggtcccgcgacggtccgtaccgagggggaacgggcgtgggaggtgtccgttctttactttttaagtttagtaggttagttaggtacgtaactactacctccgacacggtacgtccggtagggacgggtccctacttccaaccgtacttccgtaccgaagaacgtaaacctaacgttaccaaaaggtaaccctaccgttctttacgttttaacctaacgtaaagttcgaaaacctgtacccgtaaggaacggaaccgtccggtaagtaccggaaccggtacccggggtacgtttacggtttaaatttaccgngggttaacggtaacggaacgggtaaaggtacgggtacccggggaaccccctaaagggtttaaacccgttacccggtacggtacttacgggtacgggtaaccggttccggggtaacggggaaaccccgtaaagggtacccccgg

SEQ ID NO: 183149 - DNA, 749 bp, Homo sapiens
  misc_feature: GYAE6OF01DWDIY.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcacgtcacacctacatgacgcgtcgggtccgccgaggcctaccgaagggggaacggggctagggacgtggccgttcttactttttatttaactaggttagtggtagtactatactcccgacacgtacctccggtaggacgggggtccctatttcccgaaccgtacttccgtaccgaagtaacgtaacctaaacgtttacccaaaacggtaaaccctacgttactttacggttttacctttaacgaaagttaccgaaacgtacgtccgttaggaacggtaccgtaccgtaagtcggaaccccgaccgggttccggtttacgttaaacgttttccgtaggttcggaccggtaaacggtacgggtaaggttcccgggggaacccctaaacggggttaaacccgttacccgtaacgggtcccttaaagggttccgggaacccggttccgggttacgggggacccccgtaaagggggtaaccccccgg

SEQ ID NO: 183150 - DNA, 723 bp, Homo sapiens
  misc_feature: GYAE6OF01EMUYR.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccgagccgtcgggggtccctgagacctcctcctgtcgcagtcctcgtggttccaccgtcacgtcacacctacatgagcgtcgggtccccgcgacggcctaccggaggggaacggggcgtgggagtcggtcgttcttctttttaagttagttagttaggtcggttagtaacagttaccgtccgacgtacgtaccgttccggtggacggggtccctattccacctactcctaccaaggactaactaacgttaccaaacgacctacgtcctttagtttacctaacaaagttcgaaaacgtcgtacccgttaggaaccgcggtacccgaataccgggaccgtacccggggtacgttcggttaatttcccggtaggtccgaggtaaacggtacggtaccgggttacccggggacccccttaaaggtaaccccggtttacgacccggttacgttaacgtaccgggggttacctaccggggttccgggggaaaccctaacgggggtaacccccg

SEQ ID NO: 183151 - DNA, 818 bp, Homo sapiens
  misc_feature: GYAE6OF01D85L8.13.76.G10.1.454.CMB.1.raw
  modified_base (599)..(599): a, c, t, g, unknown or other
  misc_feature (599)..(599): n is a, c, g, or t
tcagtcacgtactacacgaccggtgctcgattttagtcactcatacagggggggagaggagcccagcactgggattccgaggttgtttccatttcggtgatcagcactgaacacagaggactcaccatggtagttttggtctgagtcgttgggttttccgttttgttgtacttaagttttaaaaggttagcccagtgtggaggtgcagcgtggtggagtcgtgggagggaggtcttgatccacggccggttcggggggtccccgtgacgtacgttccttcccgtgtgaccgacgtccgttccgttagggttccctaacccgtcgtaagttcccacctaaacccttacgataggtcggccgttcgggggtccccggacccgacgggtcccgtccggaagggggaacgggggtcgtgggtaggtcgcgtttcctttagtttttaattttagttaggtagttggtaacgttacgaacttaccgtcccgctaagtaccgtcccggtaggagggggtacccatttccaacccttacttcctcccgaaagaacgaaccgttaacttacccgaaagtaacccaccgttctttgttttacccttaanaaaagttcgaaactacgtccgtagaacgtacgacgtacgtacggaaccgtaccgggtaccggttttattacttacggttagacgggttaccgaagtagggttaccggtaaccgggggtaacccccaaccggtttaaaaggttcccgttaaaccggccttaagggttcccggggtactaccggggtaaccggggggttccccaaaacgggggttaccccg

SEQ ID NO: 183152 - DNA, 612 bp, Homo sapiens
  misc_feature: GYAE6OF01DGYKH.13.76.G10.1.454.CMB.1.raw
  modified_base (244)..(244): a, c, t, g, unknown or other
  misc_feature (244)..(244): n is a, c, g, or t
  modified_base (337)..(337): a, c, t, g, unknown or other
  misc_feature (337)..(337): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtcccgtgtccccgaggacacgacacgccagcatccacctgctctaggaaataagttggacagataatntacttctgtatcagacagagtcaggcctagtcccctgtcgctcggtctactctatacaagctcgaccgaggcccgcctacgacggtcctccgngacgcgtatccgtcgtcggtcctaccgtactcggtacggaacctcgaaccgtcctaacgtctaccggacctagtccggaacggacccgaccgtagtcctaggacgtagcggacgtacttacgtacttagttaccgtggtacgcgggtacggtacggacacggacacgacctacgtcgaccccgtagtacgttcgttaccggtaacggtccggtaccgggaaccgttaacccggtaccgttaacccgtaccgtaaccgtacccgacggaacccccg

SEQ ID NO: 183153 - DNA, 688 bp, Homo sapiens
  misc_feature: GYAE6OF01CVPJK.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacgaggactccgtcggcctcctatgacgctgactcacgcccacctcgagtcgtccgtcgtcccgaggacagacacgccacgcactccaccgtgtctacgtaaggaaattaagtcggacaagtaataaatacttacttcgtagttacacagacaaggacgtcgacggtcctacgtccgtagtcgtcgtcggtactatctaatacaagtacgtcgaaccgaacgtcccgtaccgtacggtaggtacctccggtagaacgtctacgttctcgtcggccttaacgacgttcggacggaactcacggtaccctcgtacgacaccgtagtaccggacgggaaccggtaaccgtaggtacgtaaggtacgggtagtacgggctactttaacggtatttaacggtcgttcggaacggtcgggacggtaccgggaactacggcgtacgaccgttacgcccgtccgttagtccggttaccgttaccggggacgtaaaccgggtcggttaaaccgaacccgggttccgttaaacccctaagggtaccctaccccgaaccgggtaaccccg

SEQ ID NO: 183154 - DNA, 693 bp, Homo sapiens
  misc_feature: GYAE6OF01DZLFX.13.76.G10.1.454.CMB.1.raw
  modified_base (533)..(533): a, c, t, g, unknown or other
  misc_feature (533)..(533): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttctgtgctatttaaaggtgccagtgtgaggtgcagctggtggagtcgtgggaggaggcttgatccagccgtgggggtccctgagactctcctgtgcagcctcgtgggttccaccgtcacgtcaccaccctacagtggacgtcgtcgggtcccgccgaggccgtaccggaggggaacggggcgtgggagtcggtcgttctttactttttattagtaaggttaggttaggtacgttaacgtagttacctccgaccgaggtaccgttccgggtagggtacgggggtcccgtaacgttccctaacctactccgttacccgaagaaccgtaactaacgttacccgaaaggaacgtaccgttctttcggtttaacctagaaactcgaaacncggtcgtagacggaacgcgtaagtcgaccgtacggtccgttattacgttctacggttgacggagacgtcgggtaccgggaccctaacggtaacgtcgttaccggatttacgggtaccggtacccgggttaggtacccggggccgtaaacgggtaccccgg

SEQ ID NO: 183155 - DNA, 782 bp, Homo sapiens
  misc_feature: GYAE6OF01AHCJX.13.76.G10.1.454.CMB.1.raw
  modified_base (179)..(179): a, c, t, g, unknown or other
  misc_feature (179)..(179): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgtcttaattttaaaaggtncccagtgtgaggtgcagcgtgggtggagtcgtgggaggaggcttgactccgaggtccggtcggggggtccctggacgtcctcctcgtgtgccacgtcctcgttcgggtccaccgtcgacgtcaccacctacgatgacgtcgtcgggtccccgccgacggtccgtaccgggaagggggtaacgggcggtacgggagttcggtccgtttacttttacgtttttaatttaggttaaggtttaggttagggttaacttaccgtacttacccgtaccgtaacgtacggtccgttccgggtacgggacggggtcctaacgttaccgactaccgtccctaaccgaaggtaaccgtaacctaacgttaaccccaaaggtaaccctacgttcctttagttttacccgtaaacgtaaacttacgaaaccgtccgtaactagggaacgtacggacccgtacgtaacgggaccgtaccgggtacgttagttaacgttacgttggaccgtacgggtaagtacgggcccgggtacgggtacccctaaacgggttacccgttactaccgggttactacgggttacggaccgggtttccggggacgggggtaaccccgg

SEQ ID NO: 183156 - DNA, 777 bp, Homo sapiens
  misc_feature: GYAE6OF01EKJRE.13.76.G10.1.454.CMB.1.raw
  modified_base (170)..(170): a, c, t, g, unknown or other
  misc_feature (170)..(170): n is a, c, g, or t
  modified_base (198)..(198): a, c, t, g, unknown or other
  misc_feature (198)..(198): n is a, c, g, or t
  modified_base (267)..(267): a, c, t, g, unknown or other
  misc_feature (267)..(267): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagcccaccctnagtcgtccgtcgtaccccaggacagacngccagcactccaccttgcctacgtaggaaaattaagtggacaagtaataaatacttacttcctaggtancagacaagtaacgtcgacgcctacgtccccgtagtcgcgttggtacctatcgtaatacgaagtacgtccgaccgtaaacggtccggtacccgttacggacggggtacctaccccggttaggaacggttcccgttaacgtttccgtcgtaccgggtaccctaacccgttaacgtccgggttaaccggtaacctacggtaaccccgtacccgttaaccgtaccgttaaccggaaccttaacgtacccgggaaccggggtaccccgggaacccggtaacgggttaaccttaacgggttacggggtacgttacgggaacggttccgttaaacgtaccggtttatttacggtcggtaccggtacggtcgggtaaccggacgttacgacgttacggaccgtacgtaccggtaccctacggttacgttccgttacggtacggttaaccggtaccggggtaacctaaccgggttacccgtacccgtaacggttaccgtcccgaaccggtaacccccgg

SEQ ID NO: 183157 - DNA, 863 bp, Homo sapiens
  misc_feature: GYAE6OF01DYYIC.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccagtggtagttttggctgagtcgttggttttcgttgttgtcttaagtttaaaaggtcgccgtagtgtgaggtgcagcgtggtggagtgtagggaggtaggtcttgactccgacggtccggtcgggggtcctagacgtacctcgtccgtgtgcgtacgtccgttcgttccggtaccgtaccgtacgtacgtaccaacctaaccgtaactagtcggaccggtcggttcgggtcccgaccgtaacgggtccgtaccggggaagggggtacgggaccggtgggtacggtggttaccgttttacgttttacgtttttaaagtttaggttaaaggttaggtttaacggttaacgtaacctaaccgttaaccgtaccgtaccgaacggttacccggtacgggtacgggaccgggtaccgttacctaaccgtaacctacgttacccgaactaacgacgtaacttaaacccgttaacgaaaacgtaccgttacgttaccgtttaagtttaacccttaaagaacgttaacaacgtacgttaccgtaaggaaccgtccggtaaccggtaagtacccggaaccggttaaccggttcgttaacggtttacgtacgggttagtacgggaacggtaacggtaaccggtaccggtaaccccgggtaacccttaaaccggggttaaccttaaccggtaacgtaggttaacccgggaagggtttacccgggtacggggtaacccgggtaaacccgg

SEQ ID NO: 183158 - DNA, 803 bp, Homo sapiens
  misc_feature: GYAE6OF01BPAQB.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtgggaggaggtcttgatccgaggccggtcggggggtccctggacgtactcctccgtgtcgcgacgtccttcgtcgggttcacccggtcacgtaccactacctacagtggacgcggtcgggtccgccgacggcgtaccggaggggaaggggtctgggagtcggtcgttctttactttttagttagttaggttaggttggtaacttaacgtacttaccgtcccgcgtaacgtaccgttccgggtacggtacggggtaccgtacgttaccaaccctacttcccgtaaccaagaacgtaacctaacttaaccgaaaagtaacccaccgttccttacgttttaccgttaacaaagtacggaaaccgtcgtaccgtacggaacggaaccggtacccggtagtaacccgggtaacccggtacccggggttaaccggttaggttaaacgtttaccggtgggtaccggacgggtaaagggaccggtaaccgggtaccggggaaccctaacccggttaaacccggtttcgaaaccggtacttaacgggtacgggttaaccgggttacgggttacccggggaaacccgggaaacggggttaaccccgg

SEQ ID NO: 183159 - DNA, 671 bp, Homo sapiens
  misc_feature: GYAE6OF01DCUY0.13.76.G10.1.454.CMB.1.raw
  modified_base (133)..(133): a, c, t, g, unknown or other
  misc_feature (133)..(133): n is a, c, g, or t
  modified_base (250)..(250): a, c, t, g, unknown or other
  misc_feature (250)..(250): n is a, c, g, or t
  modified_base (530)..(530): a, c, t, g, unknown or other
  misc_feature (530)..(530): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacgnggatccggtggcctcctatgagctgactcacgcccacctcgaggtcgtccgtcgtccccgaggacagacgagccagcatccactgctcagaatatggcagataatactactctgtancagacagacgtcgacgcctacgtcccgtgtcgtacgtcggtactacgtctaacgtacaaggtacgtacgaccgaacggtcccggaacccgtgacggtacctccgtagacgtcgttacgtcgtcgtacgcctaaccgtcgtacgtcgggaactcgaccgtccacgtccgtcggaacctcgacggtacggacccggacccgaggtcctaagtggacgtacggagggtaccttaacgacctttaaacgtcgttggtaacggtcgggtacgggtacgaaccggngtaccggcgtaccggtaccgtccggtcccgttagttaaccgggtcgtttaaccccgggtagggtaaaccgggaccgggttaaaccgtacccgggtccttaaaccggttaccccgtaacgtccggaacccgtaaaccccggg

SEQ ID NO: 183160 - DNA, 571 bp, Homo sapiens
  misc_feature: GYAE6OF01CGZ1B.13.76.G10.1.454.CMB.1.raw
  modified_base (293)..(293): a, c, t, g, unknown or other
  misc_feature (293)..(293): n is a, c, g, or t
  modified_base (327)..(327): a, c, t, g, unknown or other
  misc_feature (327)..(327): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataattggacagataaatatacttcctggtatcagcagaagtcaggccagtcccctgtgctggtcatctatcaagntgccaagcgcctgaggactccgtgagcgacttcnctcggctaccaacgtctaggactcgacgccactcctcggaccacgtacgacggccgggacccgtacggtacgtacggtaggtacgtaggagtaccgtacgttacgttactacgtcgacggtacggtcgggtacgaacgacgacgacaccgtcgccgtaccgtacgttcgtacgttccggtaaccggtacggaccggaaccgttacgtacctaccgaacgttaccgaacgcccggtaaaccccgg

SEQ ID NO: 183161 - DNA, 804 bp, Homo sapiens
  misc_feature: GYAE6OF01CLAMI.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaattttaaaaggtgccagtgtgaggtgcagctggtggagtcgtggaggaggcttgatccgagccgtgggggtccctgagactctcctgtcgcacgcctcgtcgggttcaccgtcacgtcacacctacatgagcgtcgggtcccgccgacggcctaccggaggggaaggggcgtgggagtcgcgttcttacttttatttagtagtaggtggttagtactagtacctccgcgagtaccgtccggtggacgggtaccgtattccaaccgtactcctaccgaaggaacgtaaccgtaactttacccgaaacgaaccgtaaccgtctttacggttttaccttaaccgtaaaacttacgaaacccgtaacgtacccgttaacggaacggtaaccggtaacccgtaacggttaacccgggaacccggtaacccggggttacccgtttaacggttaacgttttaaccgttacgggttacgggaaccgggtaagggtaaacgggtaaccgggttacccgggggggaacccccctaaaacccggggttaaaccggttttaaacccccggttaaccgggttacccggtttaaaggttacccggggtaaacccgggttccgggggttaacccggggggtaaaacccccgggg

SEQ ID NO: 183162 - DNA, 704 bp, Homo sapiens
  misc_feature: GYAE6OF01DCOD5.13.76.G10.1.454.CMB.1.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccncaggctccgagggagggctggagtgcgtctcttttattanagtagtggtatacgatactccgacacgactccggtgacggggcctagttccacactcctaccagaacgactaaacttacccgaaagaaccacgtctttacgtttaccttaacaaaagttcggaaaccctaggacccctttaggaacgggtaacggtaccccggtaaagttaccgggaaccggtacccgggtcccgtttaaggtttaaccgtttaaccggttggttaccgggaccggtaagggtaacggtaacgggttacccgggggggacccccctaaagggttaaaacccggttttaacccgtaccgggtacttaaacgggtcggggttaaacccggttccgggtaccgggggggtaaaaccccgg

SEQ ID NO: 183163 - DNA, 776 bp, Homo sapiens
  misc_feature: GYAE6OF01DCHHN.13.76.G10.1.454.CMB.1.raw
  modified_base (315)..(315): a, c, t, g, unknown or other
  misc_feature (315)..(315): n is a, c, g, or t
tcagtcacgtactacacgaccggtgctcgatttagtcactcatacaggggggagaggagcccagcactgggattccgaggtgtttccattcggtgatcagcactgaacacagagactcaccatggagttttggctgagctgggttttccttgttgcttattttaaaaggtgcccagtgtgaggtgcagtcgtggtggagtcgtggaggaggtcttgactccgagtccggtggggggtccctggacgtcctctccgtgtcgcacgtcctcgtcggttccaccgtcacgtccaacacctacatcgagcgtggtcccncgacggcctacggaggggaaggcgtggagtcgcgttctttattttagttataggttagttagtagttaacattaccgtccgacacgtaccgttccggtagggacggggtacctacgtttccacccgtaacttccgtaacccgaagtaaccgtaaaccttaaacctttaaccgaaaacgtaacccgtaaccggtactttaacggttttaaccttaaaccgtaaacgttacgaaaccgtcgtaccgtacggtaacggaccgtacgtaacctacgggtaacccgacccggggttaccgttacggtttaaacttaccgggtacggtacggaaccggtaaggtaaccgggtacgggttaccccggggaaccctaaacccgggttaaacggttaaccctacgggtaacttacgggttacgggaaccggttaccgggtaccgggaaaccggtaaccgggtaaccccgg

SEQ ID NO: 183164 - DNA, 983 bp, Homo sapiens
  misc_feature: GYAE6OF01BBVZF.13.76.G10.1.454.CMB.1.raw
  modified_base (818)..(818): a, c, t, g, unknown or other
  misc_feature (818)..(818): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggttttccttgttgtacttaagtttttaaaaggtcgcccgtagtgtggaggtgcgagcgtgggtggtagtcgtggaggaggtcttagacgtccgacggtccgggttcgggggtccctaggacgtaccgtcctccgtgtcgcgaccgtccgttcggttccgggttccacccgttacgaccgtacctaaccccgtaaccttaactagtaggacggtccggtccgggtaccccgcccggacggtcccggtaccggggaacgggggtaaccgggtccggtaggggtacgttccgggttaccgttttccgtttttaacgttttttaagttttaagttaaggggttttacgggttaacggttaaccgttaaacctaacgttaaacccccggttaacccaaacccggttaacccggtaccgggttaacccgggtaacggggtacccggggtaacccgtaacgttacccctaaaccgtaccgttaccctaaccgaaacggtaaccgtaaaaccgttaaccgtttaacccgaaaaacggtacccgtaccgtttacgttttaccttttaaaccgttaacgtaaaagtaccgtaaacccgtacgtaccggtaagaaccgtaaccggacccgttaagacccgggtaacccggtccggttaggttaacctttaggttaacccgnggtaacccgggaagtaaacgggttccgggtaaacccggggttacccgggtacccgttaaaacccgggttaccggtttaaaccgaccgggttgaaccgggttacggggttcccggtaaaccgggggttacccggggaaccccggtaaccggggtaaaccccccggg

SEQ ID NO: 183165 - DNA, 387 bp, Homo sapiens
  misc_feature: GYAE6OF01DL13Z.13.76.G10.1.454.CMB.1.raw
  modified_base (181)..(181): a, c, t, g, unknown or other
  misc_feature (181)..(181): n is a, c, g, or t
  modified_base (190)..(190): a, c, t, g, unknown or other
  misc_feature (190)..(190): n is a, c, g, or t
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (314)..(314): a, c, t, g, unknown or other
  misc_feature (314)..(314): n is a, c, g, or t
  modified_base (319)..(322): a, c, t, g, unknown or other
  misc_feature (319)..(322): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
  modified_base (330)..(387): a, c, t, g, unknown or other
  misc_feature (330)..(387): n is a, c, g, or t
tcagtcacgtactacacgaccggtgctcgatttagtcactcatacaggggcttctaatcgggactctggggtcccaagagagattcagcggcagtgggtcaggcacttatttcacactgaaaatcgacagggtggaggctggaggatggctgggggtctattactgcatgcaagctacacnctgcctcgntcaccttcggccaagggcacgctgganatagaacaactgnggacttgcaccgatctgtctcactctcccgnatcngatgacgtnactggacgcgggntggacaaacggtcgaccaagtagcgtnacagnnnnangnanannnnnnnnnnnnnnnnnnnnnnnnnnnnnnnnnnnnnnnnnnnnnnnnnnnnnnnnnn

SEQ ID NO: 183166 - DNA, 821 bp, Homo sapiens
  misc_feature: GYAE6OF01C5P25.13.76.G10.1.454.CMB.1.raw
  modified_base (180)..(180): a, c, t, g, unknown or other
  misc_feature (180)..(180): n is a, c, g, or t
  modified_base (225)..(225): a, c, t, g, unknown or other
  misc_feature (225)..(225): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagtttggctgagtcgttgggttttccttgttgtcttaagttttaaaaggtcnccgagttgtggaggtgcagtcgtgggtggagtcgtggaggaggtnttgactccgaggtccgggtcggggggtccctaggtacgtaccttccgtccgtggtgccgtacgtcctccggttcgggtacctaccggtctacgtaccaaccaccttacgagttacgacgtcggtccgggtccgccggacggtccgttaccgggaaggggaacgggtcgtgggacggttgtccgtttcgttttacttttaagtttacgtaggtttaggttacggttaactaaacgttaccgtaccgtaccgtacgacggttacccggttcgggtacgggtacggggtaccctagtttaacccgaacgttaccttaccgtaccgaagtaacgtaaacttaaccttaaccgaaacgtacctaccggttactttacgtttaacccttaagaaaacgttcgaaaccgtacgtacctaggaacgtacgtaaccgtaacggtccggaaaccggtacccggttacggttaacgtttaacgttacggttcggacggtaaaccgggtgaaccgggtacggttaccggggaacccgtaaggttaccgtaaccgttacgacggttagtaccgggttcggtacggaccgggtaaccggccggtaacccg

SEQ ID NO: 183167 - DNA, 799 bp, Homo sapiens
  misc_feature: GYAE6OF01B1P3Z.13.76.G10.1.454.CMB.1.raw
  modified_base (356)..(356): a, c, t, g, unknown or other
  misc_feature (356)..(356): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggtcttggaactcccaggcccggttcgggggggttccccctaggaacgacccttccgtcccgttggtacgcacggtcccttcgttcggggttaccacccgtcgagttcccaacctaaccctacagtcggacgtccgtcgggtcccnccgacggcctccggagggggaacgggcgtaggggagtcggtccgttctttacgtttttagtttacgtaggtttagggttaggttaacgttaccgtaacgttacccgtcccggtactaccggtaccgttccgggtacgggaccgggggtccctaacttccgaaccctagttcccgtaccgagaaccgtaaaccttaaacgtacccgaaaacgaacccgtacgttcctttaacgtttacctaacgaaagttcgaaacctccggccgtaaggaacggtaccgccgtaagtaccgggaaccgaccgggtacgtttagttacttaccggtgtcggtacggaagtacgacggggttaccggacccgttaacggttaaccgttaaccgccgtaagttaccggtaccgggaccggttaccgggtacggggaacccgaacgggggtaccccg

SEQ ID NO: 183168 - DNA, 625 bp, Homo sapiens
  misc_feature: GYAE6OF01CCEPJ.13.76.G10.1.454.CMB.1.raw
  modified_base (296)..(296): a, c, t, g, unknown or other
  misc_feature (296)..(296): n is a, c, g, or t
  modified_base (307)..(307): a, c, t, g, unknown or other
  misc_feature (307)..(307): n is a, c, g, or t
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagtcacgtactacacgaccggtgctcgatttagtcactcatacagggggggagaggagcccagcactgggattccgaggtgttccattcggtgatcagcactgaacacagagactcaccatggagttttggctgagtctgggttttccttgttgcttaattttaaaaggtcgccctagtgtgaggtagcagcgtggtggagtcgtggaggaggtcttgactccgagccgtgggggtcctgagtactctcctgtgcagtcctcgtggttcaccgtcacgtccacgacctacatgngctcgggtccncgaggccgtacgaggggaaggcgtggagtgtcctagtttctttattataggtacgtggtaagtacataccncgacagtaccgtccggtaggaccggggctacgtcgaacctatcgtaccagtaacgacctaagtaccaaggaactcggacttgttacaagaatgaacnggctagngactcggataccggnaacgggtccttaggtacttaacgngtacggaggaacgtggacggtaccgggaccctaaacggtaaaccggttacacggaacctttcggagggtaaccctgggtaccggggacctaaagggggtacccc

SEQ ID NO: 183169 - DNA, 676 bp, Homo sapiens
  misc_feature: GYAE6OF01CR6E1.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaattaatggcagataaatatacttcctaggtatcgagcagaagtcacggccacgtcccctggtcgctggtctatctatcaagatcgaccaacgccgccctacgaggtacctccgtagacgcgtactttccgtcgtcggcccttacccgaacgttcggtacggaacctaccgaccgtccctaccgttcctaccgaaccctacgaccggaccgggaccccgggtaacccagggtacctagagggtacgtcgggacgtccgttagtaaccgttaacgtttaccgtcggttacggacgggtcggtacgggacctacggaccgtacgccgttaccgtccggtaccccggtattacggtcggtttacccggttaacggtaacccggttaccgggaaacccgttaccgggtaccccggtaaacccgtttaccgaaccggtccccgaaccggtaaaccccccggg

SEQ ID NO: 183170 - DNA, 556 bp, Homo sapiens
  misc_feature: GYAE6OF01BGTL4.13.76.G10.1.454.CMB.1.raw
  modified_base (362)..(362): a, c, t, g, unknown or other
  misc_feature (362)..(362): n is a, c, g, or t
  modified_base (475)..(475): a, c, t, g, unknown or other
  misc_feature (475)..(475): n is a, c, g, or t
  modified_base (541)..(541): a, c, t, g, unknown or other
  misc_feature (541)..(541): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcagggagtggattctcagactgtggtgacccaggagccatcgttctcagtgtctccgtgggagggacagtccacactctacttggtggcttggagatacggctcagtcttctagtacgttacctaccccagctggtaccaacacgaccccaggccaggctccgcgcacgctcatctacacacaacactcgctcttcgtcgggtccctcatcgtcttctctcggctccncttcgtagggaacaaacgtctacgccttatacacgtcggaccggggtcccaggcaagaagatagaatcgtatattattactggttatttcttagtagtgggtagtcgtacttntttctgtcgttgttgttgggagtcggccgaccggtcgtcgacccggtcgtccgcgcgaccgacgcnccgccgtgtacccgg

SEQ ID NO: 183171 - DNA, 350 bp, Homo sapiens
  misc_feature: GYAE6OF01D1WI4.13.76.G10.1.454.CMB.1.raw
  modified_base (302)..(302): a, c, t, g, unknown or other
  misc_feature (302)..(302): n is a, c, g, or t
  modified_base (325)..(350): a, c, t, g, unknown or other
  misc_feature (325)..(350): n is a, c, g, or t
tcagtcacgtactacacgaccggtgctcgatttagtcactcatacagggcttctaatcgggactctggggtcccagagagattcagcggcagtgggtcaggcacttatttcacactgaaaatcgacagggtggaggctgaggatgctggggtctattactgcatgcaagctacacactggcctccgctcaccttcggacctaagggaccacgactggagatagaacgaactgtggactgacaccatctgtcttcacttccttcccgcattcctagataagtcgtgacctggacggcgggtcngggtacgaacggtcgacagtagnnnnnnnnnnnnnnnnnnnnnnnnnn

SEQ ID NO: 183172 - DNA, 654 bp, Homo sapiens
  misc_feature: GYAE6OF01AIAUI.13.76.G10.1.454.CMB.1.raw
  modified_base (171)..(171): a, c, t, g, unknown or other
  misc_feature (171)..(171): n is a, c, g, or t
  modified_base (210)..(210): a, c, t, g, unknown or other
  misc_feature (210)..(210): n is a, c, g, or t
  modified_base (527)..(527): a, c, t, g, unknown or other
  misc_feature (527)..(527): n is a, c, g, or t
tcagtcacgtactacacgaccggtgctcgatttagtcactcatacagggtctgggagaggagcccagcactgggattccgaggtgtttccattcggtgatcagcactgaacacagaggactcaccatggagttttggctgagctggtttccttgtgtcttatttaaaggtncccagtgtgaggtgcagcgtggtggagtcgtggagaggntgatccgaggtccgtcgggggtaccctggacgtaccgttcctccgtgtcgcgacgtccgtcgtcggttccaccgtcagtaccacctacctacagtgacgtccgtcggtcccggcctacggacctccggaaggggacgggcgtaggtgtcgtacggttcttacgtttattagtagtagtagtacgtatagtacctcgcaacgtcgtcgtagggcggtcgtatccactactcacgagtactaactacttaccaaacgtacgaccgttcttgtttaacctactaaagccgtaacgtcaacgtagaacggtcgaccggtanaccgtaaccgtaccggtaccgtaagttacgtactagtcgaacggaatcgggacgggtaccccgaccgtaaccggtacgttaacctacggtactacggtacgggtacgcgggttaaccgggaaccggg

SEQ ID NO: 183173 - DNA, 960 bp, Homo sapiens
  misc_feature: GYAE6OF01COLG0.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagaggactcaccatggtagtttggctgagcgttgggttttccttgttgacttaattttaaaaggtcgcccagtgtgaggtgcagcgtgggtggaggtcgtgggaggaggtctgactccgacggccgggttcgggggtccctaggacgtacttccgtccgtggtcgccgacgtccgttccggttacggggttacccacccggttacgacgtaccaacctaaccctacgtagtcggtacggtccgggttaccggggtccccgaccggtaaccgggtaccggttacccggggagggggtaacggggtcgtacggggtacggttcggttccgttttacgttttaccgttttttaagtttaaggttaagggtttaacggttaggttaacgttaactaaccgtaccgtcccgtaccgtaacggtacccgtccgggtacgggtaaccgggggtacccttaacgttacccaaccgtaacttacccgaccgaagtaaccgtaacgtaaaccgttaaccgaaacgtaacccgtaccgttacgtttaaccgtttacgttaaacgtaaacgtaacgtaaccgtacgtaccggtaaggtaacggaaccgtacggttaacgacgggtaccccgtaaccggggttaccgtttaacgttacggttaacgttacgggtacgggaacgggtaacgggtaaaccggggttaccggggtaaccccggggaacccccgttaaaaccggggtttaaacccggttacccggttaacccggtaacgggtttacgggtaacccggggttaccgggttaacccggggggtaacccggggaaaccccggggtaaaccggggttaacccccccggg

SEQ ID NO: 183174 - DNA, 685 bp, Homo sapiens
  misc_feature: GYAE6OF01BAUP5.13.76.G10.1.454.CMB.1.raw
  modified_base (494)..(494): a, c, t, g, unknown or other
  misc_feature (494)..(494): n is a, c, g, or t
  modified_base (506)..(506): a, c, t, g, unknown or other
  misc_feature (506)..(506): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtcgtgggaggaggcttgatccgagccgtgggggtccctgacgtactctcctgtcgcacgcctcgtgggtccaccgtcagtcacacctacatgagcgtcgggtccgccacggcctccggagggggaacggggtcgtagggacgtcggtcgttctttactttttatttagttaggttaggttggtaagtactagtaccgtccgacgacgtaccgtccggtaggacggggtccgtattccacctattcctaccgaagacgaactaacttaccgaaagaccctacgtctttgtttacctanaaactgaaaccngtccctaggacgtacgccgaatcggaaccgtaccgggtccgttagttaacttcggtggtacgaccggtagaaccggtcggtacccggggccctaaacgggttaaccgtttaccgacggtacttaagggtccgggtaaccggttcgggtaccgggggaaccccgtaaaggggtacccccg

SEQ ID NO: 183175 - DNA, 723 bp, Homo sapiens
  misc_feature: GYAE6OF01DNOZE.13.76.G10.1.454.CMB.1.raw
  modified_base (314)..(314): a, c, t, g, unknown or other
  misc_feature (314)..(314): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtcgcccagtgtgaggtgcagcgtggtggagtcgtggaggaggtcttgactccgaggccggtcggggggtccctgacgtaccttctccgtgtcgccgcgtcccgtcgttcgggttccaccggtcacgtaccaccaccctanatgacgtcgtcgggccccgtccgaggtccgtaccgggaagggggtacgggccgtagggacggtggtccgtttacttttacttttaagttagttaggtagttggtactataactacctccgactaacgtccgttacggcgggtacggggtacctattacccaccgtatccgtacaaggactactaacgtaccgaaagaccctcgtactttgttaccttaacaagtaccgaacgacgtccgtaggaccggtacgacgtacgtacgaaccggtccgggttacgttacgttaacttcgttcggacggacgtacgggtaggtacccgggtaccgggtaaccctaaccggttacgtttaccgaccggttgtaacggtcgggtcctacggggacgggtaacccgtaacggggaccc

SEQ ID NO: 183176 - DNA, 967 bp, Homo sapiens
  misc_feature: GYAE6OF01B8QY5.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctctgcgtccttgcttactgcacaggatccgtggcctcctatgagctgactcacgccaccctcagtcgtccgtcgtccccaggacacgaccggccaggtacttaccgtggtacgggggaaaacaacgtagttaggaaagtaaaagtgtgcactggtaccagacagaacgccgaggcccgacggtccctgtcgcgtggtccgtctagtggttagacgtacggaccggaccggccctacggacgggtaccttccccgtaggacgtcgtactttccggtccgggtcctacccgtaacgttcggtaacgggaacccgaccgggtaccctaacgtccgtaccgaaaccctacgttaaccggtaacgggtttaaccgggggtaaccgggaaaccgggggtacccggggggtaacgttaacgggggaacccggggtaccccgggtaaacccgttttaaacgggtttaaccgttaccggggtttaaccggtaacgggggttttacgggggttaacgggggttaaacggttttaaacggggttaacggggttttaccgggttaacgggtaaccgggtacggtttaaagggttttcgggggtttaaccggggtttaacgggttttacccgggggggaacccgggggtaaacggggtaaacccccggtaaaaccggtttcccggggtaaaccccgggtttacccgggttaaacggggtacccggaaaccccgggtaccccgggtaaacgggtccccggttacccccgggtccccccccggtttaaccgggttcccccgttaaccccggtttccccggttttcccccgggtttccccccccgttcccccggttccccggtttaaccccggg

SEQ ID NO: 183177 - DNA, 650 bp, Homo sapiens
  misc_feature: GYAE6OF01B8J97.13.76.G10.1.454.CMB.1.raw
  modified_base (298)..(298): a, c, t, g, unknown or other
  misc_feature (298)..(298): n is a, c, g, or t
  modified_base (481)..(481): a, c, t, g, unknown or other
  misc_feature (481)..(481): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtccgtcgtcccccaggacagacagccagcatccacctgcctctaaggaaaattaaattggacaagaattaaaatacttaccttccgtaggtatcagacaagaagtcaggcctacgtccccgngtcgcgtgtcatctatacaagatcgaccgaacggccggcccgtacggacggtacctccgtagacgtcgtactttccgtcgtcggaccttacccgtaactcggtacggaacctcgaccgtacccacttctaccgaacctacgaccggacggacccgggaacccgagtaccgttaggtaggtaancggtagtaccgtagtaaccttagttaccgtggtaccggacgggtcgtacgggacacgacgtacgcctaccgccgtcccgtagttcgtccggttacgtaccggtaacggtaccggtaaacccgtacggtaccgtaccccgttacgaaccgtcccggaacgtaacccccgg

SEQ ID NO: 183178 - DNA, 826 bp, Homo sapiens
  misc_feature: GYAE6OF01BCQSL.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcagcgtggtggagtcgtgggagggaggcttgatcccgaggtccggtcggggggtccctggacgaccttccgtcctggtgcacggtccttcggtcgggttccacccgtcacgtccaaccacctacagtgacgtcgtcgggtcccgccgtacggccgtaccggaaggggaacgggtcgtagggacggttcggtccgtttctttactttttaagtttaagttaaggttaggttacgggttaacgttaacgtaactttacccgtacccggacgtaacggtacccggttaccgggtacggggaaccgggggtacccgttaacgtttacccgtaacccgtacgttacccgttaacccgaaggtaaccgtaaaccttaaaacgttaccccgaaaaagtaaaccccgtaccgttaacccgttttacggttttaaccttaacgtaaaaacgttacgaaaccgtaccggtacccgttaaggaacgaccgacccggtagaacccggtaacccgtacgggtaccgttaagttaacgtacgtaggtacggaccggaaggtacgtaacgggtacccgggacccttaaaggtaccgttaacgacgtaccgtaggtaccggtacggtcggacgggaaccgtaacggggacccg

SEQ ID NO: 183179 - DNA, 672 bp, Homo sapiens
  misc_feature: GYAE6OF01ETBHB.13.76.G10.1.454.CMB.1.raw
  modified_base (465)..(465): a, c, t, g, unknown or other
  misc_feature (465)..(465): n is a, c, g, or t
  modified_base (495)..(495): a, c, t, g, unknown or other
  misc_feature (495)..(495): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
  modified_base (578)..(578): a, c, t, g, unknown or other
  misc_feature (578)..(578): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatgggtagttttggctgagtcgttgggtttttccttgttgtcttattttagaaggtcgcctagtgtgaggtgcagctgggtggagtcgtgggagggaggtcttggactccgacggtccggttcgggggggtccctggacgtacttcctcctggtcgcacgtccttcgttcgggttaccaccgtcacgtccaaccaccttacagtcgacgtccgtcgggacccgccgacggtccgtacggaaggggacgggcgtgggacgtgtcgttcttacttttattagtaggttagtggtatactactacgtcgactacgcgtcggtggacggtcgtattccactacnctacgaagacgaactaactacgaaacgtancgttcttnttacctanaaagtctaaacgcgtactagacgacgtacgacgtcgaaccgtcggtaccgtattacggtactcgggngaccggaggtaacgtcgggtacgggaaccccctaaaggttaccggtaaccgttcgtaacggttaagtccgggtaacccggtgggtaacccgggg

SEQ ID NO: 183180 - DNA, 786 bp, Homo sapiens
  misc_feature: GYAE6OF01C8LPE.13.76.G10.1.454.CMB.1.raw
  modified_base (507)..(507): a, c, t, g, unknown or other
  misc_feature (507)..(507): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggttttccttgttgacttaagttttaaaaggtcgcccagtgtggaggtgcagcgtggtggagtcgtgggaggaggtcttgactccgaggccggtcgggggtcctggagtacgtcctccgtgtcgcgtacgtccttcgttcggttccaccggtcacggttaccacctacctaacacgtggacggtccggtcgggtacccgaccgacggccgtaccggagggggtaacgggcgtggacggtgtacgttcttacttttattagtagttagtaggtacgtaactagtaccgtccgtacgacggtaccgttcggtaacggacgggggaccctacgttacccgaacctactcgtaaccgacgtaanaaccgttaattaaccgaaacgtaactacgttacgtttcgtttaaccctaaagtaagtaacgaaaccgtacgtccgtaagggaacgaccgtacccggaataccgaacccggtaccggggttacctaacgtttaacgttcgtacgggtacggaaccggttaaggacggttacggacccggggtaccccgtaagtttaaacccggttaccgaaccctagtaacgggtaccggggtacggtaccggggtaccggggaacccggtaaaaccgggtacccccggg

SEQ ID NO: 183181 - DNA, 782 bp, Homo sapiens
  misc_feature: GYAE6OF01EZIOF.13.76.G10.1.454.CMB.1.raw
  modified_base (306)..(306): a, c, t, g, unknown or other
  misc_feature (306)..(306): n is a, c, g, or t
tcagtcacgtactacacgaccggtgctcgatttagtcactcatacaggggtctgggagaggagcccagcactgggattccgaggtgtttccattcggtgatcagcactgaacacagaggacctcaccatggagttttggctgagcttgggtttttccttgttgcttaattttaaaaggtgcccagtgtgaggtgcagctggtggagtctgggaggaggcttgactccagccgtggggggtccctggacgacctctcctggtcgcacgtccctcgtgggttccaccgtcacgtccaacctaccctanatggacgtccgtcggggtcccgccgacggccttccggaagggggaagggggcctgggagttggccggtttctttctttttaacgtttagtaaggtagttggttaagtactacgtacctccgcaggtacctccggtggacggggtccctagttaccaccctagtccctaccgaagaacgaacctaaacttacccaaaacggtaacccgaccgtcgttttacgttttacctttaaccaaaagttaccgaaaccgacgacccgttaggaacgggtaaccggtaaccccggtaagtaccggaacccgtacccggggttaccgtttaagttaaccgttttaaccggtggtacggtacggaacggtaacggtaccgggttacccgggggaacccccttaacgggtaaacccgtttaaccgtaacccggtacggtttaacgtaccggggttaccggtccgggtacgggggtaaacccccgggg

SEQ ID NO: 183182 - DNA, 878 bp, Homo sapiens
  misc_feature: GYAE6OF01DPTT1.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttttcctgttgcttatttaaaggtgcccagtgtgaggtgcagctgggtggagtcgtagggaggaggtcgttgactccgacggccggttcggggggtccctggacggtcctccgtcgtgtcgacgcgtccttcggttggttacctaccgtcgtaacgtccgtaacctacctaacgagtcggacgtccggtccgggtacccggaccgacgggtccgaccgggaaggggggtaacggggtacgtacggggtacggttcggtccgttttaccgtttttacttttaacgttttaacggtagggtttaacggtttacggttaacggttaaccttaaccgttacccgttacccggacccgtaacggttaacccggtccggggtacggggtaccgggggtacccgttaacgtttaccccgaaccgtaaccgttaccgttaacccgaaagggtaaccctaaacgtaacccttaacccggaaacgtaaaccgtaaccgttcgttttacgttttaactaaccgtaaaataccggaaacttacggtaccgtaggaacggacccgggtacgagtaacccggaaccgacccgggtttccgtaagtttcgttaacggtgggaccgtaggaaagtaggtaaccgggttacccgggaacccctaaggttaaacccggttccgtacgttaaccgtcgggtaccggttaaccgggtaccgggtaaccgggggaccgtaaaacgggtccccgg

SEQ ID NO: 183183 - DNA, 754 bp, Homo sapiens
  misc_feature: GYAE6OF01BG2FS.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagcttgggttttccttgttgcttagttttaaaaggtgcccagtgtgaggtgcagctggtggagtcgtgggaggaggcttgactccgacgccggtcgggggtccctgacgacctctcctgtgcacgtcctcgtcgggttccaccgtcacgtccaccgacctacagtgacgtcggtcggtccccgccgaggccgtaccgggaggggacggggtcgtgggtacgtcgtcgttctttacgtttttattacgttaggttaggtggtacgttaactacgtaccgtcgacgtacggtaccgtcggtaggacggggacctactcccgactactccgtacgaagacgtaacctaagttaacccgaaagtaacccgtaccgttaccttttagttttaaccctaacgtaaagttaccgaaaccgtaccggtacccgtaagggacggtaacccggacgtacgtaaccgggaaccccggtacgggttaccgttagttaccgttaaccggaggttacggaacggtagacggttaccgggtcccgggaaccctaaacggttaccgttaccgcgttacgtacggttaacggtaccgggttccgggtacggaaccccgggtagggtaacccccg

SEQ ID NO: 183184 - DNA, 700 bp, Homo sapiens
  misc_feature: GYAE6OF01B83IS.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtgggggtccctgagactctcctgtgcacgcctcgtggttcaccgtcagtcacacctacatgagcgtgggcccgcgacggctaccgaggggacgggcgtggagtgtcgtctttcttttagttatagtagtggtagttacactaccgtccgacgacgtaccgttccggtaggtacgggggtaccctacgttaccaacctacgtcccgtaccgaaggaactaaccgtaaacgttacccgaaaacgtaaaccgtaccggttactttacggttttaacctaacgtaaacgttacgaaaccgacggtacctaaggaacgacgtaccgtactaccggaccgaccgggtaccgttagttaacttacgtcggtagaccggtaaggacgtacggtccgggaacccctaacggtaaaccgtttcccgaaccgtaccgtacggttaccggaccggttacggaccggggtaccgaaccggggtaaccccg

SEQ ID NO: 183185 - DNA, 687 bp, Homo sapiens
  misc_feature: GYAE6OF01EA0OU.13.76.G10.1.454.CMB.1.raw
  modified_base (518)..(518): a, c, t, g, unknown or other
  misc_feature (518)..(518): n is a, c, g, or t
  modified_base (583)..(583): a, c, t, g, unknown or other
  misc_feature (583)..(583): n is a, c, g, or t
tcagtcacgtactacacgaccggtgctcgattttagtcactcatacaggggctgggagaggagcccagcactgggattccgaggtgtttccattcggtgatcagcactgaacacagaggactcaccatggagttttggctgagctgggttttccttgttgctattttaaaaggtgccagtgtgaggtgcagctggtggagtctggaggaggcttgactccgagccggtgggggtccctgacgtactctcctgtgcacgtcctcgtggttccaccgtctacgtcaacctacctacatagagcgtcgggtccgccgacggcgtccggaagggggaaggggctgggagtgtccgttctttactttttattagtacgtagttggtagtactacttaccgtccgacgtaacgtccgtccggtgggaccggggtaccgtacttccgaaccctacttccgtaacccgaaggaaccgtaactaaaccttacccaaaggtaacctaccgtctttagtttaccttaanaaactcgaaacacgtccctaggacgacgaccgtagacggaccgccggttcgttagtacgttacgnggtacgacggtaaggacgtacgggtccgggaaccccctaacggttaaaccggtttactaccggtacttacggtaggtaccgtcggggtacgggtaaaccccggg

SEQ ID NO: 183186 - DNA, 815 bp, Homo sapiens
  misc_feature: GYAE6OF01B378Q.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagagactcaccatggtagttttggctgagtcgttgggttttccttgttgtacttaagttttaaaaggtgtcctagtgtgaggtgcgagcgtggtagaggtcggtgggggaggtggtgggtaccggtccggtcggggggtccctcgacgtacttcctccgtggtcgacctaaccgtcgtaggtacttcgtagttagtttgagtagtagttagtggactaataccgtaccggttccggtacccgtaccccgaaaccccggtaccgggaagggggtaacgggtccgtaggcggtacggttcgggttccgttacgttaagggtaaacgttaaacggtagggtaaggttcgggtaccgaccgaacgtaaccgtaaactaaacgttacgtagtaaccgtacggtaacttcggtaggtaacgggaaccggtaccgttaacgttaccaaccgtacgttcccgaacgaggtaaacgcgtacgggtaccggaaacccgttaacttaaccccggtcccgtaataccggttacgtaacgaaaaccgtaacgtaccgtaacccggtaggttaccgggaacgggtaacgtccgggaaaaccggtccgttaccggtttacctttggttacgttccgagggttacgtacgggttattccggagttcggtcgggtacttaacgggtaccacggaagtacggtcggggccgttacgggg

SEQ ID NO: 183187 - DNA, 611 bp, Homo sapiens
  misc_feature: GYAE6OF01EBG9M.13.76.G10.1.454.CMB.1.raw
  modified_base (369)..(369): a, c, t, g, unknown or other
  misc_feature (369)..(369): n is a, c, g, or t
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (509)..(509): a, c, t, g, unknown or other
  misc_feature (509)..(509): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctgagactctcctgtgcagcctgttcgggttccaccgtcagtccacacctacatgacgtctcgggtccgccagggcctaccgaggggaagggctggagtgcgttctcttttattatagtagtggtatacatacncgcagactcgtgacgggccgtattcactatctacagagactaactaccaagtaacncgtcttacgtttcttanaaacgtcgaactcgccgtagagaacgccgtaatcggtaaccgacgggtccgttaggtactttaccgngttcggacgaaggtacggtacggttaccgggggacccctaaacggtaaccgttacgaaccggtcttaacggtccggtaacggtcgggtacggggaaccccgg

SEQ ID NO: 183188 - DNA, 716 bp, Homo sapiens
  misc_feature: GYAE6OF01C6ERO.13.76.G10.1.454.CMB.1.raw
  modified_base (206)..(206): a, c, t, g, unknown or other
  misc_feature (206)..(206): n is a, c, g, or t
  modified_base (314)..(314): a, c, t, g, unknown or other
  misc_feature (314)..(314): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (520)..(520): a, c, t, g, unknown or other
  misc_feature (520)..(520): n is a, c, g, or t
tcagtcacgtactacacgaccggtgctcgatttagtcactcatacgagggggggagaggagcccagcactgggattccggaggtgtttccattcggtgatcagcactgaacacagaggactcaccatggtagttttggctgagcgttggttttcctgttgcttaagtttaaagtgcccagtgtgaggtgcagcgtggtggagtcgnggaggaggtcttgactccgaggccggttcgggggtccctggaactctccgtccgtgtcgctacgtcctcgtcgggttccaccggtacagttaccaacctaccgtaacngtacgcggtcgtcggggtacccacgacggccaccgggaaggggacggngtggacgtgtaccgttntttacgttttagttagtagtagtggtagtactacgttcgccgacaaggtcctcggtacggacgggtctacgttaccacctatccaacgagaacgtaacaacgtaccaaacgtaacacgtcgtttacgttactacgtaaacnggaaccctaggtccgaaggagaccggaccgtagtaccgaccggtaacggtccgttaacgttactcggtgtacgggacggtacggtaacggacggtaacccggggaacccgtaacgttaacccggttacgtaaccgtacggttaacgtaccggggttacgtaccgggtaccggggaaccgtaaccggggtaccccgg

SEQ ID NO: 183189 - DNA, 756 bp, Homo sapiens
  misc_feature: GYAE6OF01A2RQD.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggtcttgatccagccgtcggggggtccctgagacctctccgtgtcgcacgcctcgtcggtcaccgtcagtcaccacctacatgagcgtcggtccgccgaggccgtccggaggggaacggggcgtgggagtcggtcgttcgtttcttttaatttagtagttaggtggttacgtactacgtaccgtccgcgaacgtaccgtccggtacgggacggggtacccgtacttaccaacctactccgtaccgaaggtaacaaccttaaacttacccgaaaagtaaccctaaccgtcttttacctttacctttaacaaacgttagaaaccctaggtaccctaggaacgaacgaccgtaagtacggaacccggtaccgggtacgttacgttaacgtttacgtggtagggaccggaaggacggtacgggttacccgggggaaccccttaaaccgggttaaaccggtttaaaccgtaccgggttacctttaacgggtacccgggttaccgggttaccgggtcggggggaaacccccggtaaacgggggtaacccccgg

SEQ ID NO: 183190 - DNA, 731 bp, Homo sapiens
  misc_feature: GYAE6OF01ESZ18.13.76.G10.1.454.CMB.1.raw
  modified_base (687)..(687): a, c, t, g, unknown or other
  misc_feature (687)..(687): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttattttaaaaggtgcccagtgtgaggtgcagctgggtggagtcgtggaggaggcttgatccagccgtcggggggtccctgacgtacctctccgtgtcgcacgccttcgtgggttccacccgtcagtcaaccacctacatgagcgtcgggtcccgccgaggccgtaccggaagggggaaggggcgtggggagtcgtccgttctttactttttatttagtaggttagttggtaattacattaccgtccgacacgtacgtccgggtacggacgggggtccgtacttaccaacccgtatcccttacccgaaggaactaacccgtaaactttaccccgaaaacgtaaaccgtaccgtaccgttttacgtttttaaccccttaaacgaaaactttcggaaaaccctacgggtacccttaggaacggtacggacccgtaagtccggaacccgtaccggggtccgttagttacttaccgtgtcggacggagaccgtaggtcccggggacccctaagggtaaccttcgaccgttnacggttcgggaccgttccggacgggggaccaaacggggtacccc

SEQ ID NO: 183191 - DNA, 867 bp, Homo sapiens
  misc_feature: GYAE6OF01CCQ5M.13.76.G10.1.454.CMB.1.raw
  modified_base (139)..(139): a, c, t, g, unknown or other
  misc_feature (139)..(139): n is a, c, g, or t
tcagtcacgtactacacgaccggtgctcgatttagtcactcatacgagggggggagaggagcccagcactgggattccgaggtgtttccattcggtgatcagcactgaacacagagactcaccatggtagtttggctgngtcgttgggttttccttgttgtacttaagttttaaaaggtcgcccgtagtggtggaggtgcgagtcgtgggtggtagtcgtgggaggaggtcgttagactccgaggtcccgggttcggggggttccctggacgtacccttccgtccgtggtcggccgtaccgtccttccggtcgggttacccgtacccgttcctaccggtaccaacctaaccctaactaacgtcggacggtccggtccgggtccccggaccggtaaccgggtccgtaccgggaagggggtaacggggtaccggtacgggtacggttcggttccgttttacgttttacgttttttaagtttaagttaggttaaggttaggttaacgttaacctacgttaaccgtccgtacgtaaccgtccgtccgggtacgggaccgggtactacttaccaaccgtactacccgtacgaacgtaactaacctaacgttaaaccgaaacgacctaccgttctttactttaacctaataacgtacgaaactccggtaccaggtaacgaccgtacggtataccggaccggtaccggttaccgttaagttacttaacgggtgtaaccgggtcggaaacggtccgggtaacgggttaccccggggaaacccttacgggttaaacccggttgtacccggtaaagttcccgggtaaacggccccggttaaccggggacgggtaacccgggaaacccggttccccgg

SEQ ID NO: 183192 - DNA, 603 bp, Homo sapiens
  misc_feature: GYAE6OF01DRFI4.13.76.G10.1.454.CMB.1.raw
  modified_base (342)..(342): a, c, t, g, unknown or other
  misc_feature (342)..(342): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataaattgcagaataaatatacttcctggtactcagcaagagtcacggccacgtcccctggtcgctggtcattctatccaagctagacccaaggccgtccccgtcgaacgggtacctcccgnggaacgcgtactttctcgtcggtcctaccgacgttcgaggaaccttcgaacgcctactctacgaacctataccgacggaccgggaccgagctagtgggatggacggtctacggaacttacgttaacgtggttaccggtagggtcggttacgggaactacgaccaactacgtagttcgggtacgttacgggtaccggcggaacggaacgagtacccgaggtaccccggttacggtaccgcgaaccggtcccgaaggtccccg

SEQ ID NO: 183193 - DNA, 708 bp, Homo sapiens
  misc_feature: GYAE6OF01A412G.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgtcttaattttaaaaggtgcccagtgtgaggtgcagctggtggagtcgtggaggaggcttgatccagccgtgggggtcctgagactctcctgtgcacgcctcgtggtccaccgtcacgtcacctacctacatgagcgtcgggtccgccgacggcctaccggaggggacggggtcgtggtaacggttcgcgtttctttacgtttttatttaagttaggttaggttaggtacgttaacagttacctccgtacacgtaccgtccggtagggaccggggtccgtacgttaccgactaccttctaccgaaggtaacgaactaaacttacccgaaactaaccgacgtcgtttagtttacctaacgtaaagtacgaacgtacgtaccgtagacggaacgaccgtagtacggacccgtacgggtaccgttagttacttcgtggtacgacgggaagtacgggtacgggtacggggaccccgtaaacggttaaccgttaacccgtaaccggtcttaaacgggttacgggaccggttcggggttacggggaaacccggg

SEQ ID NO: 183194 - DNA, 787 bp, Homo sapiens
  misc_feature: GYAE6OF01E443R.13.76.G10.1.454.CMB.1.raw
  modified_base (139)..(139): a, c, t, g, unknown or other
  misc_feature (139)..(139): n is a, c, g, or t
  modified_base (208)..(208): a, c, t, g, unknown or other
  misc_feature (208)..(208): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (620)..(620): a, c, t, g, unknown or other
  misc_feature (620)..(620): n is a, c, g, or t
  modified_base (659)..(659): a, c, t, g, unknown or other
  misc_feature (659)..(659): n is a, c, g, or t
  modified_base (732)..(732): a, c, t, g, unknown or other
  misc_feature (732)..(732): n is a, c, g, or t
tcagtcacgtactacacgaccggtgctcgatttagtcactcatacgagggggggagaggagcccagcactgggattccgaggtgtttccattcggtgatcagcactgaacacagaggactcaccatggagttttgctgngtcgttgggttttccttgttgtcttaattttaaaaggtcgcccagttgtggaggtgcagcgtgggtggngtcgtggaggaggtcgttgactccgacgtccggtcggggggtccctaggacgtcctcgtccgtggtcncncgtcccgttcgttcgggttccacccgtcgtacgtacccaaccaccctaagtcgtggacggtccggttccggggtccccaccggacggtccgtaaccggaagggggacgggcggtcgggaggttcggtcgttttaccttttacgtttttaatttagtaggtttacggtaggttaaccgtaacttactaccgtcccggactacggtaccgtccggtacgggacgggccgtactacaccgtctacctacgagaagtaacctaacgaccaaactaaccgtaccgttctttagtttaaccttaagaaacgtcgaaacctccggtagtcgaacggtccgaaccggttntaaccggacccgtccggttaacgtttacgtactttaggnggtaccgtaggaaacggtccggaccgggttacccggggaaccccttaaacccggttaaggttacccacgggtnttaacgggtcccgtaaacggtccgggtaacgggaacccccggtaagggtaccccg

SEQ ID NO: 183195 - DNA, 714 bp, Homo sapiens
  misc_feature: GYAE6OF01ANMCS.13.76.G10.1.454.CMB.1.raw
tcagtcacgtactacacgaccggtgctcgatttagtcactcatacagggggctgggcctcaggaagcagcatcggaggtgcctcagccatggcatggatccctctcttcctcggcgtccttgcttactgcacaggatccgtggcctctatgagctgactcagcccaccctcagtcgtccgtgtccccaggacagacagccagcatccacctgctctaggaaataagttggacagtaataaatacttacttacctggtatcaagtacagaagtcacggccaacggtcccctagtcgcgtgtcactctagtacaacgactcgaccgaacggccggtaccctaggacgggtactacccgtaggacgtcgtacgtttcctacgttcggttacctaacgttcgacgggtaactaccgacgtcctactacctacgaactaccgtacggaacggtaccgtacgtacggtacgttagtacgggtagttaggaccggttcgacgttaacgttacttaccgttacggaccggtaacgggtacggtacggggaccgtaggaccggtaaccgaccgtacccggttcgaccccgttacgttaaccggttaccggttacccgggttacccgggtaaacgggtcccggggtaaaccccgtacgggttaccccgtaacccgggttaccctaaaccggtaccgtaacccgggaaccccgtaaacccccggg

SEQ ID NO: 183196 - DNA, 763 bp, Homo sapiens
  misc_feature: GYAE6OF01AZQE3.13.76.G10.1.454.CMB.1.raw
  modified_base (170)..(170): a, c, t, g, unknown or other
  misc_feature (170)..(170): n is a, c, g, or t
  modified_base (304)..(304): a, c, t, g, unknown or other
  misc_feature (304)..(304): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggcagataaatactacttcctggtatcagcaagaagtcgagcctacgtcccctgtcgcgtcggtcattcgtatacaagtntacgacctaacggccggtccccgtacggaacgggtacttccccgtaggacgtcccgttacgtttccgtccggttacggccttacccgtaaaccgtcgggtacgggtaaacccttcggaaccgtcccctaaccgttccgtaaccgtaacccctagtacccggaacggggaaccccgggtacccggaagggtaccgttagggtaacgggtacggtacggtacgggttacctacgtttaaaccgtttacgtttaaccgtcggttaaccggtacgggggttacgggttacggggaacctaccgggtacgtaccgaccgtaccggtccgtaccccggtcgtttaacgttccgggttaacccggttaaccgggggtaacccgtacggggtaaaccccgttaaccgggttaccctaaacccccggtttaccggtaaccgtaccgggtaaccccggtaaaccccggg

SEQ ID NO: 183197 - DNA, 752 bp, Homo sapiens
  misc_feature: GYAE6OF01EP12H.13.76.G10.1.454.CMB.1.raw
  modified_base (275)..(275): a, c, t, g, unknown or other
  misc_feature (275)..(275): n is a, c, g, or t
  modified_base (334)..(334): a, c, t, g, unknown or other
  misc_feature (334)..(334): n is a, c, g, or t
tcagtcacgtactacacgaccggtgctcgatttagtcactcatacaggggctgggcctcaggaagcagcatcgtaggtgcctcagccatggcatggatccctctcttcctcggcgtccttgcttactgcacaggatccgtggcctcctatgagctgacctcacgcccaccctcagtcgtcccgtcgtccccgaggacacgacacgccagcactcacctgcctctaaggtaaataaacgttggacagtaataaacttacttacttccgtggttaancaagacaagaacgtcgaacggtcccacgttcccctagtcggctaggtcctactacttanacgtaagtactcggacccgacggtaccgtccccgaggaacgtccgtacccgtagacgtacgttacttcgtaccgtccgtaccgttaaccctaccgtacgggttacggaacccttaccgtaccgtacccctacgttccccgaaacgtacccgtaccaccgggaacccgggtacccgtaaccgcgttaaccggtacggtacggtaggacccgtacgggttaaccctacggttaaccgttaccgttaaccggtttcgggaaccgtacggggtacggtaacggcggaaaccgttcggaaacccgttcggtacccgtccggtaccgttaccgttacggtttcggtaacccgggttaacggtcggaccgtaaccgtacccggtaccgttaccggtacgtaaccggttccgaacggtaacccccg

SEQ ID NO: 183198 - DNA, 727 bp, Homo sapiens
  misc_feature: GYAE6OF01BXXYB.13.76.G10.1.454.CMB.1.raw
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (577)..(577): a, c, t, g, unknown or other
  misc_feature (577)..(577): n is a, c, g, or t
tcagtcacgtactacacgaccggtgctcgatttagtcactcatacaggggctgggcctcaggaagcagcatcggaggtgcctcagccatggcatggactccctctccttcctcggcgtccttgtccttactgcacgaggactccgtggcctcctatgagctgactcacgcccacctcagtcgtccgtcgtcccaggacagacngccagcatcaccngctctaggaaattaagttggacagtaataattactacttcgtaggtactcagacgtaagaacgtcgaacggcctaccggtccccctggtcgccggttggtactaacttctaacgttacgaacgtactcggaacccagggtaccccggtcctacgggaacggtaccgtcccgaggtaacgcgttaacttcgtcgtacggtccttaccgactcggttacggaacctcgacgacctcgtcctacgaccgtagtcccgaggacccgggaccctaggtaccgttaggacggtaaggtcggtacgggaccctggttaaaccctttaagttccgacgggtaccgtaacgggggttccgtacgggaacncggttaccaacgggttcccaagggtcccgtccccgagtttaacggttccggttacccggttaccggggtaaacgtacccgggtaaacccgttacgggttaccccgaacccggtttaacccgttacggtccccgtaccggtaaacccccgg

SEQ ID NO: 183199 - DNA, 849 bp, Homo sapiens
  misc_feature: GYAE6OF01BW70Q.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagagactcaccatggagttttggctgagctgggttttccttgttgcttattttaaaaggtgcccagtgtgaggtgcagcgtggtggagtcgtggaggaggcttgatccagccggtggggtccctgagactctcctgtgcacgccttacgtcgggttccaccgtactacgtccaacctacctacagtgacgcgtcgggtcccgccgtacggccgtaccggaaggggaacggggtcgtaggggacgtcggtacccgtttcttttacgttttttaagtttagttaaggttaaggttacggttaacgtaactaacgttacccgtaccgcgtaagtacccggttaccggtagggtaccggggccgtaacttccaccgtaacttccgtaccgaagtaaccgtaactaaaccgttacccaaaacggtaaccctaccggttaccttttggttttaaccctttaacgtaaaacgtttaccggaaaaccgtacggtacccgtaagggtaacggaaccgggtacccgtaaggttaccggaaacccggtaccggggtaccgtttagttaaacgtttcccgttagggttacggaacgggtaacggtaagggtaacccggttaccgggggaacccccgtttaaaccgggtaaacccggtttaaccggtaaacccggtttacgtaacgggttccgggtaaacccggtttccggggaacccgggggtaaacggaacccgggggttaaacccccgg

SEQ ID NO: 183200 - DNA, 568 bp, Homo sapiens
  misc_feature: GYAE6OF01DLVOU.13.76.G10.1.454.CMB.1.raw
  modified_base (458)..(458): a, c, t, g, unknown or other
  misc_feature (458)..(458): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctaattttaaaaggtgccagtgtgaggtgcagctggtgagtctggaggaggcttgatccgagccgtggggggtccctgagactcctccgtgtgcagcctcgtgggttcaccgtcagtcacacctacatgagctcgggtccgcaggctccgaggggaagggctggagtgcgttcttcttttattagtagtagtaggttactacgatacgtccgacacgtactcgtgacgggggcctagttccactatcaccgagagactaataccaaagacacgtctgtttactacgtaaatcgaaacngaccgtgagaccgacgagtcgacgacggtcgtagtacttagcgtgcgaggagcgtgggacccaacggtaacgttaacaccgtactagtacggacgtcggtgggaacccgg

SEQ ID NO: 183201 - DNA, 951 bp, Homo sapiens
  misc_feature: GYAE6OF01BJ8SS.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggtttccttattactatttaaagtgtcagtgtgaggtgcagttggtggagtcgtgggaggaggtcgttgggtccgaggggcccggggggggtccctggaggtacctcgtctagtgtggccggcctcgtgggcctcaccgtacaaccaccaactacagtgacgcgtcggggtccgaccgaggccgtaccggaggggaacggcggggacccgggtagggttcgggtcctacgtaagtttttagtttacgttcggttccggtacgggttcgaccctaacgtactttaccgtaacggacgtacggtaaccggttcccgggtagggacggggggttccccgtttaacgaaccccgtacgttaccccgtacccgaacgggaaccgtaaaacgttaaacccgtttaaccccgaaaacgggtaaacccgttaaaccggggtttacggtttaaactttaaccgtttaaaccgaaaacgttacggtaaaaacccggtacccgtttacgggaaacgggttaaccgggttaaccggggaaccgggaaccccgggtaaccggtacccggtttacgtttaaccgttaaccgttacggttaacggggtaacggtaaaaggtaaccggtacggtaccgaacggggaaaccgggtacccggggtaaacccccgggttaaagggggttccccgggggtaccgggtttaacgggggttacgggggtttacccggggttttaccgttttaccggttacgggttaacccggttcggggttacccgggttacggggggtaccccgggtaaaccgggggttaaccccccggg

SEQ ID NO: 183202 - DNA, 591 bp, Homo sapiens
  misc_feature: GYAE6OF01DYC7K.13.76.G10.1.454.CMB.1.raw
  modified_base (381)..(381): a, c, t, g, unknown or other
  misc_feature (381)..(381): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (554)..(554): a, c, t, g, unknown or other
  misc_feature (554)..(554): n is a, c, g, or t
  modified_base (572)..(572): a, c, t, g, unknown or other
  misc_feature (572)..(572): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggttcaccgtcagtccacacctacatgagtcgtcgggtccgccgaggccgtaccggaggggaaggggccgtagggagtgcgttcttcttttatttagtaggtagtggtagtactatactccgnagctcgtggagggcattcactntcncagagacaattaccaaagaccacgcttgttaccttagaaatggaaactacgctagaagtacgaccgtagtaccgaacgtaccgggtccgttagttacgttacgtgtacgcgtagacggagtccggggaccctagtaacgttcaccgtntacggtcggaacgtcggngggtaccgaagggtacccg

SEQ ID NO: 183203 - DNA, 559 bp, Homo sapiens
  misc_feature: GYAE6OF01A574F.13.76.G10.1.454.CMB.1.raw
  modified_base (294)..(294): a, c, t, g, unknown or other
  misc_feature (294)..(294): n is a, c, g, or t
  modified_base (357)..(357): a, c, t, g, unknown or other
  misc_feature (357)..(357): n is a, c, g, or t
  modified_base (360)..(360): a, c, t, g, unknown or other
  misc_feature (360)..(360): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
  modified_base (429)..(429): a, c, t, g, unknown or other
  misc_feature (429)..(429): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctctgggttcaccgtcagtcacacctacatgagcgtgggtccnccaggctccgaggggaagggctggagtgcgttctcttttattatagtagtggtatacattacncgnagactcgtggagggccattcacatcncagagactaatccaagacncgcttgtttactacaaatcgaacngtcctagacgtacgcgatcgacgaccggtccgttagtacttactggtacgcgagacgtacgcggggacccaacggtaccgttacaccggtacttagtcgggaccgttgcgggggaccctaaggggacccg

SEQ ID NO: 183204 - DNA, 846 bp, Homo sapiens
  misc_feature: GYAE6OF01E5MEB.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggtttttccttgttgtcttaagtttttaaaaggtcgaccctagtgtggaggtgcagtcgtggtggagtcgtggaggaggtcttgactccgaggtccggtcggggggtccctggacgtacctcctccgtagtcgctacgtccgttcgttcgggttaccaccgtcgaacgtaccaacctaacctacgtatacggtacggtccggtcgggtacccgccggtacggtaccgtccggaacgggggaacgggcgtagggacgttcggtaccgtttctttaccgtttttaatttaacgtaaggttaggttacggtacgttaactacgttaccctccggactacggtacccggttccgggtagggacccgggggtacccgtacttaccaacctacgttccgtaccgaagggaacctaaaccgtaaccggttaacccgaaagggtaaacccctaccggttaccgtttacttttacctaaccggtaaatacccggaaaccgtacgtaccgtaaggtaaccggacgtaccgtagtaacccggacccggtacgggttacccgttagttacgtttaaccgtggtcgaacggcggtaacggtacccggggtaaccggtcccccgtaaacggtttaacccgtacgtttaccggacggttaacgttacggggacccgttaccggggaccggggaaaccgtaaccgggtaccccgg

SEQ ID NO: 183205 - DNA, 885 bp, Homo sapiens
  misc_feature: GYAE6OF01AISHA.13.76.G10.1.454.CMB.1.raw
  modified_base (173)..(173): a, c, t, g, unknown or other
  misc_feature (173)..(173): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtgccttcctatgagctgactcacgcccaccctnagtcgtccgtcgtccccaggacagacagccagcactccacctgcctactagaaactaagtggacaagtaattaaatcgttacttccgtaggttatacacgacaggtacgtcgacggtaccaccgttccccgtgtcgtacgtcggtactacttactataccgaagtacgtacgaccctaaaccgggcccgtaccccgtacgggaaacgggtccccttaccccggtaggggaccgtaccggtttacgtttaacccggttccggtcccgggttaaccccgttaaccccttaaaccgggtttcccgggtttaaacgggggtacccccttaacccggccgtaaccccgttacccgttttaccccgaccgggttaaccccgtaacgttacccggggtaaaccccggggacccccggggtaaacccccggtacggggttaaacccggttacgggttaaccggggttaacggttacgggggtaaccggtacggtttaaacggttacccgtttaacggtttaaccggtttacgggtaaccgggtaccgggttaaccggggtaccggtaacgacgggttaacgaccggtacgtacccggttccgacccgtttaccgtacggttccgttacccggttacgggtaacccggttaaccgggtaacccttaacgggtcccgtaaccccgtttaaccgacccgttccgaaccccggtaaacccccgg

SEQ ID NO: 183206 - DNA, 846 bp, Homo sapiens
  misc_feature: GYAE6OF01B76I7.13.76.G10.1.454.CMB.1.raw
tcagtcacgtactacacgaccggtgctcgatttagtcactcatacaggggtctgggagaggagcccagcactgggattccgaggtgttccattcggtgatcagcactgaacacagaggactcaccatggagtttggctgagcttgggttttccttgttgctaatttaaaaggtgcccagtgtgaggtgcagcgtgggtggagtcgtgggagggaggcttgactccgacggtccggtcggggggtccctgacgtacctcttccgtggtcgcgtacgtccttcggtcgggttccgaccggtcacggtaccaaccacctacacgtggacggtcgtcgggtcccgccgacgggccgtaccggaaggggaacggggtcgtacgggtaggtcggtccgttcttttacgttttaagtttagtaggttaaggttggtaacgtactacgtaccgttccgacgacggtaccgtcgggttacgggacggggtcctaccgtccgtaacctacgtccaccgtaacgacgaacttaacgttaccgaaaatacgaccgttctttacgttacttaacgaaaagttccgaacgtaacgtcggtaccgtaacgggacgttaacccgtaggtaacccggtaccgggtaacccgggttcccggtttaaacgtttaccggtttaacggtaaccggggttcgaaacccggggttaaaggtaacccgggggtacgggtaaccccggggtaaccccccggttaaaccgggttaaaccgggtttaaacccccggtacggttacccgttaaacgggttaaccccggggtacccggggtttcggggaaaccccgggggtaaaacccccggggg

SEQ ID NO: 183207 - DNA, 1121 bp, Homo sapiens
  misc_feature: GYAE6OF01C811U.13.76.G10.1.454.CMB.1.raw
tcagtcacgtactacacgaccggtgctcgatttagtcactcatacaggggtctgggagaggagcccagcactgggattccgaggttgtttccattcggtgatcagcactgaacacagaggactcaccatggtagttttggctgagcttgggttttccttgttgcttaattttaaaaggtcgccctagtgtgaggtgcgagctggtggagtcgtagggaggaggtcttgactccgagtccggtcggggggtccctggacgaccttcctccgtggtcgcgacgtccgtcggttcgggttcctacccgtacgtacggtaccaaccctaaccttaacgtacgtacggtacggtccgggttacccgggggttcccccgacccggtaaccgggtacccggttacccggggaaaagggggggtaaaccggggggtccggtttaaggggtaaccgggttaccgggtttccccgggttttaccgtttttttaacctttttttaaaggttttttaacgggtttaaacgggtttagggggtttaaacggggttttaaacggttaccgttaaaaccggtttaccccggttacccccgggtaacggtaaacccgggttaacccggtttacccggggttacgggggtaacccgggggttacccgttaacctttaaccccggaaacccttaacgttcccccggtaaaccggtaagggaaaacctaacccggtttaaaccgtttaaaccccggaaaacggtaaacccgttaccgggttttacccgttttaacgttttttacctaaaaccgtaaaacggtttaacccgtaaaccggttaaccggtccgttaaaggggaaccgggaaaccccggtaccgttaaacggttaacccggggtaacccggttacccggggtttaaacccgttttgtttaaacccgtttaccgggttaacggacccgggtacgggtaaacgggtaaccgggtaacccggggggtttacccccggggaaacccccgttaaacccggggttttaaaaccgtacccccgggtttaaacccgtacgggggtttaaaccttaacccggggggtaacccggttttaaccccgggggaacccgggggggtaaaaccccggg

SEQ ID NO: 183208 - DNA, 906 bp, Homo sapiens
  misc_feature: GYAE6OF01CY7C5.13.76.G10.1.454.CMB.1.raw
tcagtcacgtactacacgaccggtgctcgatttagtcactcatacaggggtctgggaggaggagcccagcactgggattccgaggtgtttccattcggtgatcagcactgaacacagaggactcaccatggagttttggctgagcttgggtttttccttgttgcttaagttttaaaaggtcgcccgagtgtgaggtgcagcgtgggtggagtcgtggaggaggcgttgactccgacggtccggttcgggggtccctagacgaccttctccgtgtcgcgacgccttcgtacggttccaccgtcacgtccaacctacctacagttggacgtccggttcgggtccccgaccggacggcccgtaccgggaaggggtaacgggcgttaggacggtcgtcgtttactttacgttttttaagttacgttaggttacggtggtttaacgtaacctacgttacctccggactaacggtcccgtttccgggagggtaccggggtaccctaacgttcccaacccgttctacccggtaccgaaggaacgttaaaccgttaaacgttacccgtaaaaacggtaacccggttaaccgtttcccttttacgggtttttaacctaaccggtaaaaacgttaccggtaaaaccggtccggtaacccggtttacgggaaaccggtaaccggttacccggaacgtttacccgggaacccgggttaaccccgggggttacttttaacgggtttaacgttaaccggtcgggtaaccggaaacggttaacggtacggggtaaacccgggtccccggggtaaccccgttaaaacccggttaacccggtttaacccgtacccgggttaacgtttaacggtaccccggggttaaccgggtttcccgggggtaacccggggaaaaccccggg

SEQ ID NO: 183209 - DNA, 829 bp, Homo sapiens
  misc_feature: GYAE6OF01C8L3U.13.76.G10.1.454.CMB.1.raw
tcagtcacgtactacacgaccggtgctcgatttagtcactcatacgaggggggggagaggacgcccagcacgtgggattccgaggtgtttccattcggtgatcagcactgaacacagagactcaccatggtagtttggctgagtcgttcgggtttttccttgttgtacttaagttttaaaacggtcgcccgtaggtgtggaggtgcgagtcgtgggtggagtcgtgggaggaggtcgttgactaccgacggtccgggtcgggggtccctggacgtaccttcctccgtgtcgaccgaccggtccgttcggttccgggttacctacccgtcgacgtaccaacctacctacgacgtcggacgtccggtcgggtccgaccggtacggtaccgtaccgggaaggggaacgggtcgtggtaggtcgtcgttctttacgtttagtttacgtaggttaggtaggttacgtactacgttaccgtacgtacgtacgtaccggtacggtcgggacgggtccgtacgtaccctactacctaccgtaaccgaagaactaaaccgttaacgtaaccgaaaacgttacccgtacgttcgtttactttaactaaacgtaaacgtaacgaaaccctagtccgtaacgggtaacgaaccgtaccgtaacgtacggtaaccccgggtacggggtttaccgttaacggttaactttagggccgggtaacgacggtaggacgggacggttaaccccggggtaaccctaaccgggttaacgttaccgtacgacccgggttagtaccgggtacggtacccgggaacggggtaaccccaaggggtacccccgg

SEQ ID NO: 183210 - DNA, 730 bp, Homo sapiens
  misc_feature: GYAE6OF01DN0CN.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgcttatttaaaaggtgcccagtgtgaggtgcagcgtggtggagtcgtgggaggaggtcttgactccacggccggtcggggggtccctgacgaccgttctccgtgtcgcgacgcctcgttcgggttccaccgtctacgtcaccacctaacatgacgcgtcgggtcccgccgaggtccgtaccggaggggtaacggggcgtgggtacggtcggtccgtttctttactttttagtttagtaggttacggttggtaacgtactagtacctccgcgtaacgtcgtccggtggacggggtcctacgttaccactacgtctacccgagaactaactaacttacccgaaacgaacctaccgtactttcgtttaccttaacgaaattacgaaccgacgtccgtagaacggaaccgtcgtaaagcgtaaccggcggtccgttagtttacgttacgtggtacggaggtagacgggtaggtcccggggaacccctaaccgggttaacccgtttacgtaccgttacggttacgtaccgggttacccggtacccgggtaccggggtaaccgtaaccgggggtaaccccg

SEQ ID NO: 183211 - DNA, 721 bp, Homo sapiens
  misc_feature: GYAE6OF01EID5N.13.76.G10.1.454.CMB.1.raw
  modified_base (186)..(186): a, c, t, g, unknown or other
  misc_feature (186)..(186): n is a, c, g, or t
  modified_base (459)..(459): a, c, t, g, unknown or other
  misc_feature (459)..(459): n is a, c, g, or t
  modified_base (572)..(572): a, c, t, g, unknown or other
  misc_feature (572)..(572): n is a, c, g, or t
tcagtcacgtactacacgaccggtgctcgatttagtcactcatacaggggtcgtgggagaggagcccagcactgggattccgaggtgtttccattcggtgatcagcactgaacacagaggactcaccatggagttttggctgagctgggttttctgttgctaatttaaaggtgccagtgtgaggtncagctgggtggagtcgtgggaggaggcttgactccgaggccggttcggggggtccctgacgaccttcctccgtgtcgcctacgtccgttcgttcgggttccaccggttcaacggttccaaccgtaccttacgagtacggacggtccggttcggggtacccgccggaacgggtccgtaccggggaagggggtaacgggtcgtgggacgttcgtaccgtttacgtttacgtttttaagttagttaggtacggttaggtacgtaactacgttaccncggtacacgtaccgttcggacggacggggtctacttccaccgtactccgtacgaagacgtaactaacgttaccaaagaacctcgtacttcgtttacctaaagaactcgtaacncgtcgtagacgacgaccgagtccggaacgtacgggtcttagttacgttcgtaggtacggaccgagggtaaccggtagtaccggggaccctaaacggtacgttaccgtacgtacgtacggtacggacggttccggacggggtaaacccgg

SEQ ID NO: 183212 - DNA, 558 bp, Homo sapiens
  misc_feature: GYAE6OF01E1Y0I.13.76.G10.1.454.CMB.1.raw
  modified_base (257)..(257): a, c, t, g, unknown or other
  misc_feature (257)..(257): n is a, c, g, or t
  modified_base (447)..(448): a, c, t, g, unknown or other
  misc_feature (447)..(448): n is a, c, g, or t
  modified_base (547)..(547): a, c, t, g, unknown or other
  misc_feature (547)..(547): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtctggaggaggcttgatccgagccgtggggggtccctgagactctcctgtgcagcctntgggttcaccgtcagtcacacctacatgagctgggtaccgccaggctccgaggggaagggctgggagtcgcgttctcttttattatagtagtggtatacatactccgcagacctccgtggacggggcctattcaccgatctaccagagacaattccgaaagaccacgctgtaatctagctaaagtgaacnnccgtgagccgccgatgacgtacggcgtatataccgtggtcgacgtagacgtagtcggggacccaaggtaccgttacacggtactaggacggcgttcggngggtaacccgg

SEQ ID NO: 183213 - DNA, 624 bp, Homo sapiens
  misc_feature: GYAE6OF01ESAR9.13.76.G10.1.454.CMB.1.raw
  modified_base (486)..(486): a, c, t, g, unknown or other
  misc_feature (486)..(486): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatccacctgctcgtaggaaataagtggacaagaataaatacttacttcctaggtactcagcaagtagtcaggccacgtcccctgtcgcgttggtctatctaatacgaagctcgaccaacggcccggtccctacgacgggtacctacccgtaggacgtcgtactttcgtcgtcggtacctacacgtcgtacggactcacgtccctatcctacgacctactacggaccggacccgggactacggtctagtcggagtacggacgtctagtaaccttgtttaccgngttaccggacggtacgggtacgggacgtacgccgaacgtcgacccgtccggcccgtagttacgtcggttaccggtaacggacccggttaggacccgtaacggtccctaaccgttacgtaaccgcgaaccggaaccccg

SEQ ID NO: 183214 - DNA, 646 bp, Homo sapiens
  misc_feature: GYAE6OF01AFFKL.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataaatattacttcctggtatcagcagaagtcacggcctacgtcccctgtgctggtctatctatacaagatcgaccaacgccggcccctagacggtactcccgtgacgcgtacttctcgtcggtctaccctaactcggtacggaacctcgaccgcctaccgtctcgaacctagtccgacgggacccggacccgaggtctaggtggtacgtggacggtctacggtacttaacgttacgtcggtacgagggtcggtagggaaccgaggaccgaggtacccgtacgtcccggtaccccgttacgttacggttccggttacccggttaaccgggaacccgggttaccgggtaaacccgtaacgggtaccccgtaccccggttaaccctaaaccgggttcccgaacccggtaacccccgg

SEQ ID NO: 183215 - DNA, 789 bp, Homo sapiens
  misc_feature: GYAE6OF01ADAG4.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggaggcttgatccgagccgtgggggtcctgagactctcctgtgcagcctcgtgggtcaccgtcagtcacacctacatgacgtcgtcgggtccgccgaggcctaccggaggggaacggggccgtgggaggtcggtcgttcttacgtttttagtttagttaggttaggtaggttaacgttactacgttaccgtccgacgtacggtaccgttccgggtacgggacggggtccgtacttacccgaccgtacttcccgtaacgaacggtacgtaaccttaacgttacccgaaaaggtaccctaccggttctttacgggttttaccctaaacgtaaacgttacgaaacccggttcggtacccttagggaaccggaccggtaccccgttaaggtacccggtaaacccgggtacccgggttacccgtttaaggttaaccgtttaacgggttacggtccgggaaccggtaaacggggtaacgttaccggggtaccccgggggtaacccctaaaccgggtttaaaccggttaccctaacggtacgtttacgggtacccgggtaccgttcggggtacccggggaaaccccggg

SEQ ID NO: 183216 - DNA, 735 bp, Homo sapiens
  misc_feature: GYAE6OF01C9YNW.13.76.G10.1.454.CMB.1.raw
  modified_base (135)..(135): a, c, t, g, unknown or other
  misc_feature (135)..(135): n is a, c, g, or t
  modified_base (390)..(390): a, c, t, g, unknown or other
  misc_feature (390)..(390): n is a, c, g, or t
  modified_base (546)..(546): a, c, t, g, unknown or other
  misc_feature (546)..(546): n is a, c, g, or t
tcagtcacgtactacacgaccggtgctcgatttagtcactcatacaggggtgggcctcaggaagcagcatcggaggtgcctcagccatggcatggatccctctcttcctcggcgttccttgcttactgcacaggntccggtggcctcctatgagctgactcagcccaccgtcagtcgtccgtgtccccaggacagacagccagcatccacctgcctcgtaggaaaattagttggacaagaataatacttcttacctggtactcgagtacagacgtcacggtccacggtcccctaggtcgtcgttacggcctatacgtattacgaggtactcggaccgacggttccgacccgtagaccggtacgttccgtggacgacgttacttccgtacncggtccctaccgaacgttcgtaacgggacctcgtacgaccgtactacgtaccgacctacgtcgaaccggggacccggtaaccgtacggggtaccttgggacgtacggttaggccgtacgtaaccgttacgtttacgtacgttacggttaacccggnggggttacccggtacggtaccgagggttaccgacgttaccccgtacgggttacccgtaccccgggtatttaaccggtcccggttcggggttaacccggtaacgggtaaccccgggtacgtttaaccccgggaccggtttaaccttaccccgttaaggaacccgacccgggttaccccgaaaaccccggg

SEQ ID NO: 183217 - DNA, 555 bp, Homo sapiens
  misc_feature: GYAE6OF01B2Y0M.13.76.G10.1.454.CMB.1.raw
  modified_base (240)..(240): a, c, t, g, unknown or other
  misc_feature (240)..(240): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (325)..(325): a, c, t, g, unknown or other
  misc_feature (325)..(325): n is a, c, g, or t
  modified_base (335)..(335): a, c, t, g, unknown or other
  misc_feature (335)..(335): n is a, c, g, or t
  modified_base (353)..(353): a, c, t, g, unknown or other
  misc_feature (353)..(353): n is a, c, g, or t
  modified_base (448)..(448): a, c, t, g, unknown or other
  misc_feature (448)..(448): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccagcatcacctgctctaggaaactaattggacagataaatntacttctggtatcagcagaagtcaggccagtcccctgtcgcgtggtcatcctatacaagntcgccaagcgcccngacggactccngatcgattcnctcggctacccgacgtcncggtaactcacgccctactcctacgaaccagttccgacgaccgggacccaggtcctagtcggatggacggtcttagacgttattacgtgtaccgngggtaccgtaggacacggacgacgctaccgcgtacccgattacgtcgttacgtaccggacgtcgggaacctacggtcacccgttacgtaacgtccgacgtacccccg

SEQ ID NO: 183218 - DNA, 792 bp, Homo sapiens
  misc_feature: GYAE6OF01DIRGR.13.76.G10.1.454.CMB.1.raw
  modified_base (609)..(609): a, c, t, g, unknown or other
  misc_feature (609)..(609): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtcgtgggaggaggcttgactccgagccgtcggggggtccctggacgtactcctccgtgtcgcacgccttcgtgggttcaccggtcagtccaccaccctacatgacgtcgtcggggtcccgccgacgggcctaccggagggggaacgggggccgttaggggaggttcggtcccgggtttactttttaccgttttttaagttttaacgtagggtttagggttaggttaaacgttacctaacgttacccgtcccggaccgtaacgtacccggttcccgggtaggggtacccggggggcccgttaacttcccgaacctacttcccgtaccgaagtaacgaacctaaacctttaaccggaaacgaaaccgtaccgttctttacgttttacccttaacgtaaattacggaaaccncgtccgtaggacgtacgccggtaatcggaaccgtacgggtcccgttagttacgttacggtgtacggacgacggtaggtacggtccggggtaccccgtaaggtaacccggtttaacgtaccgtacggttaacggtcgggtaccgttcggggtacccggggaaccggtaacggggtaaaccccgg

SEQ ID NO: 183219 - DNA, 699 bp, Homo sapiens
  misc_feature: GYAE6OF01DY2TL.13.76.G10.1.454.CMB.1.raw
  modified_base (566)..(566): a, c, t, g, unknown or other
  misc_feature (566)..(566): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgactccagccgtgggggtccctgagactctcctgtcgcagcctcgtggttcaccgtcacgtcactacctacatgacgcgtcgggtcctccgaggtccgtaccggagggggtaacggggcgtgggagtcgtccgttctttacttttaagtttataggtagttggtaagtacattacctcgacagaccttccggtaggacgggcctacttccactatcctccaagaccgtaacctaacttaccgaaagtaaccctgtccgtttagtttaccttacaaagttcggaaaacctcgcccgtaagaaccggactaccggaattcggacccggtaccggttccgtagtttaacttacggnggttacgccggtaaagacgtacgggtccccgggggtaaacccaagggttaaacccggtttaccaccggtacgtttacggtaacggggtaccgttccggggacccgggggtaaccaaccgggggtaacccccgg

SEQ ID NO: 183220 - DNA, 779 bp, Homo sapiens
  misc_feature: GYAE6OF01CB0YZ.13.76.G10.1.454.CMB.1.raw
  modified_base (327)..(327): a, c, t, g, unknown or other
  misc_feature (327)..(327): n is a, c, g, or t
tcagtcacgtactacacgaccggtgctcgatttagtcactcatacagggggggagaggagcccagcactgggattccgaggtgttccattcggtgatcagcactgaacacagaggactcaccatggagttttggctgagcgtgggttttccttgttgtcttaattttaaaaggtcgcccagtgtgaggtgcacgtcgtgggtggagtcgtggaggaggtcttgactccgacgccggtcggggggtccctggacgaccttccgtccgttgtcgccgtacgtcccgttcgttcgggttcccaaccggttcacgtacccactaaccctanagttcggacggccggtcggggtccccgtccgacggtccgtaccgggtaacggggtaacggggcgtagggtcgtcgtaccgttactttacgtttttaattagttaggttaacggttaggtaacgttacgtacgttacccgtcccgacgtaccggtaccgtcccggtacggggacgggtacccgtacgttacccaccttacgttaccgtaccgaagtacgtaaaccttaaccgtaacctaaaacggtaactacccggttcgtttacgttttacctaagtaactaccggtaacgaccgtccggtagaacgtaccggactagtaacccgcgtaccgggtctgttaacgtcgtcgtacggactagggtcgaccgttaccgggacccttaacggttaacgtacgtaccgtacgtacggtcgggtacggtacgacggggtaacccgacgggtaaccccg

SEQ ID NO: 183221 - DNA, 890 bp, Homo sapiens
  misc_feature: GYAE6OF01BDMLM.13.76.G10.1.454.CMB.1.raw
  modified_base (819)..(819): a, c, t, g, unknown or other
  misc_feature (819)..(819): n is a, c, g, or t
  modified_base (876)..(876): a, c, t, g, unknown or other
  misc_feature (876)..(876): n is a, c, g, or t
tcagtcacgtactacacgaccggtgctcgattttagtcactcatacgaggggggggggctgagcccttctctggaaaccacacagctcctcctgcagcacgcccctgactgctgatttgcatcgacgggcctcttctttccgagacgaaggggataaggaggacggtccgtaggaaacgaacccgtcgacccacggccgtgggacctacgaaggaacgccagccgagtcgggacggtcgcctacgacgccgagtcggacaggtcggtaccttcccgttccgttccgttcccgtccggtccgtttccgttacgtccgtttacgtacgaccgtaacggtaacggtacccgttccggtaccgttcccgtaacgtttaacgcgggtaccgtaccggtttaaccgaacccgtaccgtacccccggttaaccctaccccggttacggttaccgggttacccggtttccccggtaacccgttaaccccgggaaggtaacccgtacggaccaccgggtacctacgaacctaccggtacccgtaccgtttaccggtaaccgttttaacggtaaaaccgggtttaaaagttaccggtaaccgggtaaaacgtaaaacggtttaaaactttaaaccgggttaccttttaaccggttaccgggtaagttaacccaccgtaaggtaaccgttaaacgggaacgttaccggtaccggaacccgttaccttaccggtgtttaccggcgtttaaccgtcgtttaacctaacggtaacgtacgaaaccggtcgtacccgtacggtacccgcgttacccgaggtccgtaactccggngtaacgttcgttacctcggtaacgttcgaaccccttatcccgggacggtaccgttanccttagccccgtag

SEQ ID NO: 183222 - DNA, 630 bp, Homo sapiens
  misc_feature: GYAE6OF01BIFUC.13.76.G10.1.454.CMB.1.raw
  modified_base (344)..(344): a, c, t, g, unknown or other
  misc_feature (344)..(344): n is a, c, g, or t
  modified_base (525)..(525): a, c, t, g, unknown or other
  misc_feature (525)..(525): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctgggaggacagtcacactcacgttggtggcttggagactacggctcagttctcgtagttacgttaccaccccagctggtaccaacacgaccccaggccaggcctccgcgcgacgcctcatcctacacaacaacactcgctcttctcgggtccctnactcgcttctctggctccatccgttagggaaacaaacgtctcgtcccttatcctactccggaccgggggcccctagggaccaaggaaacgtagtacgaagttcctagttaactttacgtttacgttggttcgttttacgttttaattaggtggggtttacgtacgtcccttagtttttccncggttcttaggttcggttcggggacgggtacggccgacccgggtctacccggtacccggtccgtccgggtccaccgtacccgaggccctccgcccgtcgtcccgg

SEQ ID NO: 183223 - DNA, 766 bp, Homo sapiens
  misc_feature: GYAE6OF01AQKDJ.13.76.G10.1.454.CMB.1.raw
  modified_base (656)..(656): a, c, t, g, unknown or other
  misc_feature (656)..(656): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcttgggttttccttgttgcttattttaaaaggtgcccagtgtgaggtgcagccggtggagtcgtggaggaggcttgatccaggccgtcgggggtccctgacgtactctcctgtcgcacgtcctcgtcggtccaccgtcacgtccactacctacagtcgacgtcggtcgggtccccgcgacgggtccgtaccgggaagggggaacgggtccgtagggtacggtcggtccgtttcttttacttttagtttaagttaggttaggtaggttacgtactacgttaccgtccgtacgacgtaccgttccggacggggaccgggtacgtaccttaccgacctaccgttaccgtaccgaaggtaaccgtaacttaaacgttaacccgaaaacggtaaaccgtccggtttacttttacggtttaacctaaacgaaacggttacccgaaagtcccgggttacccgtagggaaccggacccgtaaccgtagtacccggaaccggtccgttacgggttattacgttacggngtacgagggtaagacggtcccggtaccgggaccgttaaccgtaaggttaccgacgtccttaagggtccggacggttacccgggacgggaaccgtaccgggccctacccgg

SEQ ID NO: 183224 - DNA, 848 bp, Homo sapiens
  misc_feature: GYAE6OF01D2WH7.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatgggagttttggctgagcttgggttttccttgttgctaattttaaaaggtgccagtgtgaggtgcagctggtggagtcgtgggagggaggcgttggactccgaaggccggtcggggggtccctggtacgaccttcctccgtggtcgcgacgtcccttcggttcggggttaccacccggttacaaggttacccaaccgtaacccttaacgaacgttcggaacggtccggttacgggggtcccccgacccggtaagggtcccgtacccggggaaggggggtaaacgggggtccgtaggggtacggttcggtccggttttacgttttaccttttttaaagtttaaggttaagggtttaggttacgggttaacgtaactacgttaaccgtcccgacgtaccggtacccgttccgggtagggacgggggtacctacgttcaacctacgtcctaaccgaagaacgtaactaacgttaccaaacgtaaccacgttactttacgttactaacgaaatacgaaactacgtacctaggaacgtaaccgacgtaacgtacggacccgtaccgggtaccgttacggttaacttaacgtcggtacgggtacgaaggtaacggtaccggtaacccggggtaccccgtaaacggttaacccggttaaacccgacggttacgtacgggtacgggtaccggtacgggtaccggggaacccgtaaaccgggtaacccccggg

SEQ ID NO: 183225 - DNA, 672 bp, Homo sapiens
  misc_feature: GYAE6OF01ESQ3B.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagcttgggttttccttgttgcttaatttttaaaaggtgtccaatgtgagctgcagctggtggagtcgtgggggtaggtttggtacagccgagggcgtccctgagactctcctgtatacttctggtattcaacgttggtgtattatgactagtgaacgtgggtccgccgaggcctaccggaagggggaacggggcgtaggggtaggttggggttaggtttcgagttagggagactaattctacgatacgagtacgggaacaaacgaagaaacgtaccggccgtacggttactaagggtaaaaacgggtcaaaggtacttaccacctaattacctacgtaagaagtagtacggtacgtaccgaagaacgtacctacgtaccgttcccttttacgcgtacgtaagtagtagaaggtacgccgtaaggaacgaccggaacggaccacgacgacctacgtacttaacgttacgttggtacgtagtaggtacggtagttaatacgtaccttacgtacccgtacgtacccgtggtaccgg

SEQ ID NO: 183226 - DNA, 799 bp, Homo sapiens
  misc_feature: GYAE6OF01C09L0.13.76.G10.1.454.CMB.1.raw
  modified_base (351)..(351): a, c, t, g, unknown or other
  misc_feature (351)..(351): n is a, c, g, or t
  modified_base (697)..(697): a, c, t, g, unknown or other
  misc_feature (697)..(697): n is a, c, g, or t
  modified_base (758)..(758): a, c, t, g, unknown or other
  misc_feature (758)..(758): n is a, c, g, or t
tcagtcacgtactacacgaccggtgctcgatttagtcactcatacgaggggggggagaggagcccagcacgtgggattccgaggttgtttccattcggtgatcagcactgaacacagaggactcaccagtggtagttttggctggagtcgttgggtttttccttggttgtactttaagttttaaaacgggtcgcccgtaggtggtggaggtgcgagtcgtgggtgggagtcgtagggaggtaggtcttagactccgacggtccgggtcggggggttcccctaggactacgtcctccgtggtacgcacgtccttcggttcggttccaccgtactacgtccaacctaccgtanacgtggacgtcggttaccgggtcccgaccgtaccggtccgtacgggaggggtacggtcggcggtagggtgtccgttcgttttacttttacgttttagttaagttacggtagttacggttaactactacgtttaccgccggacgtacgtaccgtccggtcgggacgggtacttactacctaccgtattcccgaacgtaacggaaccgttaactaaccgttaacccgaaaacggtaccgttacgttaccttttcgtttaaccttaacgaaacgttacgaacctacggtacggtaggaagccggtaactacggtacccggaacgtccggttacgttagttacgttacgnggtaccggaggtcggacggtacggtacccgggaccttaaacgggtaacccttacggtaccnggttacgtcggtacgggtcggaccgggtacggtaacccggg

SEQ ID NO: 183227 - DNA, 880 bp, Homo sapiens
  misc_feature: GYAE6OF01DTXT9.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggtagttttggctgagtcgttgggttttccttgttgtacttaagtttaaaggtcgcccgtaggtggtggaggtcgcgaggtcggtgggtggtcggtggtaggggagggtaggttcgttacggtaacgtccggaccgggtccgggggttccggggggtccctacgggtaacgtcccttccgttcccgtggtacgccgtcggttcccgttccggttcgggttcccaccggtacgtacgtaccacctacctagtagtacggtcggtccggttacccgggcccgacggaccggccggtaacggggacggggtacgggtcggttcggacggttcgttaccgtttcttttacgtttttaggttaagttacggttaggttaacgtaacgtacgtaccgttcccgtaccggaccgtaccggttccggtcgggacggggtacccgtaccgttactaccgtaccctacgtacccgacgtaacgaacgtaaacttaacctaaacggaaaccttaacgggtccctttacgtttacttaacccgtaaataaccgtaaccgaacggtcccgagtacggaacggcgtaaccgtaggaccgtaacccggttacccggttagttaaccgttagtaccggttcggacggtaacggaacgggtacgggtccggttaacccccgggtaacgttaacccggttaaccggtaacccgttagacccgggtttaacggacgggttcccggtaaccggggaaccgggtaacccccggg

SEQ ID NO: 183228 - DNA, 732 bp, Homo sapiens
  misc_feature: GYAE6OF01E4SHE.13.76.G10.1.454.CMB.1.raw
  modified_base (323)..(323): a, c, t, g, unknown or other
  misc_feature (323)..(323): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcttgggtttttccttgttgcttaattttaaaaggtgcccagtgtgaggtgcagctggtggagtcgtgggaggaggtcttgactccgagccggtcggggggtcccctgacgaccttcctcctgtcgcacgtccttcgttcgggttccaccgtcagtcactacctacagtgacgtcgtcggggtcccnccgacggccgtccgaaggggaacgggtcgtgggtaggtcggtcgtttactttactttttatttaagtaggttacggttggttacgtaactacttacctcccggacgtacggtaccggttccgggtacgggacgggggtaccctacgttacccaccctactacctaccgaagacgtaacctaacttaccgaaacgaaccgtacgttcgtttgttttacctaactaaagtacgaaacgcgtacccgtaggacggaccgacgtaataccggaccgaccgggttacgttagttacttacggtgtacggagtacgtacggaccgggtaccgggaccctaacggtaaccgttacgtaccgtacgtacggtaccgggtacgtaccgggacccgggaccggaaccgggtaaccccgg

SEQ ID NO: 183229 - DNA, 705 bp, Homo sapiens
  misc_feature: GYAE6OF01BWZIX.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctgaaataattggcagataaatatacttcctggtatcagcagagtcagccacgtcccctgtgctggtcatctatcaagatgccgaagccggccctcgacgggactcccgtaggacgcggtactttccgtcgtcgggtcctcccgaaacttccgtacggggtaacctacgaccgtaccctacgtacccgtcgaaccctagttaccgaccgggtacccggggaacccccgtaagggcccttaaggttacgggtacgttagggtacgggtaccttacggtaaccgtttaacttttaaccggcggtttaaccggtacggggtccgggttacggggaaccgtaacggacggacgaccgtaaccgtccggacccccggtattaccggttcggttacccgtttacccggggtaaacggttaacccggggaccccgttaaacgggtacccgttaccccggttaaccgttaaaccggttacccgaaccggtaaaccccccggg

SEQ ID NO: 183230 - DNA, 723 bp, Homo sapiens
  misc_feature: GYAE6OF01B7HWK.13.76.G10.1.454.CMB.1.raw
  modified_base (176)..(176): a, c, t, g, unknown or other
  misc_feature (176)..(176): n is a, c, g, or t
  modified_base (436)..(436): a, c, t, g, unknown or other
  misc_feature (436)..(436): n is a, c, g, or t
  modified_base (632)..(632): a, c, t, g, unknown or other
  misc_feature (632)..(632): n is a, c, g, or t
tcagtcacgtactacacgaccggtgctcgatttagtcactcatacaggggctgggcctcaggaagcagcatcgggaggtgcctcagccatggcatggactccctctcttcctcggcgtccttgcttactcgcacgaggtatccggtggcctctatgagctgactcacgccaccctntagtcgtccgtcgtacccaggacaggacagccagcatccacgtgtacctacgtaaggaaaattaacgttggactaagaacttaaaagtacttacctttaccgtaggtaactacgacgtacgaagaacggttacgaacggccctacgtaccccgtggtcgacgttcggttacaacttactagtacgaaggtacttcggaacccgaacggtccgaacccgttaggacggttaacctcccgtagacgtaccgtacttaccgtntccggtacctaccgtaaacgtcggtaacggtaccctcgacgtaccctagtcctacgcctaaggtccgacggtacccgggaccgtaacgtcggtagtacggagtagggtacgtacgtagttacttaacggtacgtggtaccgggtacggacggtacggtaccacgtacggtacaccggtccgtaccgcccggttaanccggttcgttacggtaccgggtaacggtacccggtaaggacccgtttaccggaaccccggttagtaacccgtggtaccccggaaaccccgg

SEQ ID NO: 183231 - DNA, 585 bp, Homo sapiens
  misc_feature: GYAE6OF01A48V5.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtggggggtccctgagactctcctgtgcagcctcgtgggtcaccgtcagtcacacctacatgagctgggccgccgaggcctccgaggggaacgggctgggagtcgcgtcttcttttaatttatagtaggtggtagtactatactccgcagactcgtggacgggccgattcgacctatctaccagacgaactaattacccaaagaacacgtcttgtttactacaaatcgaacagtccctagacgacgcccgagtacggaccgaccgggtcttagttacttacgtggtgacgaaggacgtaggtccggggaccctaacggtaacgttacctacggctagtacgggtacgtcggtcggggaacccg

SEQ ID NO: 183232 - DNA, 812 bp, Homo sapiens
  misc_feature: GYAE6OF01DPKIH.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagaggactcaccatggagttttggctgagcgttgggtttttccttgttgacttaagttttaaaaaggtcgcccgtagtgtggaggtgcagtcgtggtaggagtcgtgggaggaggtcttgacttccgacggtccggtcggggggtccctaggacgtaccttctccgtgtcgcgtcgtccgttcggttggttccaaccgtctacgtacccacctaacctactagtggaccgtcggtccgggcccgaccggtacggtccgtaccggggaagggggacggggtcgtagggtacgtcgtccgtttcttttacgttttaattttaaggtaaggttacggttggtaacgttaactaccgttaccgttcccggacgtacggtaccgtaccgggtacgggacgggggtaccctacgtacctaacccgtcgttccacccgtaagaacgtaactaaccgttaaaccgaaacgtaacccgtaccggttctttacgttttaccgtaacaaagttccgaacgtacgtacgtagaggacgaccgtggtaccaacccggtccgttacgttacgttacgttacggtcggtcgacggtaaggtaccgggaccgggtaaccggggaacccgtaaccggttaaccggttaacgcggtaacgttacgggtaacggtcccggtaacggggtacccggggaacggaacccgggtaacccggg

SEQ ID NO: 183233 - DNA, 701 bp, Homo sapiens
  misc_feature: GYAE6OF01BXOZO.13.76.G10.1.454.CMB.1.raw
  modified_base (537)..(537): a, c, t, g, unknown or other
  misc_feature (537)..(537): n is a, c, g, or t
  modified_base (597)..(597): a, c, t, g, unknown or other
  misc_feature (597)..(597): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtgctccttgttgctattttagaaggtggcagtgtgagatgcgactggtggagtcgtgggggagtcttggtccagggcccgggggggtcctggacgactctcctgtgcagtcctcgttgggttccaccggtcacgtcacctacctacatcggagcgtcgggtacccgccgaggcctaccggagggggaacggggtctgggtagtgtccgttctttactttttaatttagtaggttaggttacggtagtacctaattaccgtccgacaacggtaccttccgggtagggacggggtccctagttacccaaccgtatccctaccgagtaacgtaacctaacttccgaaaagtaccacggttcctttagtttaccttaaacaatacggtaacccncggtacccgtaggaacgcggaccgtagtacgtacccgacgggttcctagttacgttacgnggtcgaccggtaggacggtacgggttcccgggaaccccttaaacgggtaacccgtttacgacgtaccgttaggtaccgggtcgtacgggtcggggaaaccccgg

SEQ ID NO: 183234 - DNA, 642 bp, Homo sapiens
  misc_feature: GYAE6OF01A4ML8.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcatccactgctactaggaaattaaagtggacagaattaaatacttacttccgttaggtactcgaagcaaggaacgtcgacggtcctaccgttcccctggtcgtcgtggtactattctaagtacaagtatcgaccaacggtccgaccgtacggacggtacctcccgtaggacgccgttattccgtcggtcgaccctaccgaactcggtaacggacctcgacctccactcgtacgaacctactacggaccggacccggacccgaggactaaggtcggagtacgggacggtactacgtaaccgttagtaccgttcggtacggacgggtaggtacgggtacacgtcacgcctacgccgaccttcgtagtcgtaccggttacggacggtaccggacgtaacccgtcgtaaccgtaccgttaagccgtaaccgacccgtaaacccg

SEQ ID NO: 183235 - DNA, 826 bp, Homo sapiens
  misc_feature: GYAE6OF01ENUYO.13.76.G10.1.454.CMB.1.raw
  modified_base (812)..(812): a, c, t, g, unknown or other
  misc_feature (812)..(812): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggtttttccttgttgtcttattttaaaaggtgccagtgtgaggtgcagcgtggtggagtcgtgggaggaggtcgttggaactccgaggcccggttcggggggtcccctgacgtactccttccgtgtgccgtagtcctcgttcggttccaaccgtcacgtccaacctaaccctacgagtagacgtacggtcgggtccccgaccgtaccggccgttaccggaaacggggggaaggggtccgttaggggaggttcggtccgtttcgtttactttttttaagtttaacgttaggttacggttaggttaacgtaactacgttaacccgtcgaaccgtaagtacccgttacggtacggaaccgggtacccgtaacttacccgaacctaccttaccgtaacccgaagtaacgtaaaacccttaaacgtttaaccccgaaaacggtaaaacccctacccggttacttaaggtaaacccttagtaccgaaaacctaaaagtaccgaaaccggaacgtaccgaggaacggaccgacggaacggaacccgtaacggttcttaagtacgttacgtaggtacgaaacgttaaacggttaaaacctttcccgttaaatttaccggtttactaaccgtagggttaaccgggaccgtaaaccgggaacccttgggttaacccnccggttacctcccg

SEQ ID NO: 183236 - DNA, 616 bp, Homo sapiens
  misc_feature: GYAE6OF01DB2SW.13.76.G10.1.454.CMB.1.raw
  modified_base (265)..(265): a, c, t, g, unknown or other
  misc_feature (265)..(265): n is a, c, g, or t
  modified_base (328)..(328): a, c, t, g, unknown or other
  misc_feature (328)..(328): n is a, c, g, or t
  modified_base (527)..(527): a, c, t, g, unknown or other
  misc_feature (527)..(527): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggactccggtggcctctatgacgctcgactcacgccaccctcagtcgtccgtcgtcccaggacacgacagccagcatccactgctcgtaagaaattaagtcggactaagataatataccttcgtaggtacncacgacgaagaacgtcgacggtccacgttccctgtcgtcgtcgtactattcctaagacgtaancgtacgacgtaacggccggacctacgcggtacctccgtagacggtactacgttcgtacgtcgccgttaaccgtacgttcgtacggaacctcgacgtcctactccgcacgtcacgtccggacggtaccacggacgttgacggacgtcggacgtcttaacgtccttagttacggtcgtcggacggtacggtacggctacgncggtcctaccgcgtccgtatacggttcgtacgttacggaacgtacggaccgacgtacccgtaacgtccgtaacgcccgacggaaccccg

SEQ ID NO: 183237 - DNA, 765 bp, Homo sapiens
  misc_feature: GYAE6OF01A4AAA.13.76.G10.1.454.CMB.1.raw
  modified_base (699)..(699): a, c, t, g, unknown or other
  misc_feature (699)..(699): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtgggaggaggtcttgactccgaggtccggtcggggggttccctggacgtacctcctcctgtcgcacgcctcgtcgggttcaccgtcacgtccaccacctacatgacgcgtcgggtcccgccgacggtccgtccggaagggggaggggcggtgggtagtcggtccgttcttttactttttaatttagttaggttaggttagggttaacgtactaacgtaccgtcccgactacggtacccgttccgggtagggacggggtacccgtacttcccgaccctatcccgtaccgagaactaaccgtaaccttacccgaaaagaacccgtacgttccgtttacgttttacctaacgaaacgtaccgaaacgtcgtaccgttagggaacgtaccgaccgtagaaccgggtacccgtaccggggttccgttagtttaacgttacgtacggtcgacgggagtaacgggcgggttacccgggaccccgtaacggttaacccggtnttaccgggacgtttagtacccgggacgtttaccgggggaccgggtaacccggaacggggtaccccg

SEQ ID NO: 183238 - DNA, 801 bp, Homo sapiens
  misc_feature: GYAE6OF01CPH8T.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtgcctcctatgagctgactcacgcccaccctnagttcgtccgttcgccccgaggacagaccagcccagcatccaccgtcgtctcgtaaggaaaattaaagttggacaagtaattaaacttattaccttccgtaggtaactcaacggtacaagaacgttcgaacgggtcctaccgtcccccgttgtcggtacgttcggtacctagttccgtaactaccgaagtaacgtcgaaccgtaacgggccccggtacccctaggtaacgggtacctcccggtaacggtaacgtccggttaacctttcgtaccgtccggtacccttaacccgagttaccggtaacggtaaaccaccggtacgaccctaccgttaccgtacgaaccctagtacccggaccgggaccgggtaacccgtagggtcccgttagggtacgggtaggttaccggaagggttcctaacggttaactttacgttacgtaaccggttacgggtacgggttacggggacggtaacgaccggtaacgccgtaccgtacggttcccgtacccgttaccggtaacgggtaaccgggttacccggaacccggttaaccggtaccgtaaccccggtttacgtaacgggtacccaaccccggtaacccggaaccccgtaaccccgttaacccccgg

SEQ ID NO: 183239 - DNA, 892 bp, Homo sapiens
  misc_feature: GYAE6OF01CTEPN.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgtcttattttaaaggtgcccagtgtgaggtgcagtcgtgggtggtagtcgtgggaggtaggtcgttgatccgacggccggttcggggggtccctggtacggtacctccgtccgtggtcgcgacgtccttcgtgggttccacccgtcacgtccaccgaacccttaacgagtcggtacgcggtcggggtccccgccgtaacgggtccgttaccggaagggggtaacgggggccgttagggacggttcggtccgttttacgtttaccttttttaagttttacgttaagggttacgggttacgggttaaacgttaccgtaaccgttaaccgttccccggtacgtaaccggttacccggttccgggtacggggtaaccggggggtacccgttaaacgtttcccgaaccccttacgttacccttacccggaaggtaaccgtaaacctaaacgtttaaccccgaaaacggtaaccgtaacccgttaccgtttaccggttttaacctttaacccgaaacgtttacggaaaaccgtcggtacccgttacgggaacgacggtccgtaagtaccggaaccgtacccgggtacgtttaacgttacgtttaccggtggtacgggacggtaacggtacggtaccgggacccggggtaacccgtaacggtaaaccggtttccgtaaccggtagttacggtaccgggttacggttaccgggccggggttaacccggaaacgggtaaccccggg

SEQ ID NO: 183240 - DNA, 750 bp, Homo sapiens
  misc_feature: GYAE6OF01BATG5.13.76.G10.1.454.CMB.1.raw
  modified_base (257)..(257): a, c, t, g, unknown or other
  misc_feature (257)..(257): n is a, c, g, or t
  modified_base (261)..(261): a, c, t, g, unknown or other
  misc_feature (261)..(261): n is a, c, g, or t
tcagtcacgtactacacgaccggtgctcgatttagtcactcatacaggggagaggagcccagcactgggattccgaggtgtttccattcggtgatcagcactgaacacagaggactcaccatggtagttttggctgagtcttgggtttttccttgttgtcttaagttttaaaaggtgccctagtgtgaggtgcagctggtggagtcgtggaggaggcttgatccagccggtcgggggtccctgacgactcgtcctgngacncgccttcgtcggttccaccgtcagtccacacctacatcgagtccgtcgggtcccgccgtacggccgtaccggaggggacggggcgtgggacggttggaccgtttctttacttttaagtttagtaaggttaggtaggttaagtacctagttaccgtcccgacgtacgtacccgtccgggtagggacggggtcctaagtttcccaaccgtactccctaccgaaggaaccgtaacctaacgttaccccaaaagggtaaccctaccggttactttacgtttacctaaacctaagtaacgaaccgtaccggtacttagggacgaaccgtaccgtaacgttaccggaaccgtaccgggtcccgttaagttacgttacggtcgacgggtaggaagtacggtacgggtaccgggacccctaaggtaaccgttacgaccgtaacgttacggtacgggtaccgttacgggtacccgggaaccgtaaccgggtaacccgg

SEQ ID NO: 183241 - DNA, 834 bp, Homo sapiens
  misc_feature: GYAE6OF01CDAQH.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagagactcaccatggtagttttggctgagcttgggtttttccttgttgtacttaattttaaaaggtgcccagtgtgaggtgcagctggtggtagtcgtgggaggaggtcttggacttccgacggcccgggttcggggggttcccctggacgaccttctccgttggtgccacggtccttcggttcgggttacccacccgttcgacgtacccaaccctaccgttaacagtcggtacgtccggttcggggtccccgccgacgggtccgtacccgggaaggggggaacggggtccgtaggggtacggtcggtccgtttcttttacgtttttaattttagttaaggttagttacgggtaacgtactaacgttacccgtccgaacgtaacggttacccgttccggggtagggtaacccggggtcccgttaacttaacccgtaacccttacgtaccccttaaccgaacggtaaaccgtaaccttaaacgttaaccccgaaaagaaacccgttcttcgtttaacgttttaccttaagaaaacgtttaccgaaaccgtacggtaccctgggaacaccgggtacctaaggttaccggaccggtaaccggttcgtaacgtttacgttacgtgacggtacgacggtacgtaccgggtccgggaacccctaaggtaaccgttcgtacgtacgtaggtacgggtaccgttgggacccggaacggaacccgggtaccg

SEQ ID NO: 183242 - DNA, 693 bp, Homo sapiens
  misc_feature: GYAE6OF01C39J1.13.76.G10.1.454.CMB.1.raw
  modified_base (463)..(463): a, c, t, g, unknown or other
  misc_feature (463)..(463): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatgggtagttttggctgagcttgggttttccttgttgcttaattttaaaaggtgcccagtgtgaggtgcagcgtggtggagtcgtgggaggaggcttgactccgaggtcccggtcgggggggtccctggacgtaccttcctccgtggtcgctacgccttcgtcgggttaccaccgtcacgtccaaccacctacagtgacgcgtcgggtccgccgaggcctcggaggggagggcgtggacgtgtcgttcttcgttttaatttagtagttagttggttaacgtactacgtaccgtccgacgtaacgtaccgtcggtgggacgggtccgtattaccacctntacctaccgaagtaactaactaacttacaaacgaaccgtacgttctttacgtttacctaataaagtcgtaaccgacgtcctagggacgacgtaccgagtacgaccgtacggtcgttagtacttaggtcgagacggtaaggacggacgggtacccggggaaccctaaacgggtacccgtttaacgacggtaccttaaacgggtcggaacccggtgggtcggggaaacccgg

SEQ ID NO: 183243 - DNA, 750 bp, Homo sapiens
  misc_feature: GYAE6OF01CCM3P.13.76.G10.1.454.CMB.1.raw
  modified_base (211)..(211): a, c, t, g, unknown or other
  misc_feature (211)..(211): n is a, c, g, or t
  modified_base (301)..(301): a, c, t, g, unknown or other
  misc_feature (301)..(301): n is a, c, g, or t
  modified_base (603)..(603): a, c, t, g, unknown or other
  misc_feature (603)..(603): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgcttaattttaaaaggtgcccagtgtgaggtgcagctggtggagtcgtggaggngcttgatccaggccgtcgggggtccctgacgtacctcctcctgtcgcacgtcctcgtcggttccaccgtcacgtccaccaccctacatgngtccgtcgggtccccgcgacggccgtaccgggaggggaacgggcgtgggacgtcgcgtttctttattttagtttagtaggtagttggtagtactactccgtcgcgacgtccgtcggcggtacgggaccgtatccgactacgtccaccgaaggacgtacctaacttaccgaaagaacccgtacgttccgtttcgtttaaccctacaaaacggttcgaaaccgccgtacccgtagggaaccaccggtacgacgtaaccggtaccgggtaccggttaccgtttaggtttaaccgtggttacgggngtaacggtaacgggtacggtacccggggttaccgggaaaccccgttaaacggtttaacccggttacctaccgggtacgttaacgggtaccggggttaccggttaggggtaacccggggaacccgggttaaaccgggtaacccccggg

SEQ ID NO: 183244 - DNA, 717 bp, Homo sapiens
  misc_feature: GYAE6OF01BH8DU.13.76.G10.1.454.CMB.1.raw
  modified_base (343)..(343): a, c, t, g, unknown or other
  misc_feature (343)..(343): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagcgtggtggagtcgtggaggaggcttgatccaggccgtgggggtccctgagactctctgtgcagtcctcgtggtccaccgtcacgtccactacctacagtcgagcgtcggtccgccgaggtccaccggagggagggtcgtggagtcgtcgttnttacttttattagtagtagtgtagtactagtacgtccgactacgtaccgtccggtggacggggtaccctacgttccgaacctactccgtaccgaagacgaacctaacttacccgtaaaagaacccgtccgttacgtttacgttttaccttaacgtaaactacgaaacccgtaacgtaccctaggaacgtacgccgtaagtccggaacccggtaccgggtacgtttacgttaacgttacgttacggtacgaccgggtaggtacgtacccggggttaccggaccccgttaaacggttaaccggttaccgtaccggttacgtacggttacccgggagggttacccgggacggggaccccgtaacggggtaacccccg

SEQ ID NO: 183245 - DNA, 754 bp, Homo sapiens
  misc_feature: GYAE6OF01A1640.13.76.G10.1.454.CMB.1.raw
  modified_base (209)..(209): a, c, t, g, unknown or other
  misc_feature (209)..(209): n is a, c, g, or t
  modified_base (287)..(287): a, c, t, g, unknown or other
  misc_feature (287)..(287): n is a, c, g, or t
  modified_base (505)..(505): a, c, t, g, unknown or other
  misc_feature (505)..(505): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttcccttgttcgcttaattttaaaaggtgcccagtgtgagtgcagctggtggagtctggaggngctgatccagcgtgggggtccctgagactctcctgtgcacgcctcgtcgggttcacccgtcacgtccacctaccctangtgacgtcgtcgggtccccgccgaacggtcctccgaggggaacggggtctagggaacgttcggtccgttctttactttttaagtttactaaggttacggttaggttacgtaactaacgtaccgtcccggatacgtccgtcggtcgggaccggggtacccgtaacttaccgaacctagtccctaccgaaggagtaacctaacttaccgaaacggtaacnccgttcttacgttttaccgtaacaaagtacggaacctacggccgtaggtaagacgtaccgagtaaccggacccggtaaccgggtcccgtttaagtttaaccgttcggtacgggtacgggtacgaagggtaaacggtaccgggttaacccgggggccccctaaaaggttaaacccggttacccgaacggttaaccgttacgtagggacccgttacgggttacccggggaacgtaacccggggaaccccgg

SEQ ID NO: 183246 - DNA, 755 bp, Homo sapiens
  misc_feature: GYAE6OF01BBJP2.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtcgtccccaggacagacacgcagcactccacctgcttacgtaggaaaattaaagttcggacaagtaaataaatacttacttccgtaggtatacagacagagtacgaggccacgtccccgtgtcgcgtcggtcatctactacaagtacgtcgaaccgaacggccggacccgtaggacgggtactcccgtgaacgtcgtattccgtcgtggtacctacctaaccgttcggtacggggtaacctcgaaccgacctaccgttacgtaccgtaaccgtacgtaccggacccgggaaccggggaaccccgtaagggtaacccgttaggttaacgggtaacggtagggtaacggtaccttaacggtaaccgtttaaacgtaccggttacggtacgggtaacgggtccgggggtacgggtaactaacggaccggtaacggacccgtaccgggtaccggtaccgtaccgttacggttacggtttacccggttaacccggggtaaaccgttaccggggaaacccgttaaccggtacccggtaaccccgttaacgtaaaccgtaccccggaacggtaaaccccccggg

SEQ ID NO: 183247 - DNA, 567 bp, Homo sapiens
  misc_feature: GYAE6OF01CR6N9.13.76.G10.1.454.CMB.1.raw
  modified_base (143)..(143): a, c, t, g, unknown or other
  misc_feature (143)..(143): n is a, c, g, or t
  modified_base (149)..(149): a, c, t, g, unknown or other
  misc_feature (149)..(149): n is a, c, g, or t
  modified_base (166)..(166): a, c, t, g, unknown or other
  misc_feature (166)..(166): n is a, c, g, or t
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (174)..(174): a, c, t, g, unknown or other
  misc_feature (174)..(174): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (187)..(187): a, c, t, g, unknown or other
  misc_feature (187)..(187): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (205)..(205): a, c, t, g, unknown or other
  misc_feature (205)..(205): n is a, c, g, or t
  modified_base (208)..(209): a, c, t, g, unknown or other
  misc_feature (208)..(209): n is a, c, g, or t
  modified_base (211)..(211): a, c, t, g, unknown or other
  misc_feature (211)..(211): n is a, c, g, or t
  modified_base (215)..(215): a, c, t, g, unknown or other
  misc_feature (215)..(215): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (244)..(245): a, c, t, g, unknown or other
  misc_feature (244)..(245): n is a, c, g, or t
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
  modified_base (278)..(278): a, c, t, g, unknown or other
  misc_feature (278)..(278): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcggngttcgntaggctattaagtgctngnagngcngntgngatngagngctnancngcgtgggccnganncnctgngcatccngttggtcaacgccntacacncnngttgngcgtcgcgcgcgcgcgaggnggngnggngtcgtgtcttagttagttagtagtagtagtacgtacgtacgtacgacgacgacgtacgtcggacggacggtacgtacgtacacgtactactacgacgaacactactaacgaacgaacgtacgtacgttacgttacgtaactaagtacgtacgacgagagacgacgacgacgacgtacgtacgtacgtacgtacgtagacgaacgtacgtacgacgacgaccgggaccgggtaccggtacggtcgggtacggtggtacggttacggttacgttacgtcggtcgtggtcgg

SEQ ID NO: 183248 - DNA, 699 bp, Homo sapiens
  misc_feature: GYAE6OF01EYI2B.13.76.G10.1.454.CMB.1.raw
  modified_base (129)..(129): a, c, t, g, unknown or other
  misc_feature (129)..(129): n is a, c, g, or t
  modified_base (198)..(198): a, c, t, g, unknown or other
  misc_feature (198)..(198): n is a, c, g, or t
tcagtcacgtactacacgaccggtgctcgatttagtcactcatacagggggtgggcctcaggaagcagcatcggaggtgcctcagccatggcatggactccctctcttcctcggcgttccttgcttacngcacgaggctccgtggcctctagtgagctgacctcgcgcccacctgagttcgtccgtcgcccgagacanacagccagcatccacctgcttactaaggaaacttaagtggactagtaattaatacgtcttacgtgtactcgagacaggtacgtcgacggtcctaccggtccctaggtccgtcgttgtactacgttactagtaccgaaggactccggacggtccggccgttacccgagggacggtaccttcggacggtacgtccggttactccggtagtcggtacccttacgtacgtcgggtaaactaccacgtaccgtaccttaccgtactaccgtacgtaccgcgggacccggttaccgggaccctaggtcgtaggcggtacgcggtacggtacttagttaaccgtaacgttcgggacgtacggacgggttcgggacgtacggacctacgacgttacccggcggttacccgcccgggttaattccgggtaccggtacgttaaccgggacggttaccggaccgtacgtaccgtacccttacggacttacgaccccggtaaccgtaccccgg

SEQ ID NO: 183249 - DNA, 857 bp, Homo sapiens
  misc_feature: GYAE6OF01APSP7.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatgggagtttttggctggagtcgttgggtttttcctttgtttgtactttaagtttttaaaaaggtcgcccagtgtgaggtgcagcgtgggtggagtcgtgggaggaggtcttgactccgacggtcccggttcggggggtccctggacgtaccttcctccgttgtcgccgacgtccttcggttcggttaccacccgtctacgtccaacctaacctacagtgacggtcggtcggggtccccgccggacggtccgtaccgggaagggggaacggggtcggtgggtacggttcggtccgtttacttttacgtttttaagttttaagttagggtttaaggttacggttaacgttaacgtaacgttacccgtccgacgtacggtaccggttaccgggtacgggaccggggtaccgtacgttaccctaaccgtacgtaccctacccgaagtaaccgtaaccttaactaacccgaaaaccgtaacccgtaccgttctttacgttttaacctaaacgtaaaacgttaccgaactaccgtaccgtaggaaccggtaccgaccgtaaggtacggaacccggttaccgggttaccgttaagtttacttacggttggtacggaggaacggacggtaccgggtacccgggaacccgtaacgggttaacccgttaccggtaacgtaccgttaaggtccggggttacggtacccgggtaacggggtaacccggtaaccggggtaaccccg

SEQ ID NO: 183250 - DNA, 811 bp, Homo sapiens
  misc_feature: GYAE6OF01D5EYC.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtcccaggacagacagccagcactccacctgcctacgtaaggtaaaattaagttcgggactaaagtaattaaaacttacttacctttccgtaggtaactcgaagcaagtaagtccgaacggtcccaaccggttcccctggtcgccgttcggtactacgttacttaactacgaaagtactacgaacccgaacggtcccggacccgttacggaaccgggtacctcccggtaggacggtaccttacgttccgtacgtccggtaccctacctaacgtcgtaacgggtacctacgaccgtccctacttaccgtaccgaaccgtacgtacccgggaacggtacccgggaacccgtaggttaaccgttagggtacgggtacgtacgggtacgtaccgttagttaaaccgtttacgttacggtacggttaccgggtacggggtccgggtagggaaccacgggtacctaccggtaccgtaacccggttacccgcccggttaccgtttacggttccggtttaacccgggttaccgggaaacccgggttaaccggggtaaacccccgttaccgggttaaaccccgttacccggttaaacccggttaaccggtaaccccggaccccggtaaaacccccggg

SEQ ID NO: 183251 - DNA, 744 bp, Homo sapiens
  misc_feature: GYAE6OF01CZU7J.13.76.G10.1.454.CMB.1.raw
  modified_base (462)..(462): a, c, t, g, unknown or other
  misc_feature (462)..(462): n is a, c, g, or t
  modified_base (545)..(545): a, c, t, g, unknown or other
  misc_feature (545)..(545): n is a, c, g, or t
tcagtcacgtactacacgaccggtgctcgatttagtcactcatacgaggggggagaggagcccagcactgggattccgaggtgtttccattcggtgatcagcactgaacacagagactcaccatggtagtttggctgagcgtgggtttttccttgttgcttaagttttaaaaggtcgcccagtgtgaggtgcagcgtgggtggtagtcgtgggaggaggtcttgactccgaggtcccggtcggggggtccctggaacgaccttctccgtggtcgccgacgtccgttcggtggttaccacccgtactacgtaccaacctaccgtaacagtacgacgtcgtccgggtcccgccgacggtcccgtaccggaaggggacgggtcgtagggtacgtcggtccgttcttttacttttaagttagtaggttagtggtaagtactagtacctcgactagtaccgtccggnggacggggtcctagtaccactactcctacgaagacgactaacgtaccaaagaacctcgtatttcgttactaacaaatcgaacncgtacctaggacgtacggactaacgtcggaaccgccgggttccgttagttaacgttacgtcgggtagaccggaaggtaccgggtacggtcccggggtaaacccaacgggttaaaccgttccgtaaccggttacgttacgggttaccgggtaaccggttccggggaaccggggaaacccggtaacggggtaacccccggg

SEQ ID NO: 183252 - DNA, 703 bp, Homo sapiens
  misc_feature: GYAE6OF01EX0PK.13.76.G10.1.454.CMB.1.raw
  modified_base (302)..(302): a, c, t, g, unknown or other
  misc_feature (302)..(302): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaggtgcccagtgtgaggtgcagcgtggtggagtcgtgggaggaggtcttggactccgagccggtggggggtcccctggacgtactcctccgtgtcgcacgtcctcgttcgggtccaccgtcagtccaccacctanatgagtcgtcgggtcccgccgaggaccgtccggaagggggacggggtcgtagggtacgtcgtccggtttctttactttttatttagtaggttagtggtatactactacgtccgatacgtaccgtcggtaggacggggccctagttaccactcgttacctaccgaaggacctaactaacttaccgaaaatcccgaccgttctttcggtttacctaacaaagttcgaaaccacggtcctaggaacggtccgactagtacggaccgtacgggtcttagttaacgttcgagttacggacggaaggtacgtacgggccgggtaaccctaacggtaaccgtttcgtacgaaccgttacgggtcgggtaccgtttcccgggacgggaaccccgtaaggggtacccccg

SEQ ID NO: 183253 - DNA, 740 bp, Homo sapiens
  misc_feature: GYAE6OF01BE1NL.13.76.G10.1.454.CMB.1.raw
  modified_base (549)..(549): a, c, t, g, unknown or other
  misc_feature (549)..(549): n is a, c, g, or t
tcagtcacgtactacacgaccggtgctcgatttagtcactcatacagggggagaggagcccagcactgggattccgaggtgtttccattcggtgatcagcactgaacacagaggactcaccatggagttttggctgagcgttgggtttttccttgttgtacttaagttttaaaaggtgccctagtgtgaggtgcgagcgtggtggagtcgtggaggaggtcttgactccgagtccggttcgggggtcctgacgactcctccgtgtcgcgacgtcctcgtggttccaccgtcagtccaccacctacagtcgacgtcgtcgggtccgccgaggccggtaccgggggaggtcgagggagtccgtcgttctttacttttaagtttagttaggttacgttaggttacgtacgtacgttaccgtccgaacgtacgtaccgttccggtagggtaccgggtcccgtacgttacccgaaccgtacgtacccgtacgaacggaacgtaacttaaaccgtaccgaaagtaccctaacgttcgtttacgtttaaccttaanaaacgtcgaaccgtaacgcccgttaaggacgtacccgacgtaacgtcggtaacccgtaacggtccgtttaagttacttacgacggttgccgtaagggcgtacggacccgggtaccaacggttaaaccttcggtacgtacgtaggtaccgtacggtacggacccgggaaccgggtaaaccggcccgtaccgg

SEQ ID NO: 183254 - DNA, 1014 bp, Homo sapiens
  misc_feature: GYAE6OF01ELQQU.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttgggtttttccttgttgtacttaattttaaaaggtgcccagtgtgaggtgcagcgtggtggtagtcgtgggaggaggtcttagactaccgacggtcccggttcgggggggttccccctaggtacgtacccgttccttacccgtaagttcgaccgtacggtccccgtttcggtttccggggttacccctaacccggttccgtaaccggttaccctaaccctaacccttaaccgtaacgtttcgggaacggttccccgggtttacccgggggttacccccggacccggtaaccggggttacccggttaacccgggggaaagggggggtaaaccggggggtccggttacgggggttacggtttccggttaccggttttaccttttttaccgtttttttaaagttttaaggttaacgggtttagggttaacgggttaaacgtttaaccgtaacgttaaccccgtacccggtacgtaaaccgggtaccggttaccggggtaggggtacccggggtacccgtactttacccgaaccttaccgttacccgtaacggaacgtaacgtaaacccttaaacttacccaaaacgtacccgtacgttacccgtttttaacgttttaaccctaacgtaaagtacccggaaaccgtacggtacccgttaagggaacccgaccgggtaaccctaacggttacccgtaaacccgggttaccgggttacccgtttaagtttaccgggtttaccggtgggttacggaacggtaaacgggttagggtaaccccggggttcgggaaaaccccccgttaagggtaaaccccttacggtacgtacggttaacggccgggttacggttccggggaacggggtaaccccggg

SEQ ID NO: 183255 - DNA, 630 bp, Homo sapiens
  misc_feature: GYAE6OF01ETQCW.13.76.G10.1.454.CMB.1.raw
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgttgctattttaaaaggtgtccagtgtgaggtgcaaggtggtggagtcgtggggggggcttgggttaagccgtggggggtccctcagactctcctgtgcaacctcgtggattctattttctctgaccgtccttggttgagcgtagggtccgccgaggccgtcccggggaaggggctgggagtggggttcggccggttaagttaaaggtagaacgacagtgggtcggaacaacaggactacagtcgttcccggtagaaaggcagtattcacgtatctacaaagagatagactaacgaaaaaggtaatgaattatatctagaactaaagtacgaaacaacctagaaaacgcgaagacagaaggcgtagtatactagtaccagagagtcggacatagtagaacgtaaagtcgggacccgacggtacgtacggttaccgaaccggttacggtacgggggaccccggtagtaccgtaccgg

SEQ ID NO: 183256 - DNA, 814 bp, Homo sapiens
  misc_feature: GYAE6OF01DPXHV.13.76.G10.1.454.CMB.1.raw
tcagtcacgtactacacgaccggtgctcgatttagtcactcatacaggggtctgggagaggagcccagcactgggattccgaggtgttccattcggtgatcagcactgaacacagaggactcaccatggtagtttggctgagtcgttgggttttccttgttgtacttaaagttttaaaaggtcgtaccgagtgtggacggtgcgagtcgtgggtggacgtcgtagggaaggtggtcgtttagacgtccgacggtccgggttcgggggtacctggacgtacctctccgtgtacgcgacgtccgtcgttcgggttacctaccggtacacggttaccaaccgtacctaacgtcgtacggacggtcggtcccggggtaccccgcgtacggggtcccggtccgggaaaggggggtacgggtcggtaggtacggttcgttcccgtttaccttttagtttttaagttaaggttaaggttacggttacggttaactaacgtactacccgtccggaactacggtacccggtacgggtcgggtaaacgggacctttacgttccaaacgttcctaccgtacgaacgtaactaacctaaccgtaaacgtaaacaccgttacgtacgtttacgtttacctaaagtaaccgttacgaaccggtacgtctaaaggacgaccggtaacgcgtaacgacgacgtaacgtagtagttaacctgtacggacggtaacgaaggttccggtaggtaacccgggaccctttaaacggggttaaacccttgtaaaccggttcggtaggtaacggtccgggggtacggtaacccgggg

SEQ ID NO: 183257 - DNA, 1075 bp, Homo sapiens
  misc_feature: GYAE6OF01DYMAP.13.76.G10.1.454.CMB.1.raw
tcagtcacgtactacacgaccggtgctcgatttagtcactcatacgagggggggagaggagcccagcacgtgggattccggaggttgtttccattcggtgatcagcactgaacacagagactcaccagtggtagttttggctgagtcgttcgggtttttccttgttgtactttaaagttttaaaacgggtcgacccgtagttggtaggtaggtgcgacggtcggttgggtaggtacggttcggtaggggaaggggtacggtccgtttacggtaaccgtcccggtacgggtcccggggttccgggggggttacccccgtaggtaaccggtaccttccgttccgtcgggttccgaccgtaccggtcccgtttccgggttccgggtttacccgtacccggttacgtaccgttaaccctaaacccgtaacccttaacgtacggttacgggtaccggttcccgggttaccccgggggtcccccgtaaccgggtaccgggttaccccgggttaaccgggggggaaacgggggggtaacgggggttaccggggtagggggttaacgggggttccgggggtaacccggaaaaccccgtaaaaacgtaaaacgggttaaaaccgaaccgggtaaacggtaaagggtaaacgggggtaaacggtaaaacgggtaaaaacggttaaaacggtaagggttaacggtttaggggttaacgggttacggtttacggtacgggtaaacgggggtaaccgggtacccgttaaaccgtttacccgtaaaccgttaccgttaacccgtaacgggaaaccggtaaaccgtaaaccccgaaacggtaacctaaacggttaacccttaccgacgttaacgttactcgacgtacgaaaggttgacgtacgcgtaaccggtccgaagggtacgggaacggtccggaacggtacccggtacggtttaccgttaagttacccgggtgtaacgggtacgggaacggtaaggggacccggttaccggggaaccccggttaaaccgttaaaacgggtttaccccgttaaaggccccggtttaagtacgggtttaacccggggg

SEQ ID NO: 183258 - DNA, 658 bp, Homo sapiens
  misc_feature: GYAE6OF01E03ZD.13.76.G10.1.454.CMB.1.raw
  modified_base (498)..(498): a, c, t, g, unknown or other
  misc_feature (498)..(498): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccgaggccgtcggggggtccctggagactctcctgtgcagcctcgtgggtcacccgtcagtccaccacctacatgacggctgggtcccgccaggccgtccgaggggaaggggctagggagtggcgttcttacgtttttaatttagtacgttaggtggtagtactatacctcccgctaggtacctccggtggacggggcccgtaacttccaccactcctacaagacgaacctaacgttacccaaagtaacccacgtcttagtttacctacaaactcgtaaacncgtcctaggaacgacggaccgagtacgaccgaccgggtcgttagttattcgtggtgacggtagacggtacggtaccggggccctaaacggtaaccgtttacgaaccgtagtaacggtacgggacggttaccgggtcggggtaaccgaacggggtaccccg

SEQ ID NO: 183259 - DNA, 743 bp, Homo sapiens
  misc_feature: GYAE6OF01EPT7G.13.76.G10.1.454.CMB.1.raw
  modified_base (136)..(136): a, c, t, g, unknown or other
  misc_feature (136)..(136): n is a, c, g, or t
tcagtcacgtactacacgaccggtgctcgatttagtcactcatacaggggtgggcctcaggaagcagcatcggaggtgcctcagccatggcatggactccctctcttcctcggcgtccttgcttactgcacgaggntccgtggcctctatgagctgactcacgcccaccctgagttcgtccgttcgtccccgaggacagacacgccagcaatccgacctgctacgtaaggaaaattaagttggacaagtaaattaaaacttacttacctttaccgtaggttaactcgaagacgtaaagacgtacacggtacctaccggttcccctggtcgtacgttacggtactacgttactaacgtacgaaggtacgtccggaacccgaacgggtcccggtacccgtacggaacgggtccgtaccggtacggacggtacgttcttaccggtcgtacggtccctaacgtaaccgttcgggtaccgggtaactaccgtaccgtaccctacgttacctacggaccctacggtaccgaccggggacccggacgtacgtacgtaggtagggtacgaggtacgtcgttaacgttacgtttacctagtcgggtacggtaccgggtacggtacgggacacgggacacggtcctaccggtaccgtcccgttacgttacgttccggttaaccggtaccggtaccggtacggacccgttacgtacccgtacgttacggtaccgaccgaccgaaccgaccccgg

SEQ ID NO: 183260 - DNA, 605 bp, Homo sapiens
  misc_feature: GYAE6OF01CZTJG.13.76.G10.1.454.CMB.1.raw
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (326)..(326): a, c, t, g, unknown or other
  misc_feature (326)..(326): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccacctcagtcgtccgtgtccccaggacagacagccagcatcactgctctagaataagtgcagataatatactcgtagtatcagcagaagtcgacgccacgtcccctgngtcgtggtcatctancaagactcgaccaagcccgccgtacgaggtacctcccgnggacgcgtacttccgtcgtcggtctacccaagtccgtacggaactcacgccctactcgtacgacctagtacgacggtccgggaaccaggtaccgtaagtgggacttagggacggttactacggtaacttagtaccgttgacggtacggtccgggtagggtaaccagaccggtaacgccgtaccgtcgaccccgttgttacgtaccggtcggttaacccgggacctacggggtaacccaaccgggttccgaacccgtaccttaacggccacccgaacccg

SEQ ID NO: 183261 - DNA, 852 bp, Homo sapiens
  misc_feature: GYAE6OF01DR2UF.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgtcttaattttaaaaggtcgccctagtgtgaggtgcagcgtgggtggagtcgtgggacggaggcttagactccgaggtcccggtcggggggtccctggacgtaccttccgttcctggtcgaccgtacgtccctacggttcgggttacccaccgttccgaacgtaccaacctaaccctacagtacgaggtccggtcggggtcccgccggacggtccgtaccgggaagggggacggggtacgtgggtacggtcgtccgtttaccttttacgttttagtttaagtagttaggtaacggtataactacgtaaccgtccgtacgacgtaccgtccggtagggaccggggttacctacgttacccaaccgtacttccggtaacaacggtaactaaacctaagttaaaccccgaaagtaacccgtaacgttccttttacggttttaacctaaccgtaaaagttaccggaaaccgtaccgtaccggtaacggtaaccgtaccggtaaccgttaaggacccggtaaacccgggttcccgggttaccgtttaacggtttaccgttaccgtagggttaccggacgtaaaggggtaccggtaccggggtaaccccggaaccccgttaaacggtaaacccggttacccgttacggacgttacggttaccggggtaacggtaccgggccggggaccgtaaaacccggg

SEQ ID NO: 183262 - DNA, 693 bp, Homo sapiens
  misc_feature: GYAE6OF01DILKE.13.76.G10.1.454.CMB.1.raw
  modified_base (549)..(549): a, c, t, g, unknown or other
  misc_feature (549)..(549): n is a, c, g, or t
  modified_base (598)..(598): a, c, t, g, unknown or other
  misc_feature (598)..(598): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagcttgggttttccttgttgtcttaattttaaaaggtgcccagtgtgaggtgcagcgtggtggagtcgtgggaggaggcttgatccgaggccggtcggggggtccctggacgtacctcctccgtgtcgcacgcctcgttcgggttccaccgtcacgtcaccacctacatgacgtcgtcgggtcccgccgacggccgtaccggagggggaacgggtcgtgggtagtcggtcgtttactttacttttatttaagtaggttagtaggtaagtactacttacctccgagtacgtaccgtccggtcgggacggggtcctacgttaccacctacttccgacgaacgtacgaacctaacttacccgaaacgtaacctaaccgttcgtttaccgttttactaaccaaagtacgaaccncggtactagacgacgccgagtaccgacgtccggttactattacgttcgngtgacggagtaggacggtcccgggaacctaacggttaaccgtactcgtaccgtagggtacggtaccgttaccgggtcggggacccggaaaccggg

SEQ ID NO: 183263 - DNA, 716 bp, Homo sapiens
  misc_feature: GYAE6OF01BB0WD.13.76.G10.1.454.CMB.1.raw
  modified_base (544)..(544): a, c, t, g, unknown or other
  misc_feature (544)..(544): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtgggaggaggtcttgatccgaggccgttcggggggtccctggacgtactcctccgtgtcgctacggtcctcgtcggttccacccgtcacgttccacacctacagtgacgcggtcgggtcccgccgaggccgtacggaggggaacgggtcgtggtagtcgtccgttcgtttcttttaattagtaggttacgtaggtagtactacgttaccgtccggtacacggtacgtccggttagggaccgggtaccgtatttacccaacctacgttccgtaccgaagaaccgtaactaactaccgaaagaaccctcgtcgtttagtttaccttagaaacttcgaaaccngtaccgaggacgaacgctagtcgacggtaccgtcggttattacgtacggtgtacggcgaaggtcggacgggttcccggaacccgttaaggttaaaccccggttacgacccgtaggttccggtaaggggtacccgttacgggaccggggtaaaccccgtacggggtaaccccg

SEQ ID NO: 183264 - DNA, 973 bp, Homo sapiens
  misc_feature: GYAE6OF01CXTAQ.13.76.G10.1.454.CMB.1.raw
  modified_base (808)..(808): a, c, t, g, unknown or other
  misc_feature (808)..(808): n is a, c, g, or t
tcagtcacgtactacacgaccggtgctcgatttagtcactcatacaggggtctgggagaggagcccagcactgggattccgaggttgttttccagttcggtgatcagcactgaacacagaggactcaccatggtagtttggctgagtcgttggtttaccttatagtacgttaagtttaaaggtcgaccgtagtgtgaggtgcagtcgtggtgtagtgaggaggaggtcttagactccgacggtccggttcgggggttacccaggtactaccgttccgtaccgttggtaacggacctaccgtccgtttacggttccgggtttaaccgcccggtttacaacggttacccaaaccgtaacccttaacgaacgttggaaccggttaccggggtttcccgggtaccccgtaccggacgggttaacccggtacccggggtaaggggtaaccggggtgtaacgggtacggttccgtttaccggtttacctttttaacggtttttaaagttaaggttacggtttaaggttaacggttaacctaacgttaacttaacccgttcccgaaacgttacgtacccggttacgggtacgggaccggggtaaccttacctaacccgtaacgtacgttaccccgaagaaacgggaaccttaacgttaaaccgttaaccgaaaacggtaaccgtaccgtttcgtttaacgttaaccctaaaagtaaccgaacgaaccgtaccggtaaccgtaggtacccggaccgtaaacgttacggtaaaccgtaccccggttaagggtaacccttttagtaaacccgggtttnttacgggggaacgttaaacccggagggtaaaaccccggggtcggtaaaccccccgggtaccgttaaaacccggtttaaaccggtccgtttaaaaccccggtttgaaaaccgggttttccggggacccgggtttaaacccggggaacccgggtaaaaccccggggg

SEQ ID NO: 183265 - DNA, 906 bp, Homo sapiens
  misc_feature: GYAE6OF01A1MAX.13.76.G10.1.454.CMB.1.raw
  modified_base (769)..(769): a, c, t, g, unknown or other
  misc_feature (769)..(769): n is a, c, g, or t
tcagtcacgtactacacgaccggtgctcgatttagtcactcatacgagggggggagaggagcccagcactgggattccgaggttgtttccattcggtgatcagcactgaacacagagactcaccagtggtagttttggctgagtcgttgggtttttccttgttgtacttaagttttaaaaggtcgccctagtgtggtaggtgcgaggtcgtagggtggtacgtcggtagggagggacggtcttaggactccgacggtccgggttcgggggtccctaggacgtaccttccgtccgttgtcgcgtacgtccgttcggttccgggtacctccgtactaccgtaccaacctaccgtaacgacgtggacggtccggttaccgggtccccgaccggtaccgggtaccggtaccggggaaggggggtaccggggtccggttagggtacggtccggtttaccgttttaccttttaacgttttttaagttttaaggtaacgggttttaggttaggttaacccgtacttaaacccggtcccgtaccggttaccgtaccgtaacccggttaccggggtacggggaaccgggttcccgttaacgttaccacccgtacttaccgaccgtaagaactaaccgtaaacttaccgaaactaacgtaccgttcgtttaacgtttaacctaactaaaccgtagaaccttacgtaccgtaggaacgtaccggtacgtaacgaaccggtaccggtaccggttacggttaactttaggttcggttaccgnggtaaccggtaacggtaggtaccccggggacccggttaaccggtaaaccgttaccggttaaacccgtaccgttaccgggtactttacgggacccgggttaccggggacccgggaaccggtacccggtaaccccgggg

SEQ ID NO: 183266 - DNA, 666 bp, Homo sapiens
  misc_feature: GYAE6OF01C85Z9.13.76.G10.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (418)..(418): a, c, t, g, unknown or other
  misc_feature (418)..(418): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctcctatgagctgactcacgcccaccctcagtcgtccgtcgtccccaggacagacncgccagcatcacctgctctagaataatggacagataanattacttccgtagtatcagacagtaacgtcacggccacgtcccctggtacgctggtcactntacncaagntcgaccgacggcccgtacctacgacggtaccgtcccgtaggacgtaccgtaactttccgtaccgtcggaccttaccccgaacgttccgtaccgggtaacctccggtaacncccgtactacctaccgaaccctaggtacccgaaccggaccccgggtaacccgtagggtacccgttaagcggtaacgtggaacgtccgttaagaacttagttacgtacggtcggtacgggacgggtacggacgttacgacgacgcgtaccgtccgacccgtagtacgtcggtaccgttacgggtaacgtcccggtaacgaaccggttacctacccgggttacctaaacggtccgaaccgtaacccccgg

SEQ ID NO: 183267 - DNA, 677 bp, Homo sapiens
  misc_feature: GYAE6OF01CR59M.13.76.G10.1.454.CMB.1.raw
  modified_base (208)..(208): a, c, t, g, unknown or other
  misc_feature (208)..(208): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggnggcttgatccagccgtgggggtccctgagactctcctgtgcacgcctcgtgggttcaccgtcagtcacacctacatgagctgggtcccgccgaggcctccgaggggaacggggcctgggagtgcgtcttcttttattataggtagtggtagtacatactccgacacgacgtccggtggacgggggccctattccacctatcctaccgaagaacgtaaccgtaactttacccgaaagaaaccctacggtctttacggttttccttaacgaaaagttacgaaaccgtacgtacccgttaggaacggtacggcccgtaagtacggaccgtaccgggtccgttagttactttacgtggtacgcggagaggtaccgtcgggggacccctaagggttaaacccggtttaccgtaaccgtacgttacgtacgggtaccggtcggtacgggggacccgtaaacggggtaacccccgg

SEQ ID NO: 183268 - DNA, 673 bp, Homo sapiens
  misc_feature: GYAE6OF01CWMR5.13.76.G10.1.454.CMB.1.raw
  modified_base (172)..(172): a, c, t, g, unknown or other
  misc_feature (172)..(172): n is a, c, g, or t
tcagtcacgtactacacgaccggtgctcgatttagtcactcatacaggggtgggcctcaggaagcagcatcggaggtgcctcagccatggcatggatccctctcttcctcggcgttccttgcttactgcacaggatccgtggccctcctatgagctgactcagcccaccctnagtcgtcccgtgtcccccaggaccagacagccagcatccaccgtgacctctaaggtaaaacttaagttcggacaagtaaactaaattctaaccttccgtaggtactcgagacaaggtaacgtccgacggaccctaacggttcccccgtggtacgtccgttaggtacacttctaataaccgaaagtctacggaccgaacggcccggtcccgtacggacgggtacctacccgtggtaacgtcgttacttccgtcgtacggtaccctaccgtaaccgtcggtacggaacctcgacgtaccctacgtctaccgacctagtacggaccggacccggtaccgaggtaccgtagtagggacgtacggacggtctaggtaccttagttacgtggtaccgagggtaccggtacgggacagacgacgtaccacgtaccgccgtattcgtacggtcgtacggacgtcgggaactacgtccctaacggactacgtaccgccgtaccgaacccg

SEQ ID NO: 183269 - DNA, 866 bp, Homo sapiens
  misc_feature: GYAE6OF01BHOLB.13.76.G10.1.454.CMB.1.raw
  modified_base (85)..(85): a, c, t, g, unknown or other
  misc_feature (85)..(85): n is a, c, g, or t
tcagtcacgtactacacgaccggtgctcgatttagtcactcatacgagggggctgggcctcaggaagcagcatcggaggtgcctnagccatggcatggactccctctcttccgcggcgttccttgcttacgtggaccacgaggtacgtcccggtggtccctaccgtatcgacgtctagacctcacgcccaccctgagttcgtccgttcgtcccgaggacacggaactcgaccagactactccgtaccgtgtcctacggtaaggtaaaattacggtggacgtaaagtaattaaacgttacttaccgttcgtaggtaactcgagacgaagaacgtcgacgtcctaccgttccccgtggtcgcgtaggtctacgttactacgtaccgaagtaccgtaccgaacccgtaacggtaccccggtacctagggaccggtacccttcggaggtaccgtacttcgttccgtaccggttactacccgttaccggtaaaccgtccgggtaacggtacctaaccggcccggtaccgtacttaccgaacccggaacctttacgggcccggggtaaacccgggaccgggggtaacccgggtacgttaacccgggtagtttaccggggtacgtttaaccggggtaccgttacggttaaaccggtttaaccgtttacggttacccggggttcgacgggggttaacccgggtacggtacgggtactacccgggatacccgggtaaccctcggggtacccctaggtaacccgttttacggaccggggttttacccggaccgggttaaacccggggaccgtaacccggttaacccggtacccgttaccggttaaccaccgggtaacccggccgggaaaacccccg

SEQ ID NO: 183270 - DNA, 639 bp, Homo sapiens
  misc_feature: GYAE6OF01EK749.13.76.G10.1.454.CMB.1.raw
  modified_base (303)..(303): a, c, t, g, unknown or other
  misc_feature (303)..(303): n is a, c, g, or t
  modified_base (377)..(377): a, c, t, g, unknown or other
  misc_feature (377)..(377): n is a, c, g, or t
tcagtcacgtactacacgaccggtgctcgatttagtcactcatacagggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagccttcgtggttccaccggtcagtcaacctacctacatcgagcgtgggtccnccgaggcctccgagggagggctgggagtgcgttcgttctttttaattagtagttagtcggtaagtacattaccncgcacgactccggtagacggggtcctagttcacctagtctacccgagaacgaactacttaccaaacgtaaccacgtaccttgttttaccttactaaagtacgaacgagaccctagacggtacgaccgatacgaccgacggtccgtcgttattacgtggtacgccgtaagacggtacgggttcgggccccgtaaaggtaacccgtttaccgtaaccgtacgttacggtacgggtacccggttccgggtcggggaaaccccggg

SEQ ID NO: 183271 - DNA, 721 bp, Homo sapiens
  misc_feature: GYAE6OF01EF0WI.13.76.G10.1.454.CMB.1.raw
  modified_base (256)..(256): a, c, t, g, unknown or other
  misc_feature (256)..(256): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttaatttttaaaaggtgcccagtgtgaggtgcagctggtggagtctgggaggaggcttgatccgagccgtgggggtccctgagactctcctgtgcngcctcgtcggtcaccgtcacgtccacacctacatgagtcgtcgggtcccgccgacgggcctaccgggagggggaacggggcgtgggacgtcggtccgtttctttactttttaatttagtaggtaggttggtaagtacattacctccgacaacgtcctcggtgggacgggtcctacttccgacctacttccacgagaacgtaactaaacgttacccaaagaacctacgttacctttacgttttacctacgaaaagttccgaaactcggtaccctagggaactaccgtaaccgagtaccggtaaccggtcccggttacgttacgttaattcgtacggtacggacggaacggtaggtaaccggggtacccgggtaaccccccttaaaggttaaacccggtttaccgtaacccgtcgtttaacggtaccggggtaacccgggttcccggcggggggtaaaacccccggg

SEQ ID NO: 183272 - DNA, 749 bp, Homo sapiens
  misc_feature: GYAE6OF01BZV7R.13.76.G10.1.454.CMB.1.raw
  modified_base (600)..(600): a, c, t, g, unknown or other
  misc_feature (600)..(600): n is a, c, g, or t
tcagtcacgtactacacgaccggtgctcgatttagtcactcatacagggggggagaggagcccagcactgggattccggaggtgtttccattccggtgatcagcactgaacacagaggactcaccatggagttttggctgagtcgttgggtttttccttgttgacttaattttaaaacggtcgcccgagtgtgaggtgcagtcgtggtaggtagtcgtgggagggaggtcttggactccgacggccgggttcggggggtccctggacgtcctcgttcctgtcgcacggtccttcggttacgggttccaccgtacacgttccaacctacctacagtcgaggtcggtccgggtcccgccgacggccggtacgggacgggggagggtcggtggggacgttcggtccgtttacttttacgttttattttaaggtaacggtttaggttaggtacgttactagttacccgtcgacgacggtacccgtcggtacgggacggggtcctacttccaacctcgtccacgtacgactaacgtactaaccgaaagtaccctagtcctttagttacctaacaacttaggacacggccgtaggacgcgtaacgntacgtacgaccgggttgtttagtaacttggacgtacggacgtaaggacggttaccgggaccggggaaccccttaacgggttaacctttaacggcgtttaaccgtggtacggggtccgtaccggggacgggaccggtaacggtacccggg

SEQ ID NO: 183273 - DNA, 842 bp, Homo sapiens
  misc_feature: GYAE6OF01ANMJ5.13.76.G10.1.454.CMB.1.raw
  modified_base (608)..(608): a, c, t, g, unknown or other
  misc_feature (608)..(608): n is a, c, g, or t
tcagtcacgtactacacgaccggtgctcgatttagtcactcatacgagggggggagaggagcccagcacgtgggattccggaggttgtttccattcggtgatcagcactagaacacgagagactcacagtggtagtttggctgtagtcgttgggttttccttgttagtacttaaagtttaaacggtcgccgtaggtgtggaggtgcgaggtcggtgggtggtacgtcggtagggaggagtcgtagaccgtccggacggtccgggtccggggtcctacgtacgtcctccgtcgtcggtcgaccgtcgtccgttcggttcggtacccaccgtacgacgtaccacctaccgtagtacgtcgacggtccggtcccggtaccgacgggtacgggtaccggtacgggaggggtacggtcgtaggtacgtcgtttacgtttacttttagtttagtttaaggtggttaggtacgtaactacgtaacctaccgtcgaacgtacggtcccggtaggtcggaccggtacctacctaccactaccgtaccagaacctagaaccttacgtaacctaacgtacttacgttactttacttaacgaacgtaagaccgtaaccgngttacggacggtacgacccggtagtacggtaaccggtacccggttcgtttaccgtaagttaccgttacgggacgtaaccgggtacggaggtaaccccgggtaccgggtaacccggttaaacccggttaacggtttaaccgaccgggtttacccgggtaacggttacccgggtaccgggggtaccccggttaagggggaccccccgggttaaaccgggcccggttaaacccccgg

SEQ ID NO: 183274 - DNA, 874 bp, Homo sapiens
  misc_feature: GYAE6OF01AN9Y2.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggtttttccttgttgtcttaagtttttaaaaagggtcgccctagtgtggaggtgcagcgtggtggtagtcgtgggaggaggtcttgactccgacggtccggttcggggggttccctggacgtaccttccttccgtgtcgaccacgtccgttcggttcgggttccacccggtacgacgtaccaacctaccctaacgtagttcggacgtccggtccgggtccccgaccggacgggtccgtaccggggaaggggggaacggggtcggtagggtcggttcggtccggttttaccttttacgtttttatttacggttaaggttagggttaggttaacgttaactaccgtaccgtcccgacgtaccggtaccgtacgggtaccgggtaccgggtaccttacgtacccacctcgtacccaacgacgtaacctaacttaacgtaacccgaaacgtacccgttacgttacgtttacttaacctaactaacggaaactaccgtaccgacgtaggtaacaccggtcgtaacgacccggacgggttacccggtacgtttagtttaacgtccgtaagggtccgaaacgggtagggtaccgtaccgggggttaaccgtaaccccgggttaaagttaaccccggtttaaccgaacccggtttaacggttcgggtaaacccggggttacccggggtacccgggtaaacccggggacccggggtaaacccgtaaacccccgggg

SEQ ID NO: 183275 - DNA, 914 bp, Homo sapiens
  misc_feature: GYAE6OF01A1AR2.13.76.G10.1.454.CMB.1.raw
  modified_base (369)..(369): a, c, t, g, unknown or other
  misc_feature (369)..(369): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgaagtcttggggtttttccttgtttcgcttaatttttaaaaaggtcgaccctagttgtgaggtgcagctggtggtagtcgtgggaggaggtccttggactccgacggtccggttcgggggggtcccctggacgtaccttccttccgtgtgcgacgtccgtcgttcgggttccaccggttacacggtccaaccaaccctacacgtaacggcgtccgttcggggtccccnccggacgggtccgtacccggagggggaacggggtccttaggggacgttcggccgtttaccgttttacttttttaagtttaacgttaggtacggttaggttaagtaacgtacgttaaccgtcccgacggtaacggtccggtacccgggttaggggaacccggggtcccgttactttacccaccgtacttaccgtaccgaaagggaaccgtaaaccgtaactttaaacccggaaaccttaaccggaaccggtttaccgtttttacgggtttacctttaacgtaaaagttttaccggaaacgtaccgggtaccttaacggagggtaaacctaccgggtaaggttaaaccggggtaaacccgggttccggtttaagtttaaaccggtttaccgtagggttaccgaaccgggtagtaacggtaacgggttcccggggtaaacccctaaccggggtttaaaccgtttaccggtaacccggttacgggtttaaccgtaccgggttaaccgggttccggttacccgggggggtaaccgtaaaaccccgggggg

SEQ ID NO: 183276 - DNA, 906 bp, Homo sapiens
  misc_feature: GYAE6OF01B1OAX.13.76.G10.1.454.CMB.1.raw
  modified_base (186)..(186): a, c, t, g, unknown or other
  misc_feature (186)..(186): n is a, c, g, or t
tcagtcacgtactacacgaccggtgctcgatttagtcactcatacagggggggagaggagcccagcactgggattccgaggtgtttccattcggtgatcagcactgaacacaggaggactcaccatggagttttggctgagcttgggtttcttcgtgtcgtatttaaagtagccagtgtggtaggngcagtgtcggtggagtcgtaggagggaggtcgtttagtacgtaccgacggtccgggtccggggggtacccgtacgtaggaccttccgtccgttggtcgacgaccgtaccgttcggttaccggggttccgtaaccccggtctaacggtaccaaaccgaacccttaaacctagaggtaacggtccggggttccggggttccccgggaacccgtaccgggtaccgccccgggtaacggggggaaaggggtccggtacgggttacggtaggttcccggtttacgtttttacctttttaaagttttaaggttaacgggttttaacgggttgggttaaaccgggttaaacgtaaccttttaacccgggacccggggttaactaaccgggtaacccggtacccgggttggggtaaccggggggtaccttaccgttaacctaacccgacctttaacgacccgaagtaacgaacttaaacctaaccgaaacaacgtaacccgtgttacgtttactttaaccgaaacgacgtaacgtacgtaccgtaggacgaaccggaccgtgaacggtcgacccgggttagttcgttaaacggtttcagggtaacggcggtaaggtacggtacgggtacccggggtaccctaaacgggtaacccgttaaaccgtacggtaccgtacgggtacggttaccgggcccggttacgggaaacgggaaccccggtaaacccgg

SEQ ID NO: 183277 - DNA, 938 bp, Homo sapiens
  misc_feature: GYAE6OF01E2TA7.13.76.G10.1.454.CMB.1.raw
tcagtcacgtactacacgaccggtgctcgatttagtcactcatacgaggggggggggctgagcccttctctggaaaccacacagctcctcctgcagcacgcccctgactgctgatttgcatcacggccgctcttccagcgaagggataagagaggcctaggaacgaacctcgcccagccgtcgggcctcgaaggagcagcagtcggagtcgcctcacgccagtcgactagtcgaccttcccctctccgttccgtccggtaccgttccgttcgtcctttaccgcgaccacggtacggtacccgttcccggtaccggtcccttaccgttaagtcggtaaccgccggttaccgtaccgtaccgacccgtcccctaacccgtcggtacgggtttcccgtcccggtaccgtacccccggaaggtccaaccggtaccgaccggtaccacggtaccctaacctcccggtacccgttacgtcccgtttaaacgtaaaacggtaaaacgttttaaccgtagggtaacctaaaaggtaaaacttttaaaacgttaccgttttaacccgtttaccggtaggttaaccgtaccgtaaacgttaaccgtaaacggttaaaccggtaccggtaacccggggtaaccccttacccgggtttccccggtaacggtttacccggtacccgtttaaccgtaccgtttaacccgtaacgttaacggtaccgtaacggtacccgtacccggtaaaccggtaaccccgggttcccgtaaccccggtaacggggaccctttaaccccgggtaccggtacggtaacggtttaccccggttacgtttacccggggttaccgttaacccggtaccccgtttaaacccgggtaaccctttaccggggtttaaacccgggtaccccttaaaccccggttaaccccgtacccccgggtttaacccg

SEQ ID NO: 183278 - DNA, 733 bp, Homo sapiens
  misc_feature: GYAE6OF01BHXRH.13.76.G10.1.454.CMB.1.raw
  modified_base (482)..(482): a, c, t, g, unknown or other
  misc_feature (482)..(482): n is a, c, g, or t
  modified_base (628)..(628): a, c, t, g, unknown or other
  misc_feature (628)..(628): n is a, c, g, or t
tcagtcacgtactacacgaccggtgctcgatttagtcactcatacagggggggagaggagcccagcactgggattccgaggtgtttccattcggtgatcagcactgaacacagaggacctcaccatgggtagttttggctgagtcgttggttttcctgtagctaagttttaaaggcgccagtgtgtaggtcgctagtcgtggtcggtagtcgtgggacggtggtccgttgacgtccgacggccggttcgggggtacctggtacgtactctccgtgtgcagtccgtgtcggtctacggctacgtccactacctagtacgtcggtacgtccggttccggacccgaccgtaggacccggtcgggaagggtacggtcgtaggtcgtcgttgtccgttttatttacgttagtagttcggtagtagtactagtccgaccgtgtaagtcccggtacggtacggtcgggtactacttaccgacctttacncgtacgagtacgtaactaaccggtacaaacgtctacgttctagttactaacgtaggtacaaggccctaggaccgtacgaaccgtgaacggtagaacccggtcggtacgttagtcccgtaagtcggacgtacgggtagtacccgggnggtaacccgggtactaacccggttacggtttccgaacccgtttgggaaccccgggtttcgtaccggttaccgggggccgaaaaccggttcccgggtaaacccggg

SEQ ID NO: 183279 - DNA, 663 bp, Homo sapiens
  misc_feature: GYAE6OF01EJYW0.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctgggtggagtctgggaggaggcttgatccagccgtgggggtccctgagactctcctgtgcagtcctgtgggttccaccgtcacgtcacctacctacatgagcgtcgggtcccgccgaggtccgtccgagggggaacggggcgtgggagtcgtcgttcttcttttattatagtagtggtagtacatactccgacagtactccggtggacggggcctattccaacgatcctaccgagacgaactaacttacccaaagaacacgtcttcgttttacctacaaagttacaacgtacgcctagaacgacgcccgtaagtacggaaccgtaccggggtcccgttagttaacgttaccgtaggtacgacgggaagtacggaacggttccggggaacccctaacgggtaaaccggtttccgaacggtcgtaagtcgggtaccggttacgggtacggggaaccgtaacggggtaaccccgg

SEQ ID NO: 183280 - DNA, 719 bp, Homo sapiens
  misc_feature: GYAE6OF01DOHDJ.13.76.G10.1.454.CMB.1.raw
  modified_base (132)..(132): a, c, t, g, unknown or other
  misc_feature (132)..(132): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacnggatccgtggcctcctatgagctgactcacgcccaccctcagtcgtccgtcgtccccgaggacagacacgccagcactccacctgctcgtaggtaaataagttggactaagaattaaatactaccttccgtaggtactacacgacgaagtaacgtccgacggtcctaccggtccccgttaggtcgtccgtagggtacctattacgtaactacgtaagacgtaccgaccgaacggtcccggtcccgtacggacggtacctccggtaggaccgtacgtacgttcctcggtcgtcccttacgacgttcggacggtaacctcgtacgtcctacgtccgacgactcgacggaccgggtaccgaccgtaggcctaaggtcggtagtcgggctacgtacgtaacgttacttacggacggtagggacggtaccggtagggaccacgaaccggcgtaccgtacccgggtccgtcccgttaagttaccgttccggttacggtacccgggttaaaccggtacccggggtaaacccgttaccgggtacccctaaacccggttaccgtaaacccggtccgaaccccgggtaaacccccgg

SEQ ID NO: 183281 - DNA, 783 bp, Homo sapiens
  misc_feature: GYAE6OF01CPHRF.13.76.G10.1.454.CMB.1.raw
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacaggggtctgggagaggagcccagcactgggattccgaggtgttccattcggtgatcagcactgaacacagaggactcaccagtggtagttttggctgagtcgttgggtttttccttgttgtcttaagttttaaaaggtcgccctagtgtggaggtgcgagtcgtggtggtagtcgtgggaggaggtcttgactccgacggtccggttcgggggtccctggacgtaccgtcctcgtgtcgactcgtccgttccggtcggttcctaccgtntaccgtaccaccaccttanagtacggcgtccggttcgggcccgaccgacggtccgtaccgggtaggggacgggtcgtaggtcgtcggtccgttacttttcgttttaagtttagtaggttacgttaggttacgtaactactaaccgtcgtaacgtacgtacgtcggtacgggtccgggtaccttaccttacccgacctcgttccgtaacgaacgtaacgtaaactacgtaaacccgaaatacccgtacgttctttcgtttaataaaccgtaagtactaaacccgcggtacctacgaggtaacccgtacgtacggtacggtacccgtaccggttacggtttacgttaactccggttacggtgaccggtaaggaacgggttaccgggtacccggtaaccccgtaaacgttaacgttacccgtaacgtgttaacgggtccggtaaccggttcgggtacccggggaaacccggg

SEQ ID NO: 183282 - DNA, 676 bp, Homo sapiens
  misc_feature: GYAE6OF01AYK32.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtccgtcgtccccaggacagacagccagcatccacctgctctaggaaactaagtgacagataaatatactcctgtatcagcagaacgtcaggccacgtcccctgtcgtctggtcgattctaatccgaaagctgacctaacggccggtcccacgtacgggacttcccgagacgcgtacttcgacgttcggcctaacctaccgtcgtacgggtaacctacgacgccctactcctacggaccgtacctcgaacggtccgggacccgaaggtcgtagtagggtacgtagacggtacgtacgtaaccgtttacgtacgtccggtacggtaacggggtccggtacgggacctacggacgtacggtacccgtaccgtaccgggtacccggtacgttaacggttcccggttacccgggtttaacggaaaccggttaccggggtaaacccgtaaccggttaccgaacccgggttaccctaaacgggtacccgtaacccgaaacccccggg

SEQ ID NO: 183283 - DNA, 935 bp, Homo sapiens
  misc_feature: GYAE6OF01A98LD.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttagttttaaaaggtcgccgagtgtgaggtgcagcgtggtggagtcgtgggaggacggtcgttgacgtccgaacggtcccggtcggggggtccccgtaggaacgtaccttccgttcccgttggtcgccgaccggtccccgttcggttccgggtttacccgaccccggttactaaccggttaccctaaccctaaacccgttaacgtacgttaggaacggtcccggtttaccgggggtcccccgacccggtaaccgggcccggtaccggggtaaaacgggggggtaaccggggggtccggtagggggtaacggttccgggtccgttttaaccgttttacgttttttaaaagttttacggttaaagggtttaacgggttagggttaaacgtaaaccgtaacgttacccgtacccggtaaccgtaacggtaacccgttccggggtacggggtaaccgggggtaccccgtaacgtttacccgaacccgttaacccgtaccgtacccgaaagggtaaaccgtaaaccggttaaaccttaaacccggaaaacgtaaccccgtaaccgttcgttttacggttttaaccctaaacgaaaagttacgaaaccgtacgtacccgttaggaagtaccgaaccgactaacgggcccgaaccggttccgttagtaacgttcggtctaggccggtaagggacgttaccgggaaccggggacccttaacggtacccgtttcgaactccgtaaggtcggtaccgggtacgacggggtaacgaaccgggtaccc

SEQ ID NO: 183284 - DNA, 682 bp, Homo sapiens
  misc_feature: GYAE6OF01EN96Z.13.76.G10.1.454.CMB.1.raw
  modified_base (203)..(203): a, c, t, g, unknown or other
  misc_feature (203)..(203): n is a, c, g, or t
  modified_base (328)..(328): a, c, t, g, unknown or other
  misc_feature (328)..(328): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttattacttaattttaaaaggtgtccagtgtgaggtgcagttggtggagtntgggaggaggcttggtccgaggcccgggggggtccctggagactctcatgtgccggcctcgtgggctcaccgtcaaacacccaactacatgagcgtgggtcccgccaggcctccgaaggggaagngggccggaggtcgggtctctagtttatttatggtcgacggtgccactacttctacgcagctcggtggacggggtcccgttacacctactcctccgagaacgaactaacttaccaaacgaaccgacgggttattacttaccttaacgaaatcgaaaccgacctaggaacgtaggtacggacggacgaccgggtccgtactactttacgtgtaggaacgtaaagatacgagaacggacggaccggggtaccccgtaaggtccgggggccgttaggggtacgggttcgggtttccgttttcggttacggtaccgttcgggtaccgggtcgggggcccgtaaccggggtaaccccggg

SEQ ID NO: 183285 - DNA, 732 bp, Homo sapiens
  misc_feature: GYAE6OF01BPAS6.13.76.G10.1.454.CMB.1.raw
  modified_base (253)..(253): a, c, t, g, unknown or other
  misc_feature (253)..(253): n is a, c, g, or t
  modified_base (464)..(464): a, c, t, g, unknown or other
  misc_feature (464)..(464): n is a, c, g, or t
  modified_base (493)..(493): a, c, t, g, unknown or other
  misc_feature (493)..(493): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtgccctagtgtgaggtgacgagtcgtgggtggtagtcgtgggaggaggtcttggactccgaggtccggtgggggtcccngagctctcctgtcgcacgtcctcgttcgggtccaccgtctacgtacaacctacctacagtgacggtccgtcgggtcccgcgacgggtccgaccgggaaggggacggcgtagggagtcgtcgtttactttacgttttattagtaggttagttaggtaacgtactactaccgtccgacagtaccgtccggagggacgggtctaactcctaacnctaccagacgactaactaactaccgaaanacttacgtctttacgttaccaagtaaacgtcgaaccgagcctaggaacgaccggacgtaacggtaccgtaacccggcgggtttactacggtttaatacgtcgggtaacgagggacggacgggttaccggacccggggtaaccctaaacgggtttaaacgtccccgaacggttaggtaccggttttacggggaccccttaaggggggaccccggtaaaccggacccggggttaacccccg

SEQ ID NO: 183286 - DNA, 649 bp, Homo sapiens
  misc_feature: GYAE6OF01BP415.13.76.G10.1.454.CMB.1.raw
  modified_base (254)..(254): a, c, t, g, unknown or other
  misc_feature (254)..(254): n is a, c, g, or t
  modified_base (307)..(307): a, c, t, g, unknown or other
  misc_feature (307)..(307): n is a, c, g, or t
  modified_base (583)..(583): a, c, t, g, unknown or other
  misc_feature (583)..(583): n is a, c, g, or t
  modified_base (610)..(610): a, c, t, g, unknown or other
  misc_feature (610)..(610): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagctggtggagtcgtggaggaggcttgatccagccgtggggggtccctgagacctctcctgtcgcncgcctcgtcgggtccaccgtcagtccaccacctacatgacgcgtcgggtcccnccgaggccgtccgagggggaacggggcgtgggacgtcgccgttctttactttttatttagtaaggttggtggtaacgtactactaccgtccgcacgtaccgtccggtggacggggcctagttccaacctattcctaccgaagaccgtaactaacgttaccaaacgaaccctaacgtctttacgttttacctacgtaaactcgaaacctcgtaccgtagacgacggccgaagtacgacgtaccgggtaccgttaggtacttccgtggtcgaacgagnggacgtcgggaccctaagtacgttacncgtactagtacggcgtacgggcggaccgaagggtacccg

SEQ ID NO: 183287 - DNA, 835 bp, Homo sapiens
  misc_feature: GYAE6OF01AJL2V.13.76.G10.1.454.CMB.1.raw
  modified_base (174)..(174): a, c, t, g, unknown or other
  misc_feature (174)..(174): n is a, c, g, or t
  modified_base (224)..(224): a, c, t, g, unknown or other
  misc_feature (224)..(224): n is a, c, g, or t
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
  modified_base (625)..(625): a, c, t, g, unknown or other
  misc_feature (625)..(625): n is a, c, g, or t
  modified_base (700)..(700): a, c, t, g, unknown or other
  misc_feature (700)..(700): n is a, c, g, or t
tcagtcacgtactacacgaccggtgctcgatttagtcactcatacagggggggagaggagcccagcactgggattccgaggtgtttccattcggtgatcagcactgacacagaggactcaccatggagttttggctagagcttgggttttccttgttgcttaattttaaaaggngcccagtgtagaggtgcagcgtggtgggtgtcgtgggaggaggtctagtntccgaggtccggtcgggggtaccctggagtacctctaccgtgtcgnaccgtcgtcggttacggttccgaccgtacgngtaacccgaccgtacacgtaagtcggtacgtccggttcggggaccccgaccgtagggcccgttacccgggaagggggtaaccgggngttacggggacggttccgtacgttacgttttacgttttaaagttttacgttaacggggttagttacggtacgttaactccgttaacccgtccggaacacggtaccgggtccgggtaacgggtccgggtaacccgtaccgttaccgtaaacctccggtcctaacggtaacgtaacggaaccctaaccgtacctaaaccggtacacgttaccgtttacttttaaccgtaactaacggtanaaccccgtaagaccgtacggaacaccggtaacgacgttaacgcccgggtaaccgtacggttacttacgggttaancggtaaggaacccgtagtacgggtaccgggtcccggtaccggaaacccgttacgttacccggtaacctacggggttaacgttaccgggtaccggttacggtacccgggggtaaacctcccgggggtaaaccccgg

SEQ ID NO: 183288 - DNA, 788 bp, Homo sapiens
  misc_feature: GYAE6OF01BEHNN.13.76.G10.1.454.CMB.1.raw
  modified_base (209)..(209): a, c, t, g, unknown or other
  misc_feature (209)..(209): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgccctagtgtgaggtgcagctggtggagtctggaggnggcttgatccagccgtgggggtccctgagactctcctgtgcagcctcgtggtacaccgtcacgtcaccacctacatgacgcgtcgggtcccgccgacgtcgtacccgaggggaagggccgtgggagtcggtcgtcttacgtttttacgtttagtaggttagttgggttaagttaccagttaccctcccgactaagactcccggtagggacggggccctagttccacctatcctacctaagacgtaaccaacgtttaccaaacgaacctaccgtactttcggttttaccttaaccgtaaactacggtaaaaccgtccgtacccggttagaacgggtaccggtacccggtaacttacgggtaaacccgaaccccgggttcccgggtttaacggtttaaccggtttaccgttacgggttcggaacggtaaagggaaccgggtacgggttcccggggggaaccccccgttaaacgggttaaccccgggtttaaacccttaaccccgggtgttaaaacccgggttcggggtaacccccgggtttacgggtaacccggggggtaccccggtaaaaccccgggggg

SEQ ID NO: 183289 - DNA, 793 bp, Homo sapiens
  misc_feature: GYAE6OF01D7HC3.13.76.G10.1.454.CMB.1.raw
  modified_base (319)..(319): a, c, t, g, unknown or other
  misc_feature (319)..(319): n is a, c, g, or t
  modified_base (761)..(761): a, c, t, g, unknown or other
  misc_feature (761)..(761): n is a, c, g, or t
tcagtcacgtactacacgaccggtgctcgatttagtcactcatacaggggggagaggagcccagcactgggattccgaggtgtttccattcggtgatcagcactgaacacagaggactcaccatggtagttttggctgagtcgttggttttccttgttgtacttaagttttaaaaggtcgccgtagtgtgaggtgcgagtcgtgggtggagtcgtgggaggacgtcttgactccgacggtccggtcgggggtccctggacgtacgtcctcgtgtgcgtacgtccgttcgtcggttccaccgtcgtacgtccacacctanagtgacgtcgtcggtccgacgacggtcgtacggaggggtaggtcgtgggtagtcgtcctttcgtttactttagttacgttaggtagttcgtaacgttacacgttccgtacgctacggtaccgtcgggtacggccgggtacctacgttacctacgtactacccgtacgaaggtaaccgtaaactaaccgtaacgtaaacggtaccgttaccgttacgtttacgttttaaaccaacgggtaaacttaccgtaaaccgtacggttaccggtacggaacgtaccggtacccgtaacggtaccgggaacccggttaccgggtttacgggttacttttaacggttacgacgggttacggaaacggttaacgggaccgggttaacccgggccgggtaaaccccgttaagtaaccccggttcgtaccgtaggtacggtcgttacccgggnggaaacccggggtaaccgtcccgggtaacccg

SEQ ID NO: 183290 - DNA, 727 bp, Homo sapiens
  misc_feature: GYAE6OF01DNKMB.13.76.G10.1.454.CMB.1.raw
  modified_base (460)..(460): a, c, t, g, unknown or other
  misc_feature (460)..(460): n is a, c, g, or t
  modified_base (528)..(528): a, c, t, g, unknown or other
  misc_feature (528)..(528): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcttgggttttccttgttgtcttaagttttaaaaggtgcccagtgtgaggtgcagctggtggagtcgtgggaggaggcttgactccgacggtcccgggttcggggggttcccctaggacgtaccgttccttccgtggtcgccgacggcccttccggtcgggttcctacccgtcgtacggtccaacctacctaacagtggacgtcgtcgggtccgccgacggtcctacgggacggggagggcgtgggagtcgtcgttctttacgttttagttaagtagttaggtagtacgtaactataccgtccgtacgacgtaccgttccgggngggaccggggtcctacgtaccacctatcctaccgaagtaccgaactacttaaccgaagtaacctcgtntttacgtttctaacaagttacgaaactcggtacctaggacgacggaccgtaagtccggaaccggtaccgggttccgttagtttacgttcgtggtcggacgtaagggacgtacggcccggggtaccctaaacgggttaccgttccgtacgtcgttaggtcgggtaccgtcggggtaccggaaccgggaacggtaacccgg

SEQ ID NO: 183291 - DNA, 653 bp, Homo sapiens
  misc_feature: GYAE6OF01CX4U5.13.76.G10.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcacgcccacctnagtcgtccgtcgtaccccgaggacagacncgccagtcatccacctgctacgagaaaattaagtgacaagattaaatattacttcgtagtactcgagcgaagtacgtcgacggacctacgtcccctgtcgctacgtcacgtactacgtactaagcgtacgaccgaacggtccgtacccgtacggtacggtacctcccgtagacgtacggtacttcgtacgtcgacctacctacgtccgtacggtactacgacgtaccctctacctacgtaccacgtacgacccggacggaccgtagtcgtagtacgagtacggacgtcgttaactacgtacgttacgtggtaaccgtcgggtacggtcggactacggcgtacggtccaccgttccggaccgttacgttagttccggtacggttacgggaaccggttaccggtaaaccgtcggttaacccgttacgtaaccgtacgggtccaaccggaaccccgg

SEQ ID NO: 183292 - DNA, 789 bp, Homo sapiens
  misc_feature: GYAE6OF01DBVMF.13.76.G10.1.454.CMB.1.raw
  modified_base (341)..(341): a, c, t, g, unknown or other
  misc_feature (341)..(341): n is a, c, g, or t
tcagtcacgtactacacgaccggtgctcgatttagtcactcatacagggggggagaggagcccagcactgggattccgaggtgtttccattcggtgaatcagcactgaacacagagactcacagtggtagtttggctgagtcgttcgggtttttccttgttgtacttaagttttaaaacggcgcccagttgtaggaggttcgcaggtcgtagggtggaacgtcggtgggaagggtggtcttgactccgacggtccgggtcggggtccctagacgtacttccgtccgtgtcgcgcgtccttacggtcggttaccaccgtacacgtaccaacctaccttaagngtcgacgtcggtacggcccgaaccgcggccgtaccgggaaggggaggtcggtaggcgtcggtccgtttctttattttaagtttaagtaggttaggtacggttactaacgtacgttaccgtccgaagtccggttaacgttccgggaacgggtccgggtaccgtttacaccgtacttacgtacctaccgaagtacctaaacgtaacttaaccgaaataacccggttcttacgttttaccgttacaaacgttaaacgtcgaaacgtacgtacggtaacgtaacggtcccgtacggtaacgtacccggaccgggtttaacccggtagtttaccgtaactttaagggtccgaaggaacgaagggttaccggacgggtaccccgaaattaacccgtacgttaccaccggtagttacgcgggtacgtccggaaagggtcccgtaacgggaacccg

SEQ ID NO: 183293 - DNA, 747 bp, Homo sapiens
  misc_feature: GYAE6OF01CRW0O.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagagactcaccatggagtttggctgagcttggtttttccttgttgcttattttaaaggtgcccagtgtgaggtgcagctggtggagtcgtgggaggaggcttgacttccgaggtccggttcggggggtccctggtagacctcctcctgtcgccgacgtccttcgttcgggttccaccgtcacgtcaccacctacatgacgtcgtcgggtcccgccgacggcctaccgggaggggaacgggggcgtagggtaggttcggtccgtttccttttacgtttttaagtttaagtaggttaggttaggttaacgtactacttaccgtacccgacgtacggtaccgtccgggtaggaccgggggtcctacttccgaccctatcctacgaagacgtaactaacgttaaccgaaacgtaaccgccttacgtttacgtttaccttaacgaaatacggaaacgtacgtccgtaggacgtaaccgtcggtaacgtacgaccggtaccggtcggttaacgttaacgttacgtggtcggtacggacggaggtacgggtccggggacccgtaaccggttaacggttaccgtacggacgtttaacggtcgggtaaccggttcgggaccggggacccggtaacgggtaccccg

SEQ ID NO: 183294 - DNA, 854 bp, Homo sapiens
  misc_feature: GYAE6OF01CO6OX.13.76.G10.1.454.CMB.1.raw
  modified_base (257)..(257): a, c, t, g, unknown or other
  misc_feature (257)..(257): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (316)..(316): a, c, t, g, unknown or other
  misc_feature (316)..(316): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagtttggctgagctgggttttcctgttgcttatttaaaggcgcccgagtgtgaggtcgcagcgtggtacggagtcgtggaggaggcttagactccgagccggtcggggggtcctgagactctcctgtcncncgtcctcgtcgggtccaccggtntacgtccaccacctacntcggagtcgtcgggccncgacggcctcgggagggacgggctggacgtcgtacgttctttacttttattacgtacggttaggtacggttaagtacctaacgttacccgtccggtaacctacggtaccgttaccgggtacggggtaaccggggggtacccttaactttaacccgaaccccgttaacgttcccgtaaccgtaacggtaacgtaaacccgtaaaccgttaacccgtaaaccggtaaacccgtaaccggttaccgtttaccggttttacccgttaaccgttaaacgttaaccggaaaccgtaacggtacccgtacggtaacggaaccggtaccggtaacgaacggttttttttacccggacccgggtaccggttacggtttaacggttaccggttacggtaacgggtaccgggtaacgggtaccgggtacggtacccggggtaacccggtaacccgggttaaaccggttacccggttaaccgtaccgtacggttaccgggtacccgggtaccgggtaccggggtacccgggtaaccgggtaaaccccggg

SEQ ID NO: 183295 - DNA, 1197 bp, Homo sapiens
  misc_feature: GYAE6OF01AW1NB.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagagactcaccatggtagtttggctgagtcttgggttttccttgttgtacttaagtttttaaaaggtcgtccctagttgtaggaggtgcgagtcgtgggtggtagttcgtgggaggtaggtcgttagacgtacccgacggtcccgggttcgggggggttcccctaggaacggtacccttccgttcccgttggtcgtaccgtaccggttcccgttccggtttaccggggtttcccgtaacccggttaccgtaccggttaccctaaacccctaacccttaaaccgcgtttacgggaccggtcccggggttaccgggggtacccccggacccgggtaaccggggggtccccgggggttaaccccggggggggaacggggggttccgggttacgggggttaacgggtttccggttcccgggtttttaacccttttttaaccgtttttttaagtttttaaacgggtttaacgggtttaaggtttacggggtttaaaccggtttaaaccgttaaccgttaaccccggttacccggtaaacccggtaaaccggttaccccgggttacccggggtacgggggttaacccgggggggtaccccgtttaacccgtttaaccccgaaaccccgtttaccccgttaacccgttaaccccggtaaacgggaaaacccggtttaaaccccgttaaaaaccggtttaaaccccgttaaaaacccggtaaaccccggtaaccggtttacccgtttttacgttttaaaccccgtttaaaccttaaaaacggttaaccccgtaaaccggtaacccgggttaccccgttaaaggggaaacccgggtaacccggttaccccggtaaacgtttaacccgggaaaccccgggtttaaaccccggggtttacccgggttttaaacggtttacccggtttaaaccggggtttacgggtaacccgggttaacgggtaaaacgggggttaacccgggttaaccgggggttaaaccccggggggtaaaccccccttaaaccccggggtttaaaaaccccgggttaaaaccccttaccggggtttaacccgtttaaccgggggttaaacccc

SEQ ID NO: 183296 - DNA, 665 bp, Homo sapiens
  misc_feature: GYAE6OF01C2EIC.13.76.G10.1.454.CMB.1.raw
  modified_base (161)..(161): a, c, t, g, unknown or other
  misc_feature (161)..(161): n is a, c, g, or t
  modified_base (175)..(175): a, c, t, g, unknown or other
  misc_feature (175)..(175): n is a, c, g, or t
  modified_base (211)..(211): a, c, t, g, unknown or other
  misc_feature (211)..(211): n is a, c, g, or t
  modified_base (283)..(283): a, c, t, g, unknown or other
  misc_feature (283)..(283): n is a, c, g, or t
  modified_base (399)..(399): a, c, t, g, unknown or other
  misc_feature (399)..(399): n is a, c, g, or t
  modified_base (440)..(440): a, c, t, g, unknown or other
  misc_feature (440)..(440): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacgaggactccgtggcctctatgacgctgacncacgccctaccctnacgtcgtccgtacgtcccgaggacacgacagcacgnactccaccgtgcctagtaaggaaattaagttggaactaaagaattaaactacttaccttcgtaggtacctanacgtacgaaggaactcgaacgaccgtaccgtacccgtggtgtaccgtggtacctattacgtaacgaccgtaagactaccggactaacggcccggtacctacggaacgtcctaccgngacgtccgtattcgtaagccgtactaccagtcgacggactnacgacctacgtcgacactacgacggaccgaccgggaacctggtacctagacgggagtaccgagttaccgaatacccgttagtccgtagacggtacggtccgggagaccaggcacctcgtaacccgccggaccttagttaccggtaggttcccgggacggttaaacggaccgggtaacccttacggacccttaacccgagttaacccggcgacccgggtaaacccc

SEQ ID NO: 183297 - DNA, 845 bp, Homo sapiens
  misc_feature: GYAE6OF01C4U01.13.76.G10.1.454.CMB.1.raw
  modified_base (85)..(85): a, c, t, g, unknown or other
  misc_feature (85)..(85): n is a, c, g, or t
tcagtcacgtactacacgaccggtgctcgatttagtcactcatacaggggctgggagaggagcccagcactgggattccgaggtntttccattcggtgatcagcactgaacacagaggactcaccatggtagttttggctgagtcgttgggttttccttgtttgtcttaagtttttaaaaggtcgcccgtagtggtgaggtgacagtcgttgggtggagttcgtgggaggacggtcttagactccgaggtccggtcgggggtcctgacgtctctccgtgtcgcacgtccgtcgtcggtccaccgtcgtacgttaccaacctaacctaactagtagacgtccggtccgggtacccgcgtaacggtccgtacgggaaggggtacgggcgtagggtacgtcgtcgttctttacgttttaagtttacgtaggttacgttggttaacgtacgtaacttacgtcccgtaacgtacgtaccgttacgggtagggacgggtccgtatttacccgaacctacgttcccgaaccgaaaggtaacgtaaccttaaacgtaaaccccgaaaagtacccgttaacgttcttttttaccgttaacctaaaataaacgtcgaaacccgtcgttaccccggtaaggaccggtaaccgtaaccggttacgacggtaaccccgggttacgggtacccgtttaaggtttaccttaacggtaggttcccggaaggggtttaacgtaacggggtcccggggtaaccccgggtaaaccccttaaaacggttacccgtttaaccgtacggtactttacggggaacccgggttaacccggttcgggggcccgggttaaaaacccccggg

SEQ ID NO: 183298 - DNA, 796 bp, Homo sapiens
  misc_feature: GYAE6OF01AZCQ1.13.76.G10.1.454.CMB.1.raw
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaattttaaaaggtcgcccagtgtgaggtgcagcgtggtggagtcgtgggaggaggcttgactccgaggccggttcggggggtcccctggacgtacctccgtccgtcgtcgcacgcctcgttcgggttccaccgtcacgtcaccacctanatgagcgtcgggtccgccacggtccgtcggaggggacgggcgttggngtcgtcgttctttacttttatttagtaggttaggttacggtagtaactactaccgtccgacgtaacgtaccgtccggtacggggtaacggggtcccgtacgttacccgtaacctacttacccgtaacccgaaggaaaccttaaaccttaaccgttaacccgaaaacgtaaacccgttaccgttacctttacggttttaaccctaaacgtaaaagtcggaaaaccctccggtacccgtagggaaccggaccgtacccggaagttacccgggaacccgtcccggggttaccttaaggttttaccttaacgtcgggtaacggacgtaaagggtcggtaaccggtaccccggggaccctaaagggttaaccccgttaacgttacgtccgttaggtaacccggggtcgtaacccggggccggggaaaccgaacggggtccccg

SEQ ID NO: 183299 - DNA, 805 bp, Homo sapiens
  misc_feature: GYAE6OF01BWQ3O.13.76.G10.1.454.CMB.1.raw
  modified_base (55)..(55): a, c, t, g, unknown or other
  misc_feature (55)..(55): n is a, c, g, or t
  modified_base (171)..(171): a, c, t, g, unknown or other
  misc_feature (171)..(171): n is a, c, g, or t
tcagtcacgtactacacgaccggtgctcgatttagtcactcatacaggggggaancctgggaacacttagccttcatgagtgtccccaccatggcctggatgatgcttctcctcggactccttgcttatggatcaggagtggattctcagactggtggtcgacccaggacnccattccgttctcagtgtcctccgtgggacggacagtcactacctcgactttggtggtcttggacgtactacggctacaggttccttactaggttacgttaccctacccagtccgtacggtaaccaaccgacgaccccaggccgacgcctccgcgcacgtctcacgtctacaacaacaaccactcgtctcgttcgtcgggtccctctacgttcgtcttctcgtcgtcctcctacgtaccgtttacgggaaacctaaagtccgttaccgtaccctttacgtccgtaaccgttccgggaacccgggggtacccgacgggtacgaaacggaaacgtagttacggtaactccgttaagttacgtttaactttacgtttcgttttacgttttaccgttttaagttacggtttagggttaacgtttacggtaccgtttacgtttttcgttccgttacggtttcgggttacgggttaccggggtacggggtaccgggtaccccggtaccccgggggttacccgttacccgggttaccccggtttccccggtttaccccgggtacccggtaaccccgggttaccccggtaacccggggttacccgttcccccggtaaccccgttaccgggttacccccgggg

SEQ ID NO: 183300 - DNA, 769 bp, Homo sapiens
  misc_feature: GYAE6OF01CZBZG.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagaggactcaccatggtagttttggctgagcgttgggttttccttgttgcttaattttaaaaggtgcccagtgtgaggtgcgagcgtggtggaggtcgtggaggaggctgactccaggccggtcgggggtcctggacgtacctctccgtgcgcgacgtcctcgtcgggttccaccgtcacgtcaacctactacagtacgacgtcgtaccgggtccgaccgacgggcctaacccggagggggaacgggtcgtaggtaggtcgtcgttagttttacttttaagttagtaaggtaggtaggttaactatacgtacctcgacacgtaccgtccggagggtaccgggacctacttccaactcgtacctccgaaagtaacctaacgtaacttaaccggaaaactaaccgtacgtttaccgttacgttttaacctaacgtaaaagtacgtaaaccgcgtacccgtaagacggtaaccgtacggtaacgtaacggtaaccgccgggttaaccgttaggtttaacttaacggttcgggtacgtaaaggggaacgtacgggtaaccggtacggggaaacccctaaaccgggtttaacgtaacccggtacggttaactacgggtacggtaaccggtgggtaaccgggaaccggaaacggtaaccccgg

SEQ ID NO: 183301 - DNA, 750 bp, Homo sapiens
  misc_feature: GYAE6OF01ELZMO.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtcgtccccaggacagacacgccagcactcacctgctactaggaaataagtggacagtaataaatactacttcgtagtactcagacagagtcgaggcctacgtcccctggtcgtcgtcggtactacgttcctataccgaagtacgtcgaccgacggtcccggtaccctcggaacggtctacccgtagacgtacgtacttccgtcgtaccggtccttacctaaaccgttcggtacggtaaacctccaccggtaccctaccgttaccgtacccgaacctacgttaccggacgggacccgggaaccccgtagggtacccttagggtacggtagtacggtacggttacgttacgtaaccgtttaacgttccggtacggtaaccggtcgggtaccgggttagggaaccgtaccggacgacgtacccgtaccggtcccgacccgttacgtttaaacggttccggtttacccgggttaaacgggtaacccgggttacccgggtaaacccggtaacccgggttacccttaaccccgggttaccgtaaacgggttccccgaaacccgggtaaaccccccgg

SEQ ID NO: 183302 - DNA, 785 bp, Homo sapiens
  misc_feature: GYAE6OF01C4OO2.13.76.G10.1.454.CMB.1.raw
  modified_base (127)..(127): a, c, t, g, unknown or other
  misc_feature (127)..(127): n is a, c, g, or t
  modified_base (201)..(201): a, c, t, g, unknown or other
  misc_feature (201)..(201): n is a, c, g, or t
  modified_base (387)..(387): a, c, t, g, unknown or other
  misc_feature (387)..(387): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttacngcacgaggactccgtggcctctatgacgctagacctcacgcccaccctgagtcgtccgtcgcccaggacagacncgccagcactccactcgacttacgtaaggtaaacttaagttggaacaagtaattaaattcttaccttccgtagttactacgaacgtacgaagaacgtcgacggtaccctacgtccccgtgacgtcgttggtactacgttactagtaacgaaggtctacggaacccgtacggtcccgaccgtacggnggttaccctccgtaggacgtcgttacttccgtacggtcgtaccttaacccgtacgttccgggtacggaaccttccgaccgtacccgttacgtaccgtaaccgtacccgtaacgtaacccgggacccgggttaacccgggaaccgttagggtaccttacggggtagggtaaccggtagggtaccgttaccgttaacggtttaccgttaacggttaccgggttacggtacggggtaccgggtcgggttaacgggaaccacgggtacgaccgtaaccgtccggtacccggacctttaggtaccgtttaccgggtacccggttaacgggaacggtacccggggtaaacctaccgggttaacctaccccggttaagtacccgaccgtaccccggaaaccccgg

SEQ ID NO: 183303 - DNA, 856 bp, Homo sapiens
  misc_feature: GYAE6OF01BH08Y.13.76.G10.1.454.CMB.1.raw
tcagtcacgtactacacgaccggtgctcgatttagtcactcatacgagggggggagaggagcccagcacgtgggattccgaggttgtttccattcggtgatcagcactgaacacagagactcaccagtggtagttttggctgagtcgtttgggtttttccttggtttgtactttaagtttttaaaaggtcgcccgtagttgtggtaggtcgcgaggtcgtgggtgggtagtcggttgggagggtcggtcttacggaactcccggtacgggtcccgggttcgggggtcccctaggtaccgtaccttccgttccgtggtcgcgtacgtcccgttcggttccggttaccgtaccgtacgtaccgtacccaacccgtaacctacgtagtcggtacgtccgggttccgggtacccgtccggtaaccgggtccgtaccggggaagggggtacgggtcggtagggtcggttcgtcggtttacttttacgttttaagttagttaggttaggttacgtagtactacttaccgcgtacgacgttccgtacggtcggaccggtacctacgtacctaacctctaccgacgaacgtacgtaaccgtaaaccgttaaccgaaagtaacccttaccggttcttttaacgtttacctaacgtaaaccgtcgaaaccgtaccgtcgtaacggacggacccttcggaaccgttaacgaccccgggttccggtacttttacggttacgtaaccggttgaccggaaggtagaccgggtaacccgggttacgggaccccttaaaggggttacccttacggacgttagtaacgggtccgtaacgggtcccgggaaacgggccgtaacccggtacccgg

SEQ ID NO: 183304 - DNA, 660 bp, Homo sapiens
  misc_feature: GYAE6OF01CJKXB.13.76.G10.1.454.CMB.1.raw
  modified_base (247)..(247): a, c, t, g, unknown or other
  misc_feature (247)..(247): n is a, c, g, or t
  modified_base (452)..(452): a, c, t, g, unknown or other
  misc_feature (452)..(452): n is a, c, g, or t
  modified_base (543)..(543): a, c, t, g, unknown or other
  misc_feature (543)..(543): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctcctatgagctgacctcacgccacctcagtcgtcccgtcgacccaggacagacagccagccatccacctgctacgtaggaaataagtggacaagaataaatntacttcgtaggtatcagcaaggaacgtcgaaggccctaacggtcccctggtcgcctggtacctactacctagtaccgaaaggactcgaaccgaacgggtcccggccgttacggacgggtacctcccggagaacggtcgtacttccgtcgtaacggtcctacctaacgttcggtaacggtaccacgccgacctacgcgtacaccgngaccgacggaccgaaccgtggacttacggagggtatacgggactacgtaactacttacgttaccagggaccgttagggcggtaacggaacncggacgacgtaaccgcgttcccgggcctgttacgtcgtaccggttagggaacccggtacgggaacccttacgggtaccccgtaactaacccgttaggaccgtaaccgaaacccccgg

SEQ ID NO: 183305 - DNA, 909 bp, Homo sapiens
  misc_feature: GYAE6OF01DE2N7.13.76.G10.1.454.CMB.1.raw
  modified_base (307)..(307): a, c, t, g, unknown or other
  misc_feature (307)..(307): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgactccgagccggtcggggggtccctggacgaccttctcctgtcgcacgccttcgtcgggttccaccggtacacggtccaccgtaaccttanagtcgacggtcgtcgggtccgaccgaggtcctaccgggaggggacgggctagggcgttcggtccgttacttttacgttttaatttacggtaaggtttaggttacggttaacttacgtaacgttacccgtaccggtacgtaacggtaacccggttccgggtaggggtaaaccggggggcccttaaacgtttccccgaaacccgtacttaccccgtaccgaaacgggtaacgtaaacccttaaaccgttaacccgtaaaaaccggtaaacccgtaccggttaaccttttacgggttttaacctttaaccgtaaaacgttaaccggaaaccgtaccgtacccttagggaacgtaccgtaaccggaattacgggaaacccgtacccggggtaccgtttagggtttaaactttacccgggtaggttacgggaccggttaagggaaaccgggttacggggttaaccccggggggaaacccccttaaaaccgggttaaaacccggtttaacccggtaacccgggtacgtttaacggggttaccgggggttaaccggttccccgggggttacggggggaaaaccccgggttaccggggtaaaacccccgg

SEQ ID NO: 183306 - DNA, 749 bp, Homo sapiens
  misc_feature: GYAE6OF01C2BX9.13.76.G10.1.454.CMB.1.raw
  modified_base (189)..(189): a, c, t, g, unknown or other
  misc_feature (189)..(189): n is a, c, g, or t
  modified_base (205)..(205): a, c, t, g, unknown or other
  misc_feature (205)..(205): n is a, c, g, or t
  modified_base (331)..(331): a, c, t, g, unknown or other
  misc_feature (331)..(331): n is a, c, g, or t
  modified_base (344)..(344): a, c, t, g, unknown or other
  misc_feature (344)..(344): n is a, c, g, or t
  modified_base (355)..(355): a, c, t, g, unknown or other
  misc_feature (355)..(355): n is a, c, g, or t
  modified_base (507)..(507): a, c, t, g, unknown or other
  misc_feature (507)..(507): n is a, c, g, or t
tcagtcacgtactacacgaccggtgctcgatttagtcactcatacagggggggagaggacgcccagcactgggattccgaggtgtttccattcggtgatcagcactgaacacagagactcacatggagttttggctgagtcttggttttccttgttgacttaagttttaaaggtcgccagtgtgaggtncagctggtggagtcgnggaggaggtcttgactccgaggtccggtcggggtccctagacgaccttctccgtgtgacgacgtccttcggtcggtacaccgtgacgtcaacctacctacagtcgacggcgttacgggcccacggngtaccgtacgggnggggtaacggntaggatcgtccgtttttacttttatagtacggtagtcgtaactcgtactcgtaccgacgtacgtaaccgtcggtagggaaccgggtccttaacttaccgacctacgtccgtagacgtaaccgaacctaataaccgaacgtaaccgtccggtnttttaccttaacgataaacgacgtaaccggttacacgaacggtacgtaccgtagtaaccggacgtcgggttaccttagttacgttacctggggtaacgacggaacggttaacgggtcccgttaacccggggaaacccggttaccgttaaaccggtttacggaaccccggttacgttagggtaccgggttaacccggttccgggggaaaccgggtaaacccggttaaccccgggtaacccggg

SEQ ID NO: 183307 - DNA, 781 bp, Homo sapiens
  misc_feature: GYAE6OF01CKOLX.13.76.G10.1.454.CMB.1.raw
  modified_base (170)..(170): a, c, t, g, unknown or other
  misc_feature (170)..(170): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatccacctgctacgtaaggtaaaattaagttcgggacaagtaaattaaaacgttaacttaaccgtttcccgttagggttaaactacgaacggtaaccgtaaaggtaaagttaccgaacggaccccgtaccggttcccccgtgtcggtaccgtttaggtacctaaacttctaaacgttacaaaggtactacggacccgtaaacggccggtcccctacggaacgggtacctcccgtagacggtaccttaacgtttccgtcgtacggtaccctaaccgtaacgtttccgggtaacggggtaaccctacgtaaccgacccgttaacgttaccgtaacccggtaaccctaacgtcccggaaaccggggtaccccgggaaccgaacgggtacttacggtagggaagtttacgggacgtcttaggtaacccttaagtttccgtacgtacgggacgggttacgggtacgagacggtacaaggccacgtaccggcctacgttagttaccggttcggttaaccgaacgggtccgtaaaccgtacggtcccaaacccgttacgacgacctaacccggaccggtaaaccccg

SEQ ID NO: 183308 - DNA, 936 bp, Homo sapiens
  misc_feature: GYAE6OF01D6CDH.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgcttattttaaaaggtgcccagtgtgaggtgcagctgggtggagtcgtgggaggaggtcttggactccgacggtccggttcgggggggtcccctggacgtaccttccgtccgttggtcgaccgtacgtcccgtttccgttcggggtttacccacccggttaccgaacggtaccctaaccctaacccttaacagttacggacggtccggttccggggtccccggacccggacgggtcccggtacccgggaaggggggaacgggggtccgtaggggtaggttcggtccgtttcgttttacgttttttaagttttaagttaagggtttaggtttacgggtttaaacgttaaccgtaacgtttacccgttacccggacgtacggtaccggttacccgggtaggggaccgggggtacccgtaacgtttacccacccgttaacttcccgtaaccgaaggtaacccgtaaacccttaaacgttaaccccgaaaaaggtacccgttaaccggtttcccgtttacgttttttaaccgtaacctaaaaaggtttcccgaaacgtaccggttacccggtaaggaacggtaacccgggacgtaacgtacggaaccggtcccggttacggtttattacgtttacgtacgggtcgaacgggtacggtacggtaaccggggttccccgggaaaccccgtaacgggtttaaacccgtttaccggaacccggttgtaacggggttaccgggtaccgttacggggcccgggggaaacccgtaaaccggggtaccccg

SEQ ID NO: 183309 - DNA, 836 bp, Homo sapiens
  misc_feature: GYAE6OF01AMWXU.13.76.G10.1.454.CMB.1.raw
  modified_base (282)..(282): a, c, t, g, unknown or other
  misc_feature (282)..(282): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgactctcctgtgcagcctcgtcgggtcaccgtcagtcacacctacntgagcgtcgggtcccgccgaggtccgtaccggaggggtaacggggtcgtgggacgttcggtccgttcttttaccgttttttaagttttaagttaagggtttaacggttagggttaaacgttaaccgtaacgtttaacccgtcccggacgtaacggtaacccgttcccgggtacgggtaaccggggggtccctaactttacccgaaccctacgttccctacccgaaggaacgtaaaccttaaaccgttacccgaaaacgtaaacctaccggttcctttacggtttttaccctaactaaaagttacgaaaccctacggtaccccttaagggacggtaaccggtacccgtaagtaccgggaacccgtaccgggtcccggttaagtttaactttacggtacggttacggacggtaacggtaacgggtaccggttacccgggggtaaccccctaacgggttaaaccccgtttaccgtaaccggttaccgttaacggttacccggggtacccggttacggggtacccgggggtaaccccgtaaaccggggtaacccccgg

SEQ ID NO: 183310 - DNA, 702 bp, Homo sapiens
  misc_feature: GYAE6OF01DQTOI.13.76.G10.1.454.CMB.1.raw
  modified_base (173)..(173): a, c, t, g, unknown or other
  misc_feature (173)..(173): n is a, c, g, or t
  modified_base (464)..(464): a, c, t, g, unknown or other
  misc_feature (464)..(464): n is a, c, g, or t
  modified_base (582)..(582): a, c, t, g, unknown or other
  misc_feature (582)..(582): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacgagactccgtgcctcctatgacgctgactcacgcccacccgtnacgtcgtccgtcgtccccaggacagcagccagcactccacctgcttacgtaggaaattagttcggacaagtaattaatactttaccgttaccgtaggttactacagactaaaggtacgacaccggaccttacccggtccccttaggtcgtccgttggtacctagttcgtaagtaccaaacggtctaccgtacccacgggttcccgaccgtacggaacggtcctcccggtaaggacttcgttactttccgtcggtaccgtaccctaaccgtacggttcgtaaccggttaacnccgaccgttaccaccgttgacccaaccttcgaacccggtaccgggtacccggaacgtgttacgtagacggtacgaccgtcgtaccgtttacaaccgtttagtttcgcgggttaccggngggttaccgaaggtccacgaccgtcaacgttaccgcgtaccgttacgacgttcgttaccggtacggtacgacccggtacgaccgtttccaacggtttccacggtcccgtaccgacccccg

SEQ ID NO: 183311 - DNA, 615 bp, Homo sapiens
  misc_feature: GYAE6OF01D3DVS.13.76.G10.1.454.CMB.1.raw
  modified_base (162)..(162): a, c, t, g, unknown or other
  misc_feature (162)..(162): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (457)..(457): a, c, t, g, unknown or other
  misc_feature (457)..(457): n is a, c, g, or t
  modified_base (473)..(473): a, c, t, g, unknown or other
  misc_feature (473)..(473): n is a, c, g, or t
  modified_base (475)..(475): a, c, t, g, unknown or other
  misc_feature (475)..(475): n is a, c, g, or t
  modified_base (525)..(525): a, c, t, g, unknown or other
  misc_feature (525)..(525): n is a, c, g, or t
  modified_base (533)..(533): a, c, t, g, unknown or other
  misc_feature (533)..(533): n is a, c, g, or t
  modified_base (552)..(552): a, c, t, g, unknown or other
  misc_feature (552)..(552): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttacgtgcacaggatccgtggccttcctagtgagctgacncacgcccacctcagtcgtcccgtcgtaccccaggacagaccaggcccaagtcaatccgaccctgactcgtaaggaaaattaacgtggactagaataacgtattaccttcgtgtatcgagacagaacgtnaacggtcacgtcccngtcgctggtctactctanacgaatctacgacacgccgtccctagaggtacctccgngtcgacgtcttcncgttacgccctacgtactcggtaacggacttcgacctacctccctacgtaccaacgcgtaacggcccgaccgggttaacccnggtatacgagtaccgngnggtccctaggttaccttagtacgtcgtagggtcgggtacggtgggaaccngggttacncgccaccgttccgaccctntttcggcgttacgtcgacgtcggtaacaccgggttccaacgtactacgtccgaacgtcccccg

SEQ ID NO: 183312 - DNA, 937 bp, Homo sapiens
  misc_feature: GYAE6OF01BZBK3.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttttggctgagtcgtttgggtttttccgtttgttgtacttaagtttttaaaaggtcgacccgtagtgtggaggtgcagcgtggtggtagtcgtggaggaggtcgttgacttccgacggtccgggtcgggggttccctaggtacgtaccttcctccgttcggtcgtcgaccgtccgttcggttcgggttcccgtaccgttcacgtccaacccgtaacctaactagtacggacggtccggtccgggtccccggccgaccgggtccggtaccgggaagggggtagggtcggtacgggtaggttccggtcgttttaccgttttatttttaacgtttaaggttaagggttaggttaaggttaacgtactacgttaccgtaccggtaccgtaaccggtaccgttaccgggtaggggtaccggggtacctttaacgtacccgtaaccgtaacgttacccgttaacgaacggttaaaccgaaacctttaaaccgttaacccgaaaaacggtaaccttaccggttacgtttttaaccgttttaaccttaaaccgtaaagtacccggttaaaccgtaaccggtacggtaaggaccggtaaccgtaacggtaagtaccggaaccgggttacccggtttaccgttaagtttaacgttacgggtgtaccgggaaggtaccgggtacggtacccgggtcccggggtaaacccttaaccgggtttaaacgtttccccggaacgtttaaccgacggggtttaaaccgggtacccgttaaaggggggtaccccggaaaaacccggggtccggggtaaacccccg

SEQ ID NO: 183313 - DNA, 794 bp, Homo sapiens
  misc_feature: GYAE6OF01BAY6I.13.76.G10.1.454.CMB.1.raw
  modified_base (465)..(465): a, c, t, g, unknown or other
  misc_feature (465)..(465): n is a, c, g, or t
tcagtcacgtactacacgaccggtgctcgatttagtcactcatacagggggggagaagagcccagcactgggattccgaggtgtttccattcggtgatcagcactgaacacagaggactcaccatggagttttggctgagctgggttttccttgttgcttattttaaaggtgcccagtgtgaggtgcagcgtggtggtaggtcgtgggagggaggcttggactccgaggtccgttgggggggttcccctggacgtaccttcctccgtggtcgcgacggccttcgtcggggttcctacccggtcagtccaacctaccctaacatggagcgttcgggtcccgccgaggccgtacggaaggggaacggggcgtgggtaggttcgtcgttcgtttcgtttttaatttagtaaggttaggttaggttagtaactacgtaacctcccggaccgtacggtaccgttccgggnggaaccggggaccttagttcccaccctacgttccctaccgaggaacgaacctaacttacccgaaaagacccgtaacgttcttacggttttactaacgtaaactaagaaccgtacgtccgtaggaacggacgtacgaactacgggtacccgtaccggtccgggttacgtttaacgttacgtacggttacggacgggtaaggaacggacggggttacccggggaacccgttaacccgggttaacccggttaaccgtaacccggtacgttaaccggttaccggggtaccgtcgggggtaccggggtaacccgggaacggggtaacccccggg

SEQ ID NO: 183314 - DNA, 589 bp, Homo sapiens
  misc_feature: GYAE6OF01AIVNM.13.76.G10.1.454.CMB.1.raw
  modified_base (408)..(408): a, c, t, g, unknown or other
  misc_feature (408)..(408): n is a, c, g, or t
  modified_base (471)..(471): a, c, t, g, unknown or other
  misc_feature (471)..(471): n is a, c, g, or t
  modified_base (504)..(504): a, c, t, g, unknown or other
  misc_feature (504)..(504): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggtcaccgtcagtcacacctacatgacgtcgtggtcccgcgaggctccggagggaacggggcgtggagtgccgttcttcttttatttatagtagtggtagtacactctccgcagctcgtggacgggcgtactcaccgtactctaccganacgacaacttacaaagtacacgtcttagttcttacaatcgaacacgtcgagacggacgccgancgacgaccggtcgttagtacttacggtgtacgnggtaacgaggtaggtccggggaaccctaaggtaaccgttacgtacgcgttagacgggtaccgtcgggtgggccccgtaaacgggg

SEQ ID NO: 183315 - DNA, 763 bp, Homo sapiens
  misc_feature: GYAE6OF01B1JF5.13.76.G10.1.454.CMB.1.raw
  modified_base (261)..(261): a, c, t, g, unknown or other
  misc_feature (261)..(261): n is a, c, g, or t
tcagtcacgtactacacgaccggtgctcgatttagtcactcatacagggggggagaggagcccagcactgggattccggaggtgtttccattcggtgatcagcactgaacacagaggactcaccatggagttttggctgagctgggttttccttgttgtctaattttaaaggtgcccagtgtgaggtgcagctggtggagtcgtgggaggaggcttgactccgagtccggtcggggggtccctgacgactctcctgtcgcncgtcctcgtggttccaccgttcacggtccaccacctacatcggagtccggtcgggccgtaccgacggccgtaccggaagggggaacggggcgtagggacggtggtccgtttctttacgtttttaatttagttacgttagggttacggtaacggttacgtaacttacccgtccgtaccgtaacgtacccggttccgggtacgggacggggtacccgtaccgtttaccgaacccgttatcccggttaaccgacggtaacgtaaacctaaccgtttaccgaaaacgaaccgtaaccggttccttaagttttaccctaagtaaaacgtacgaacgtaaccgtcggtaagacgggacgtacccggaagtcggaacccgtccggggtacttggtacgttacgtgaccggtaggagaggtaccggtccgggaccctaaggtaaccggttccaacgtccgtttaggacccgggttcggtccgggtacggggacccgtaagggtaccccgg

SEQ ID NO: 183316 - DNA, 633 bp, Homo sapiens
  misc_feature: GYAE6OF01APVC9.13.76.G10.1.454.CMB.1.raw
  modified_base (217)..(217): a, c, t, g, unknown or other
  misc_feature (217)..(217): n is a, c, g, or t
  modified_base (504)..(504): a, c, t, g, unknown or other
  misc_feature (504)..(504): n is a, c, g, or t
  modified_base (528)..(528): a, c, t, g, unknown or other
  misc_feature (528)..(528): n is a, c, g, or t
  modified_base (536)..(536): a, c, t, g, unknown or other
  misc_feature (536)..(536): n is a, c, g, or t
  modified_base (562)..(562): a, c, t, g, unknown or other
  misc_feature (562)..(562): n is a, c, g, or t
  modified_base (567)..(567): a, c, t, g, unknown or other
  misc_feature (567)..(567): n is a, c, g, or t
  modified_base (573)..(573): a, c, t, g, unknown or other
  misc_feature (573)..(573): n is a, c, g, or t
  modified_base (577)..(577): a, c, t, g, unknown or other
  misc_feature (577)..(577): n is a, c, g, or t
tcagtcacgtactacacgaccggtgctcgatttagtcactcatacagggggggagaggacgcccagcactgggattccgaggtgtttccattcggtgatcagcactgaacacagaggactcaccatggtagttttggctgagcgttgggttttccttgttgcttaagttttaaaaggtgacccagtgtgaggtgcagcgtggtggagtcgtggaggnggcgttgatccgagccggtggggtccctgacgtactcctcctgtgccacgtccgtcgttcgggtccaccgtcacgtccaaccaccgtacagtggagtcggtcggtaccccgcgcggtccgtccggagggggacgggtcggtgggacgtcggccgtttactttacttttaatttagtaggttaggttacggtagtaactacgttaccgccgtcaacgtcggttccggagggtacgggtccctagttacccgacctattccgaccgaatacgaactactacgaataccncgtcttgtttacacaaagcgaacncgtacagngacgcgatcgaacgtcgtcgtaagtnttcgngtacgngganacgtgaccggcctagttcgagtgctaggtcgaccggtggaccgggtcgaggtcccg

SEQ ID NO: 183317 - DNA, 920 bp, Homo sapiens
  misc_feature: GYAE6OF01AGC9A.13.76.G10.1.454.CMB.1.raw
tcagtcacgtactacacgaccggtgctcgatttagtcactcatacagggggggaggaggagcccagcactgggattccgaggtgtttccattcggtgatcagcactgaacacagaggactcaccatggagtttggctgagcttgggttttccttgttgcttagttttaaaggtgcccagtgtgaggtgcgagtcgtgggtggaggtcgtgggagggtaggtcttgacttccgaggtcccggtcggggggttcccctggaccgtaccgtccgtcctggtcgaccgtacgtcccttcgttacgggttcctacccgtcgacggttccaacccgtaacctaacgtacgttacggacggtccggttcggggtacccccgaccggtaacgggtcccggttaccggaaggggggtaaccgggtccgggtggggtaacggtcggtccgtttaccgtttaccgtttttaagtttacgttaggttaggttaggttaacgtactaagttaccctccggaactacggtaccggtttccggaggggtacggggtaacccttacgttacccaaccgttacgtaccgtaacccgtaacggaaccgtaaaccttaaaccttaacccggaaaacggtaaaccccgtaaccgttaccggttttacgttttaaacccgtaaccgttaaaacgtaaccggtaaaccgtaaccggttaacccgtacgggttaacggaaccggtaacccggttaacgtaacccggtacggtaacccgggttaccggtttaaacggtttaacttaccgggtacggttacccgggtaagtaccgggtaacgggtaccggtacccgggggtaaccctaacggggttaacccgttaacggtaccgtacgtacggtacggtaccgggtacggtaccggtacgggaccgggtaacccg

SEQ ID NO: 183318 - DNA, 676 bp, Homo sapiens
  misc_feature: GYAE6OF01AGUFL.13.76.G10.1.454.CMB.1.raw
  modified_base (173)..(173): a, c, t, g, unknown or other
  misc_feature (173)..(173): n is a, c, g, or t
  modified_base (606)..(606): a, c, t, g, unknown or other
  misc_feature (606)..(606): n is a, c, g, or t
tcagtcacgtactacacgaccggtgctcgatttagtcactcatacaggggctgggcctcaggaagcagcatcggaggtggcctcagccatggcagtggatccctctcttcctcggcgtccttgcttactgcacaggtactccgtgcctctatgagctgactcagcccaccctnagtcgtccgtgtccccgaggacagacacgccagcatcgacctgctcgtaggaaataacgtggactaagtaattaaaattacttaccttaccgtagggttactacgacgtacgaagaagtccgacggtacctacgtcccctggtccgcgtcggtctactaccgtataccgtaagactacggaccgaacggtcccggacccttacggaacgggtacctaccccgtggaacgtcgttacgttccgtacgtcgtacctaccgtaacgtcggtacggtacctcgaccgtaccgtactacgtaccgaccgtaacgtaccggtaccggtacccgggtaacccgtacgggtaactacggtacgggtaacgtacgacggtacgtacgtacgttacgttacgtcgtacgtagggtcgtacggacgtacgcgtacgactcgccnccgtcgtagtcgttacgtacggacgtaccggaacgtacgtccgaccgtactaacggccgaccgtaacccg

SEQ ID NO: 183319 - DNA, 801 bp, Homo sapiens
  misc_feature: GYAE6OF01E0KIK.13.76.G10.1.454.CMB.1.raw
tcagtcacgtactacacgaccggtgctcgatttagtcactcatacagggagaggacgcccagcactgggattccgaggtgtttccagttcggtgatcagcactgaacacagaggactcacccatggagttttggctgagcgttgggttttccttgttgcttattttaaaaggtgcccagtgtgaggtgcagctggtggagtcgtggaggagcgttgagtccaggtccgttcgggggttccctaggacgtaccgttccttccgtcggtgccgacgtccgttcggttcgggttccacccgtcgtaacgtccgaaccaccctacataggacgtcggttcgggtccccggccgaacggtccgtaccggtaaggggggacggggtccggtgggtacggtcggtccggtttactttaacgtttttatttaagttaggttacggttacgttacgtactaccttaccgtcccgactacggccgtccgggtggaccggggtaccgtcttacccgacctactccctaccgtaaaggactaacctaaccgttaaccaaacggtaacccctacggttccgttacgttttacctaacgtaaacgtacgaacgtactccgtaggaacgccgacgtgaaccggcccgacgggtcgtttacgtagttaccgtcggacgcggaagtacgggtaccgttaccggggaaccccgttaaagggtacccggtttaaacctaacccggtcccggtttaaacgtcccgggttaccgggtaacccgggttacccgggggaaaccccgtacgggggtaaccccccg

SEQ ID NO: 183320 - DNA, 821 bp, Homo sapiens
  misc_feature: GYAE6OF01C03DW.13.76.G10.1.454.CMB.1.raw
tcagtcacgtactacacgaccggtgctcgatttagtcactcatacaggggtctgggagaggagcccagcactgggattccggaggtgtttccagttcggtgatcagcactagaacacagaggactcaccagtggtagttttggctggagtcgttgggtttttccttgtttgtactttaaagtttttaaaaggtcgtacccgtaggttggtaggtagggtcgcgaggtcgttagggtgggtaggttcggtagggaacgggtaggttcgttacgtacgtacccgacggtcccggttccggggggtacctaggacgtacctccgttcgtcgtcgaccgtaccgtccgttcggtttccggtaccctaccggtaccacgttacccaacctacctatagtacgaccgtacggttccggccgaccgacggccgacgggtaggggaggtcgaggtcgtgtcgttattcgttttaagtttacggtagtacggttagtacgtactaccgtacgtccgactacggtacgtccggagggtacggtactactaccgactacgtaccgacgaggaactaactaacgtaaaccgaactaacggttacttacgttacgtttacaaacgtaaagacccgtaagacccggtacaagggacccgaagtaccgaacgttacgggacccgtaccgggtttagttaaccgttgttaaaccgtggaaccggtacggtacggacggtaccccgggtaccggttaaaccccgaaagggttaacccgttactaccggttcgtaaacgggttagtaccccgggttagggaaccccggggtaaaccggg

SEQ ID NO: 183321 - DNA, 700 bp, Homo sapiens
  misc_feature: GYAE6OF01A7LVL.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatcgagccgtgggggtccctgacgactctcctgtgcacgcctcgtgggttccaccggtcagtcacacctacatgagcgtcgggtccgccgcggcctaccggaggggacgggtctgggagtcgcgttcttctttttaagttagtagtagttggtaacgtacacttacctccgcacgtaccgtcggtagggacggggcctacgttccacccgtatccgtacccaagacgaactaaacttacccaaacgaacactccgtttacttttaccttaacaaacgttacgaaccacggtacctaaggacggacgaccggataccggaaccgaccgggtcgttagttacttacggtaggtcggacggtaaggacggtacgggttacccgggggacccccgttaaacgggttaaaccccgtttaccgtaacccgggtacgttaacgggttaccgggtaacccggttccgggtaacccgggggtaaacccccgggg

SEQ ID NO: 183322 - DNA, 837 bp, Homo sapiens
  misc_feature: GYAE6OF01BX4D9.13.76.G10.1.454.CMB.1.raw
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (210)..(210): a, c, t, g, unknown or other
  misc_feature (210)..(210): n is a, c, g, or t
  modified_base (306)..(306): a, c, t, g, unknown or other
  misc_feature (306)..(306): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttccttgtgctatttaaaggtcgccagtgtgacggtgcagcgtggtggngttcgnggaggnggtctgatcagccgtgggggtcctgagactctcgtgcgcagtcctcgtaggtccaccggtcagtccacctacctacagtgagtccgtcgggtaccnccgtcggcgtaccgagggggacgggcgttgggacgtgtacgttccgtttgttttagtttaacttagggtattgggttactaactacgttaccgacccgacggttaaccggtaaccgttccgggtacgggaaaccggggggttcctttaacgttaacgaacccctaacgtttccccggtacgtaaaccgggaacgttaaacaaccgtttttaaaacccaaaaaccggggtaaaccttaaccgtcggtttttaaccgttttacggtaaacaaacggggttttaaccaacggtaaccttcccgaaggttaacccggtaaacggccgttaacggtttaacgaccggtttaaccgggtaccggttagtttaaccccgttttaggtcgtaaccggggactaaacggggtaggtacccggtttacggggaaccccccgggtttaaaagtaaaacccccggtttccgtaaccggttcccgggtttaaaagcccgggggtttaacccggtccggggttcggggtaaaaaccccccggggg

SEQ ID NO: 183323 - DNA, 780 bp, Homo sapiens
  misc_feature: GYAE6OF01CCDL1.13.76.G10.1.454.CMB.1.raw
  modified_base (498)..(498): a, c, t, g, unknown or other
  misc_feature (498)..(498): n is a, c, g, or t
tcagtcacgtactacacgaccggtgctcgatttagtcactcatacaggggctgggcctcaggaagcagcatcgggaggtgcctcagccatggcatggactccctctcttcctcggcgtccttgcttactgcacaggactccgtggcctcctatgagctgactcacgcccacctcagtcgtccgtcgtccccgaggacacgacacgccagctactccacctgtcctacgtaaggtaaattaacgttggactaagtaattaaagtacttaccttaccgtaggttactaccgtaggacgaaggaacgtaccgaccggtaccctaccgtttcccccgtggtcggtccgttggttacctaaccgtttctaacgtaccgtaaagcgttacggacccttaacgggtcccggccgtaccggaacgggtaccttcccggtaggacgttaccgttactttccggtaccgtccggtacctaccccgtaacgtccggtaaccggtaaccnccgtacgtaccctacgtcccgtaacgccgtaacgtcccggaccgggtacccggaccgtacgtaccgtgtaaggtcgacgggtactacgttcttaacgtaccttacggtccggacggttccgggagggtaacggtccgacggtaccgcgtacccggtacgtcccggtacgttaacccgttcgtaccgggttacccggttaaacgggacccgggtaccggtaacccgtacccggttccggtaacccgttaccggaacccttcccggtaaaccccgaacccccgg

SEQ ID NO: 183324 - DNA, 748 bp, Homo sapiens
  misc_feature: GYAE6OF01ADH4U.13.76.G10.1.454.CMB.1.raw
  modified_base (333)..(333): a, c, t, g, unknown or other
  misc_feature (333)..(333): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttagttttaaaaggtcgcccagtgtgaggtgcagcgtggtggagtcgtgggaggaggtcttgactccgagtccggtcggggggtccctggacgtacctccgtccgtgtcgccgacgtccctcgttcgggttaccacccgtcacgtccactacctacagtgacgcgtcgggtcccnccgaggcctaccggaggggaacgggcgtgggagtgcgttctttcttttattagtagtagtggtagactacgtaccgtccgacgtacgtaccgtccggtagggaccggggtaccttacttacccgaccgtacctccgtaccgaacgtacgaaacctaacgttacccgaaagaacccgtacgtcctttcgtttaacctaagtaaagttcgaaaccgtcgtaccgtagaacgtaccggaccgtagtaacggaacccggtaccgggtacccggtttagttacttaccgtgggtaccgaggacgacgggtacggtacccggggacccttaaagggttaacccgttacgtacccggtaacttacggggtacgggttaaccgcccgggtacggggtaaacccggtaccggggtaacccccgg

SEQ ID NO: 183325 - DNA, 766 bp, Homo sapiens
  misc_feature: GYAE6OF01AQVNX.13.76.G10.1.454.CMB.1.raw
tcagtcacgtactacacgaccggtgctcgatttagtcactcatacagggggggagaggagcccagcactgggattccgaggtgtttccattcagtgatcagcactgaacacagagactcaccatggagtttggctgagtcgttcgggttttcctttggttgtcttaattttaaaagggtcgccctagtggtggaggtgcagcgtggtggtagtcgtagggaggaggtcgttgtatcccgacggtccggttcggggggtccctggacgtacgtccttccgtgtcgacgacgtcccgtcgttcggttcctaccgtcgaccgtaccacgtacctactagtcggacgtccggtcgggtaccccgccgacggtccgtacgggaacggggaacggggtccggtggacggttccggtaccgtttccgtttacgttttttagtttaagttacggttagggtacggtttaagtacctaacgttaccgtccgacgtacggtaccgtcggtacgggcgggtacctagtcccacgtactccgaacgtagacgtaactaacgtaccgtaacaacctacgtaccgtttcgtttaacgtactaaacgtacgtaactacggtaccgtagacggtacgaccgtaagtccgaacggtaccggtcccgttagttacccgtacgtcgtaggacgtacggtaacggtacgggtccccgtaccggaaccgttaacgtcccgtacggacttccgggaggtccgtacgggaccggtaccggtaaaccggg

SEQ ID NO: 183326 - DNA, 928 bp, Homo sapiens
  misc_feature: GYAE6OF01E40V1.13.76.G10.1.454.CMB.1.raw
  modified_base (863)..(863): a, c, t, g, unknown or other
  misc_feature (863)..(863): n is a, c, g, or t
tcagtcacgtactacacgaccggtgctcgatttagtcactcatacgagggggggagaggagcccagcactgggattccgaggtgtttccattcggtgatcagcactgaacacagaggactcaccagtggtagttttggctgagtcgttgggtttttccttgtttgtacttaagtttttaaaagggtcgaccccgtaggttgttaggaagggtgcaggtcgttgggtggtagttcggtaggggaggggtacggttcgttagtaccgtaccggtaccgggtccgggggttaccgggggttcccgtaggtaccgttacccgttccgttccgttggtccgaccggtaccgttccggtttcgggtttaccggttacccgtacccgtaccgtacgtaccctaacccgtaacctacgtacgtacggtacggtccggtcccggggtacccgaccgggtaccggtacccggtaacggggaacgggggtaccgggtcggtacgggtacggttccggttccgttttacgtttttaacgttttaagttaaggttaaggttaaggttagttaacgtaacctaccgtaccgtcgtaacgtacggtccggtcgggtacgggaccggtacctacttaccaccgtacgtaccgtacggaagaccgtaaaactttaccggtaaaccgaacgttacccgttacgtttccgttttaattaacccgaaagtaacgtacccgaaacgtcggtaccgtaaggacccgtaccggacgtaccgggacgtaacccgggttcccgttagttttaagtaccgttgggagtaaccggaggacggttaccgggaacggttcccgggtaacccttaaagggttacccttacggngttacggttacggtacccggggttacggtaccggaaacccgggtaaccggtaaccggtaccccgg

SEQ ID NO: 183327 - DNA, 970 bp, Homo sapiens
  misc_feature: GYAE6OF01BQPK3.13.76.G10.1.454.CMB.1.raw
  modified_base (310)..(310): a, c, t, g, unknown or other
  misc_feature (310)..(310): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggtttttccttgttgtactttaaagtttttaaaagggtcgtccctaggttggtggtagggttgccgagtccggtgggtggtacgtcgtggggagggaggtcgttggactccgacggtccgggtccggggggtcctaggtacgtccttccgtccgtggtcgccncgtccttccggttcgggttaccctaccgtactacggtacccacctaaccgtacgtagtcgtacggtccggtccgggtaccccgccggtaccggtccggtaccgggaaggggggtacgggtccggttaggggtcggtttccggttacgttttaccgttttaacgtttttaaggtttagttaagggtttacgggttaggtaacgttaaccgtacgttaccgtccggacgtacgtaccggtccgggtacgggaccggggttaccgtacgttacccgtacccgttacgtaccgttaccggaaacgtaacggaaccttaaacccgttaaccggaaaacgtaccgtaacccggttttcttttaacccggtttaaccgtttaaaccgtaaaaccgttaccgtaaacccggtacgcccgttaaacgggacggtaaccgtaacccgggtaccgggtaacggtaccccgggtaaacccggggtttcttaaggtttaaaccgttccggggaggtacccgggtaacggggtaggtaaaccgggtacccggggtaaccccggttacccggttaaacggtaacccgttttaccgggaccgttacccggtttacggaacggggtaccccggttacccggggttaacgggaaccccgggttaaccggaaccccggg

SEQ ID NO: 183328 - DNA, 734 bp, Homo sapiens
  misc_feature: GYAE6OF01CDQ7P.13.76.G10.1.454.CMB.1.raw
  modified_base (214)..(214): a, c, t, g, unknown or other
  misc_feature (214)..(214): n is a, c, g, or t
tcagtcacgtactacacgaccggtgctcgatttagtcactcatacagggggggagaggagcccagcactgggattccgaggtgtttccattcggtgatcagcactgaacacagagactcaccatggagttttggctgagcgttgggttttccttgttgcttaattttaaaaggtgcccagtgtgaggtgcgagcgtggtggagtcgtgggaggnggtcttgactccgaggtccggtcggggggtccctgacgtacctcctccgtgtcgcgacgtccgtcgtcgggttaccaccggtcacgtaccaacacctagacgtgacgtccgtcgggcccgccggacggtccgaccgggagggggaacggggtcggtaggtggtacggtccgttttacgttttacttttaagtttaagttaaggttaaggttaggttaacgtaactacgtacctcccgacgtacgtaccgtcggtgggaccgggtcgtactaccgacctactcctaccgagaacgaaccttagtaaccaagaaccctacgtctttagttacctaacgtaaatcgacgactccggtagaacgcgaccggtaacccggaacgtcgggtattacgtagttcgtaggcgaggaacgacggtacgggacccggggaaaccctaaccggttaacgttcccgaaccggtgttaccggaccggggttaccgtagggtaacccggggaccggaaaacccgggtaccccgg

SEQ ID NO: 183329 - DNA, 591 bp, Homo sapiens
  misc_feature: GYAE6OF01A9NI3.13.76.G10.1.454.CMB.1.raw
  modified_base (272)..(272): a, c, t, g, unknown or other
  misc_feature (272)..(272): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtggggggtccctgagactctcctgtgcagcctctgggttcaccgtnagtcacacctacatgagctgggtcccgccgaggctccgaggggaagggctggagtgcgtcttcttttatttatagttagtggtagtacataccgtccgcagtaccgtccggtggacggggtcctattccacctatcctaccgagacgaactaattacccaaagaacacgtcttcgtttctacaatacgaacagcctagacgcgaccgatacgaccgacggtcgttagtacttcgtgtgacgagaggcggtcggggaccctaacggtaccgttaacgtaccgtacgtacggtcggtaccggttcggtcggggtaacccgg

SEQ ID NO: 183330 - DNA, 755 bp, Homo sapiens
  misc_feature: GYAE6OF01BQUK8.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggaattggggctgagctgggtgctccttgttgctatttagaggtggccagtgtgagatgcgacgtggtggagtcgtggggggaggtcgttgggtccgagggccgggggggtcacgtggacgtactcctcctgtaccacgtccgtacgagtacttctagtttttaccgaagggtaactttagttaggtattaggtaggtttcggggtccccgtaccgacggttccgtacccggaagggggtacggggtacgttggggtagggttcggggtacggtaccccgaaacgtaaggtaaaaggggaggtacggtaggggtaacggtccgaaggtaacctagttaagttagttggtacggtggttcggtgggtcggggccggggtaccgtacgtttacccgtaccttaacgtttaccgaagtaccggtaaccgtaaccggcccttaaggaacgttcgttacgaaggttatacgtacggtagaacgtaaagtgggtaacggcgtaccgtagggaacgtagggtaccgtagtaggtaacgtaccgttacgaattagttaactttggtaccgttaggtagtaagttagtggtaactttcgttacgaggtacccgtagtaccgttaggttcgggtaccggg

SEQ ID NO: 183331 - DNA, 840 bp, Homo sapiens
  misc_feature: GYAE6OF01EEYB3.13.76.G10.1.454.CMB.1.raw
  modified_base (694)..(694): a, c, t, g, unknown or other
  misc_feature (694)..(694): n is a, c, g, or t
  modified_base (702)..(702): a, c, t, g, unknown or other
  misc_feature (702)..(702): n is a, c, g, or t
  modified_base (753)..(753): a, c, t, g, unknown or other
  misc_feature (753)..(753): n is a, c, g, or t
tcagtcacgtactacacgaccggtgctcgattttagtcactcatacagggggggagaggagcccagcactgggattccgaggtgtttccattcggtgatcagcactgaacacagaggactcaccatggagttttggctgagcgttgggtttttccttgtttgactttaagtttttaaaaaggtcgcccgtagtggtgaggtgcaggtcgtgggtggagttcgtagggaggagtcgttgactccgacggtccgggttcgggggtccctaggacgtaccttcctccgtgtcgcgtacgtccgttcggttcgggttaccgtacccgtcgtaccgtaccaacctaacctaacgtacgtcggacggtaccgggtcgggttcccccggacccggtacgggtcccggttaaccgggggaaacgggggtaaccggggggtcggttacggggtacgggttccgggtttacgttttaccgttttttacgttttttttaaaggttttaacggtttaacgggttttaaggttttaaacgggttaaggttaaccttaacgttacccgtacccgtacggtacggtaccgttaccgggacggggtaaccgggtacgtacgttaccgaactccgtaccgtaacgaataccgaacttaaccgttacaaacgaacctacgttctttaagtttcctaaacacgttaacgaacncgttacgngaggaccgcgtaagtaccgaccggccgttacgttagtattcgtagtacggnggaggacgcggtaacccgggccttaaacggtacttacgacgtagggtacctcggtacgaccgggtaacggaccggtcgggtaacccg

SEQ ID NO: 183332 - DNA, 696 bp, Homo sapiens
  misc_feature: GYAE6OF01D36TI.13.76.G10.1.454.CMB.1.raw
  modified_base (344)..(344): a, c, t, g, unknown or other
  misc_feature (344)..(344): n is a, c, g, or t
tcagtcacgtactacacgaccggtgctcgatttagtcactcatacaggggggagaggagcccagcactgggattccgaggtgttccattcggtgatcagcactgaacacagaggactcaccatggagttttggctgagctgggtttccttgttgcttatttaaaaggtgcccagtgtgaggtgcagctggtggagtctggaggaggcttgatccagccgtggggggtccctagacgactcctcctgtgcagcctcgtggttcaccgtcgagtccaacacctacatgacgtcgtgggtcccgccgaggctcccggaaggggaggggtctgggacgtggtccgttnttctttttaattagtaacgtaggttaggtaacgtacagttacccgtcgacgtacgtaccgttccggtagggacgggggtcctacgttccaaccctatcccgtacccgaagtaaccgtaactaaaccgtttacccaaaagtaaccctacggtacttacgtttaccttaaccgtaaattacgaaactacgaccctagtaacgacgtacgaacgtcgaaccggaccggtaccgtttagttactttaccgtggtcgtacggaaggacggtacggtaccgggggaaccctaacggtaaaccggttacgtaacgtcgtacgtagggtacgtgggtacgggaccggacggtaaccccgg

SEQ ID NO: 183333 - DNA, 824 bp, Homo sapiens
  misc_feature: GYAE6OF01ARLQV.13.76.G10.1.454.CMB.1.raw
  modified_base (104)..(104): a, c, t, g, unknown or other
  misc_feature (104)..(104): n is a, c, g, or t
  modified_base (685)..(685): a, c, t, g, unknown or other
  misc_feature (685)..(685): n is a, c, g, or t
tcagtcacgtactacacgaccggtgctcgatttagtcactcatacagggggcctgggcctcaggaagcagcatcggaggtgcctcagccatgcatggatccctntcttcctcggcgtccttgcttactgcacgagtactccgtgcctctatgacgtctagacctcacgccctacctcgtagttcgtccgtcgtacccgaggacacgacacgaccagctactacgtacctcgctaggtaggtaagttaacgttaagggtgggtaaatttacgttccgttaccgtcgtaaggtacacgaacggaaccgtacgaccgtacgtccgtaccgtccgttaggtacgttacgtatacgttacgaaccgtaacgtacccgtaacggtaccgtacggtacggtacgtacctacgtagtaccttacgtccgttaccgtaccggttaccgtaaccgtacggtaaacggtaacaccgtaaccgtacctaccgtaaccgtaccgtaaaccgaaccgttaaccggaaacggtaacgttaccgtaaggttaaccggttagtaacggttacgaacggttagtaacccgttaagtttaaccgtacggtttaacggtggaacggtacggtaaccgttaacggaaccctagttaacccggtagtacccgggtttagccgggttaacgggtaccgtaccgggaanacccggtaagtcccgtaaaccgtacgtttaaccggcgtacccggttacccggacgttaaaccccgggtcccgttacccctaccccggggtccctttaacccgggtacccccttcggttaccccgtccccggtttaaccg

SEQ ID NO: 183334 - DNA, 940 bp, Homo sapiens
  misc_feature: GYAE6OF01D09FK.13.76.G10.1.454.CMB.1.raw
tcagtcacgtactacacgaccggtgctcgatttagtcactcatacaggggctggggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcactccacctgcctacgtaggaaaataagttggacaagtaattaaaacttacttaccgttaccgttaggttactacgaacgactaacggtaaacgtaccgaaccggtaccctaaccggtcccccgttaggtacggtccgttacgggttacctacttaccgttaacgtaccgaaacggttacgtacggtaacccggtaaaccgggtcccgggtaccccgttaccggtaacggggtaccccttacccggtacgggaaccgtaccgggtttacctttaccggttcccggttaccgggttaccccttaaccccggtaaaacccggtttcccggttaaccggggtaaaccttccggtaaacccgttccccgggtaacctttcccgtaaacccgtacccgtaaccgtacccgggaacccgggtacccgggtaacccgtaggggttaccgtttaacgggtacgggtacgttaacggggtacggttacccgtttaaaggtaactttagtttaccgggtacggttaccgggaacgggttcgggtacgggttaaaccgcgggtaacgaccgggtaccgtaccgtacccgggtacccttagtttaaccgggtttccggttaacccgggtttacccgggtaaaccgggttacccgggggtaaaccccgttaaaccggggttaccccgttaaacccccgggttaactttaaaccccgggccccgtaaacccgggttaaaccccccccgg

SEQ ID NO: 183335 - DNA, 805 bp, Homo sapiens
  misc_feature: GYAE6OF01A9HIE.13.76.G10.1.454.CMB.1.raw
tcagtcacgtactacacgaccggtgctcgatttagtcactcatacaggggagaggagcccagcactgggattccgaggtgtttccattcggtgatcagcactagaacacagagactccaccagtggtagttttgcgtgagtcgttcgggtttttccttggttgtactttaagttttaaaaggtcgcccgtagttgtaggaggtgtcagtcgtgggtggtagtcgtgggaggaggtcttgactccgacgtccgggttcgggggtccctggacgtacctcctccgtgtgccgtacgtccttcggtcggttacctaccgtaccgactaccgacccacctactgtgacgtcggtacggtcccgtacgacggtccgtacgggagggacggggtcgtgggtacggtcgtccgttacttttagttttacttagttagtaggttaggttaacgtactactaccgcgactacgtacgtccggtagggccggtcctacttccacctctaccgtacagaactaacttaaccgtacaaacgtaccccacgtttcgtttaacgtttaccctaagttaaaaccgtccgaaaattacccggttaccgtaggaaccggtactaacccgggtaactaccggtaccccgggttaacccggttgtttaaagttacccgtggtacggtacggacgggtacgaacggggttaacccgggacccggggttaaccccttaacggttaaccccggttacgttaaccgtacgtacggggttccgtaccgggtaccgggacgggttaaccccgggaaacggttacccccgg

SEQ ID NO: 183336 - DNA, 807 bp, Homo sapiens
  misc_feature: GYAE6OF01DX7QR.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagtctgggttttccttgttgcttattttaaaaggtgcccagtgtgaggtgcagctgggtggagtcgtggaggaggtcttgatccgagtccggtggggggtccctggacgactctcctggtgcacgccttcgtcgggtttcaccgtcacgtcacctaccgtactatggacgtcgtcggggtccccgccgtacgggccttaccgggaagggggtaacgggggctcggggtaggttacggtccgtttaccttttattttttaagtttacgttaagggttacggttaggttaacgttaactaacgttacccgtacccggaccgtaggtacccgttccggggtggtaaccggggggccctaacgttccaaccgttacttaccgttccgaaggaacgtaacctaaacgtttacccgaaaacggtaacgtaccgtcttttacgtttccttaagtaaagtcgtaaaccgcgtaccgtaggaacgtaccggaccgtaactacggaaccgttaccgggtaccgtttagttaacgttacggtcggtaggtaccggtaaggtacggtacgggtacccggggtaaccccaacccgggttaaaccttaccggtacccgtcggttaacgttacgggtaccggttagggacccgggggttaacgaaaccgggttaaacccccggg

SEQ ID NO: 183337 - DNA, 913 bp, Homo sapiens
  misc_feature: GYAE6OF01ALAJJ.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctggagcgttgggttttccttgttgtacttaagttttaaaaggtcgcctagtgtggaggtgcagtcttggtggagtcgtgggaggaggtcttagactccgacggtccgggtcgggggtccctaggactccgtcctccgtgtcgcctacggtccttccgttcgggttaccaccgtcacgtaccacctacctactagtcgaggtccggtcgggtcccgccggacgggcccgtaccgggaaggggtaacggggtccgtagggtcggtacggttcgtttccttttacgtttttaagttaggttacggttaggtacggttacgtacgtaacctccgtcccgagtaccggtaccgtcgggtacgggtaccggggaccttaacccgtttacccgaaccttaccggttaccctaaccggtaacggtaaccgtaaacccttaaaccgtaaaccggaaaccggttaaccgtacccgtttccggttttaaccttttaacccgtaaagtaaccgttaaccgggaaacgtacgacccgttaaggtaaccgaacgggtaccgtacggtaacggaaccccggggtacggtttaccgtttaagtttaaccggttcttcggggtaacgacgggaacgggtacgggttaaacccggggtcccgggttaaaaccccggttaacggttaaaccccgggttaccggttaacggtcccggtttaaacggggtacccgggggtaccccgggtttaaccgggaaccccgggggtaaccgggtaacccgggtaacccccggg

SEQ ID NO: 183338 - DNA, 849 bp, Homo sapiens
  misc_feature: GYAE6OF01DS96K.13.76.G10.1.454.CMB.1.raw
  modified_base (307)..(307): a, c, t, g, unknown or other
  misc_feature (307)..(307): n is a, c, g, or t
  modified_base (604)..(604): a, c, t, g, unknown or other
  misc_feature (604)..(604): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgcttaagttttaaaaggtcgcccagtgtgaggtgcagcgtggtggagtcgtgggaggaggtcgttgactccgacggcccggttcggggggtcccctggacgtaccgttcctccgtgtcgcgacgtccgttcgttcgggttcctaccgtnacgtaccaccacctacagtagcgtcgtccggtccgccgacggtccgtaccggaagggggtacgggtccggtagggtagttcggtccgtttcgttttacgttttttaatttaggtaaggtttaacggtaggttaacgttacgtacttacccgtacccgacgtacggtaccgttacgggtcgggtaacggggtccctaacgttcccgtaacctacttcccgtaaccgaacgaaacgtaaaccttaaccgttaaccaaaaccggtaaccgttaccgttcgttttaccgtttaaccttaanaaacgtttcgaaacgtccggtacccgttaggaaccggtaccggacgtaacgtaccgggaaacccggtcggttacccgtttagttaacccgtttggacgggttacggacgtaaacgggaggttaccgggtacccggggtaacccctaaaacggttacccgggtttaacctaccggttaagttaccggtaccgggggttaaccctcgggggaaacccgggtcccgggtaaaaccgggtaaccccggg

SEQ ID NO: 183339 - DNA, 882 bp, Homo sapiens
  misc_feature: GYAE6OF01EVTSV.13.76.G10.1.454.CMB.1.raw
tcagtcacgtactacacgaccggtgctcgatttagtcactcatacaggggggaggaggagcccagcactgggattccgaggtgtttcctattcggtgatcagcactgaacacagagactcaccatggagttttggtctgagcgttgggttttcctttgttgtcttagttttaaaaggtgcccagtgtggtaggtgcagtcgtgggtggtagtcgtgggagggaggtcttggactccgaggtcccggtcgggggtccctggacgtaccttcctccgtgtcgcgacgtcccgttcgtcgggtttcccgacccgtcctagtaccacctacctacagtcgagtccggtcgggtccccgcgacggccgtaccggaagggggacggggtcgtgggtagtcggtctttcctttacgtttttaatttagttaagggttaggtttaggttaacggtacctaacgttacccgtcccgtaaccggtacggtaccccggttccgggtacggggtacccgggggtacccgttaccgttaaccctaacccgtaccttacccgttacccggaaagtaacccgtaaaaccttaaccgggttaaacccctaaaacggaaacccctaccggtttaacccgttttgttttaaaccccccgttaaataaaaccggttacgaaaaccgtaacggtaccctagggaaccgtcgaacccggtaataccggggaacccgtacccggggttcgttaacgtttaagtttaccggtagggttcgaacggtaaacgggcggtacgggttaaccccggggaacccctaagggtttaaaccccgttgtaccccgtacgtacggttaccggtaccggtaccgggtacggggaacccgtaaccgggtaaccccg

SEQ ID NO: 183340 - DNA, 796 bp, Homo sapiens
  misc_feature: GYAE6OF01B4SP2.13.76.G10.1.454.CMB.1.raw
  modified_base (257)..(257): a, c, t, g, unknown or other
  misc_feature (257)..(257): n is a, c, g, or t
tcagtcacgtactacacgaccggtgctcgatttagtcactcatacaggggggggagaggagcccagcactgggattccgaggtgtttccattcggtgatcagcactgaacacagagactcaccatggagttttggctgagcttgggttttccttgttgcttagtttaaaaggtcgcccagtgtgaggtgcagcgtgggtggagtcgtgggaggaggcttgatccgagtccggtgggggtccctgagacctctctgtncgacgtcctgtcggttccaccgttgacgttaccactacctacagtcgagtcgtacgggtcccgccgagggcccgtaccggaacgggggaacggggtcgtggggtagtccgggtacgtttaccgttttctttttaagttttaagttaacggttacggttaacgggtagttaacctacttacccggtcccgtacggtaaacggtcccgttccgggtagggtaaccggggggcccttaaacttccgaacccttacgttacctaacccgaaaggtacgtaaaccttaaaccgttacccaaaggtaacccaacgttcttttacgttttacctaacgttaaattacccggaagtaccgcgttaaggaaccgtcggacgtaacgtacggaacccggtaccgggttacccgtagttacgtttacggtgttcgggaaccgtaaggtcggaccgggtccgggaaaccctaacggttaaccgttaccgtacgtaacgtacgttaccgggacggttccgggaacgggtaacccgggaacggtaaccccggg

SEQ ID NO: 183341 - DNA, 940 bp, Homo sapiens
  misc_feature: GYAE6OF01B0AUQ.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagagactcaccatggtagttttggctggagtcgtttcgggttttccttgttgtacttaagttttaaaaggtcgaccgtagtgtggtaggtgaccgagtcgtgggtggtaggtcgtagggaggtacggtcgttagtacgtccgacggtcccgggtcgggggtccctaggtacgtacttccgtcgttggtcgtcgacgtcctcggtcggttaccgtaccgtacgtacgtaccacctaacctacgtagtcgacggtccggttccgggtacccgaccggcggtaccggtaccgggtaagggggacggggtcgtacgggtacggttcggttaccgttttcgttttaacgtttttacgttttacggttaaggtttacgggttaggtttaaaccgttaccgtacgtttaacccggtaccggtaccgtacgggtaccccggttaacgggtaccggggaacccgggtcgttaacccttacccgaaccgttcctaccgtaacgaacgtaccgtaaacgtaacttaaacccgaaagtaaccccgtacgtttacgtttactttacgtaactaacgttagaaaccgtcgtacgtacacggtaccgaacgtaccgtacgtacccggtacgttaccgtacgtttacgttaccggtcggtaacggtaaccgggtaacggtcgggtaaccgggtaaccccggggttaaaccggttaaaccccgggtttaaccccggttaaaacgggttacccggttaccgggttaaccgggtttaccggggtaacccgggttttaacccgggggaacccggggtaacccgggtaaaccccgggggtaacccccggg

SEQ ID NO: 183342 - DNA, 712 bp, Homo sapiens
  misc_feature: GYAE6OF01DV95T.13.76.G10.1.454.CMB.1.raw
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (351)..(351): a, c, t, g, unknown or other
  misc_feature (351)..(351): n is a, c, g, or t
  modified_base (517)..(517): a, c, t, g, unknown or other
  misc_feature (517)..(517): n is a, c, g, or t
tcagtcacgtactacacgaccggtgctcgatttagtcactcatacagggggggagaggagcccagcactgggattccgaggtgtttccattcggtgatcagcactgaacacagagacctcaccatggagtttggctgagcgtgggttttccttgttgctattttaaaaggtgtccagtgtgaggtgcagcgtggtggagtcgtgggaggaggtcttgactccagccggtggggtccctggacgctcgtccgtgtgcncgtccttcgtggttccaccgtcacgtcaacctacctanagtgacgcgtacggtcccgcgtacggccgtacggaggggaacggggtcgtaagggngtcgtacgtttctttacttttagttagtacgtaggtagtaagtactactacgtccgatacgtacgtcggtaggacggggtcctattccgacctactacgtccaaagtaacgtaacctaaactaacgaaacggtaacccgtacgttccgtttagttttaaccctaanaaaggttcgaaacgccgtacgtacggaacggcgaccgttaagtaccggtaaccggtacggttccgttagttaacgttcggtcgtcgaagacgggtacgtaacgggccgggtaaccccgttaaagggtacctttaacggaaacgtcgttacggtacggtacccggtgggtaacccggggacgtaacccgggaaccg

SEQ ID NO: 183343 - DNA, 724 bp, Homo sapiens
  misc_feature: GYAE6OF01D4SDH.13.76.G10.1.454.CMB.1.raw
  modified_base (135)..(135): a, c, t, g, unknown or other
  misc_feature (135)..(135): n is a, c, g, or t
  modified_base (196)..(196): a, c, t, g, unknown or other
  misc_feature (196)..(196): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttacctgcacaggntccgtggcctctatgagctgactcagccaccctcagtcgtccgtgtccccaggaccagacngcctagcgatcacctgctctaggaaattaagtggacagaattaaactatacttcgtagtagtcacggacaagtaagtcaacggccctaacgtccccctaggtcgcgttaggtacctataccgtataccgtaagtacgtacgaccaaaggcccggtaccctacggacgggtaaccttccccgtaggaccgttacgtacgtttaccgtcggtaacggtaccttaacccgaacgtcggtaccggggtaaacctaccggtaaccgtaccccgtacgttaccgtacggtacccctaaagttcccgtaaacggggccccgggtaaaccctaacgggtacctaagttacgggtaagttacggacgtacccgttaagggtaaccttaagttaaccgtacgtacgacgggcgtaagggcgtaacggccgtaagcccgagttaccgccggttactagttccgttaccgtaacgggaccgttacggggaaacctaggaaccctacgtaaacccgtagacccgtcgacccgtaaacccgg

SEQ ID NO: 183344 - DNA, 813 bp, Homo sapiens
  misc_feature: GYAE6OF01CL8FK.13.76.G10.1.454.CMB.1.raw
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatgggatttggctgagcttgggttttccttgttgacttaattttaaaaggtcgtacccagtgtaggaggtgcagcgtggtggagtgtggaggagcttgactccgagcggtcgggggtccnggacnccgtctccgtgtcgcgacgtcctcgttcgggttcctaccgtcgacgtaccacctaacccgtagagtcggagtcggtacgggtccccgacgacggcctacccggaaggggaagggtccgtaggagtcgtacgttctttacgttttatttagtagttacggtaggtacgtaactacgtacctaccgacgtaacgtaccggtcggacgggtacgggtacctacgttaccaccgtacgttcccacgaacggaacgtaactaaaccgttaaccgaaaacggaacctaccgttacgtttaccgttttaaccgtaaacgtaaactaccgaaaccgtacggtaccctaagggacccggaagtaccccgggtaattaacccgggtaaccgacccggggtttaacgtttacggttaaaccttacccgggtagttacgggaaccggtaaggaaaccgggtaccgggttaccggggaaacccccgtaaacgggtttaaccgttaaacccggtccgttaaaccggttacggtaccgggttaacccggttaccgggtccggggggaaaacccccgg

SEQ ID NO: 183345 - DNA, 739 bp, Homo sapiens
  misc_feature: GYAE6OF01DYXD7.13.76.G10.1.454.CMB.1.raw
  modified_base (172)..(172): a, c, t, g, unknown or other
  misc_feature (172)..(172): n is a, c, g, or t
  modified_base (292)..(292): a, c, t, g, unknown or other
  misc_feature (292)..(292): n is a, c, g, or t
  modified_base (366)..(366): a, c, t, g, unknown or other
  misc_feature (366)..(366): n is a, c, g, or t
tcagtcacgtactacacgaccggtgctcgatttagtcactcatacaggggggagaggagcccagcactgggattccgaggtgttccattcggtgatcagcactgaacacagagactcaccatggagtttggctgagcttgggttttccttgttgcttaattttaaaaggtcncccagtgtgaggtgcagcgtggtggatcgtggaggagcttgactccagccggtcgggggtcctgacgccttcgtcctgtgcacgtcctgttagggttccaaccgtcacgtccaccacctnatagcgtcgtcgggtccccacgacggtcctaccgggaagggggtacgggcgtagggtacgtcggtaccgttttntttaacttttaagtttacgttaacggttaggttacggtaacgtttactacgttaccgtaccgtaccgtaagtaccccggttcggaacggggaccgggggtacctacgtttccaaaccttcctacctacgaagacaaccttaaacgtaccgaaacgtaaccctcgtacctttacgtttaacctaacgtaagtaccgaactcgacgtaggacgacggtcaacgtgaaccggtcgtacgttagttactagtcgtacggagtacgcggtacggtaccccgggtaactaaccggttaacgttaacccacggttcgtaaccgggttacgggttaccggtacccgggttaaccggggaaccggtacgggtaaacccccgg

SEQ ID NO: 183346 - DNA, 586 bp, Homo sapiens
  misc_feature: GYAE6OF01AFCZC.13.76.G10.1.454.CMB.1.raw
  modified_base (182)..(183): a, c, t, g, unknown or other
  misc_feature (182)..(183): n is a, c, g, or t
  modified_base (193)..(193): a, c, t, g, unknown or other
  misc_feature (193)..(193): n is a, c, g, or t
  modified_base (199)..(199): a, c, t, g, unknown or other
  misc_feature (199)..(199): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (244)..(244): a, c, t, g, unknown or other
  misc_feature (244)..(244): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (467)..(467): a, c, t, g, unknown or other
  misc_feature (467)..(467): n is a, c, g, or t
tcagtcacgtactacacgaccggtgctcgatttagtcactcatacaggggctgggagaggagcccagcactggggattccgaggtgtttccattcggtgatcagcactgaacacagaggactcaccatggagttttggctgagcggcgttgtctaaggcgtacttaaagtagcagctgagtnnagctagagtntacggnggagntcanactcgagtcggtcggtacngtactctctcgtagtanctcgtacgttcgtcgactaccgtanactcgcgacgtanagacgtcgcgtacggtcgcgacgcgacggacggaggcggcgtcgtgtcgttattagttattagtagtagtagtagtacacgtacaccacgcgtacgtcggtacgtacggtacgtacgtacacacgtactatacgtactaatacgtagaacgacgtacgtacgtacgtactaacactacacgtacngtacgtacgtacgtagtacgtacgtacggtacgtactactagtcgtacgtagcgtacggacggaccgtacggacgtacgacgtacgtacgtacggtacggtaggacggtcggcggtacg

SEQ ID NO: 183347 - DNA, 821 bp, Homo sapiens
  misc_feature: GYAE6OF01ANKWK.13.76.G10.1.454.CMB.1.raw
  modified_base (776)..(776): a, c, t, g, unknown or other
  misc_feature (776)..(776): n is a, c, g, or t
tcagtcacgtactacacgaccggtgctcgatttagtcactcatacagggggggaagcctgggaacacttagcctttcatgagtgtccccaccatggcctggatgatgcttctcctcggactccttgcttatggatcagggagtggtatttctcagactggtggtacgacccgaggacgcctattccgttctcgtaggttcgttccttaccggtgggacggactacgttccaaccgtaccttcgtactttggtggttactttggaacgtacgtaccggcctcgtagttccttagttaacgttacgttacccctaccccgtagtccgttacggaacccaaccgtacccgaaccccgtacggccgacggtccgtcccggccgaccgaccgtccttaccgtaacctacctaaccaaacctaaccaaacccgtaccgttccgtccctttcccgtttcccgggttaccggggttcccctccgttaccgttccggtttccttcccttcggttcccggttcccttacccgttaacgtttacccggttaaacgggaaaaccgtaacgttccgttacccgttaccctttactaccggtacccggtacccggggtacccggggaccgtaacgggacgtaaacggtaacgtagtacgtacgtactttacgttattacgtttcttagttttctttagtttagttcggttaacggtcgtcgttctttagttctacggttcttgggtcggtaggggacggtccggtcccgaccggtcctaccgggttcccncggttaccgccgaccgtccgccgttccgtcccgtcccgtgtcccg

SEQ ID NO: 183348 - DNA, 904 bp, Homo sapiens
  misc_feature: GYAE6OF01A5KMR.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagagactcaccatggtagtttggcgtgagtcgttgggttttccttgttgtacttaagttttaaaggtgacccgtagtgtgtaggtgcgtagtcgtggtggtagtcgtgggaggtaggtcttcgactaccggacggtccgggttcgggggtcctaggacgtaccgttcctccgtgtacgcgaccgtccgttcggtcggttacccgtaccgtacgtacgtacccaccctaccgtagtagtacggtacggtccggtccgggtaccccgaccggtacggtaccccggtaccgggtagggggtacgggtccggtagggtacggtcggtttcctttacggttttactttttaaggtttaggttaaggttacggtttacggtaacgttaacgtaccttacccggttacgaccgtacggtaccggtccgggtacgggtacccgggttcgtaaccttacccgtaaccctcgtaccccgtagtaacgtaactaacttaaaaccgtaccgaaaccggtaccttaccggtttaccttttacggttaaacttaaacccaaaggtaccgtacaccggtacgaacgtaacgggacccgaggttaaccggtaccggtaacccggggttagtttacccggttaggttaacttaccgggtggtacccgttaaacgggaccggggttaagggtaccccggggtaccccggtaaacccggttaacggtttaaaccgttaccccggaggttacgttaaccgggggtccgggtaaacccggttccgggggtaaacccggggtaacccccggg

SEQ ID NO: 183349 - DNA, 636 bp, Homo sapiens
  misc_feature: GYAE6OF01ACPD3.13.76.G10.1.454.CMB.1.raw
  modified_base (212)..(212): a, c, t, g, unknown or other
  misc_feature (212)..(212): n is a, c, g, or t
  modified_base (557)..(557): a, c, t, g, unknown or other
  misc_feature (557)..(557): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcgagtgtccgtgtccccgaggaccagacagccagcatcaccngctcaggaaatagtggacagtataaatacgtacttccgtggtactcgagacaagaagtccgaggcctacgtcccctagtcgcgttggtcagtctatacaagtactcgccgaagcccggcctagacgggtctcccgtgacgtccgtacttccgtcgtcggtccttaccgacgttcgtacggaacctcgaccgtacctccttacgacgtaccgagtaccggacggacccgggaaccgacggtacgtagtcggttaagcggtacggcttacgtaacttacgttacggtacgttacgggacgggtacggtacgggacgacggtccacggtcctaaccgtcgacccgttntacggtcggtaccgttaacggaccgtcggaacccgtacgttcccgaaccgttaccgtaacggacccgtcgaacccccgg

SEQ ID NO: 183350 - DNA, 801 bp, Homo sapiens
  misc_feature: GYAE6OF01AZQQX.13.76.G10.1.454.CMB.1.raw
  modified_base (173)..(173): a, c, t, g, unknown or other
  misc_feature (173)..(173): n is a, c, g, or t
  modified_base (203)..(203): a, c, t, g, unknown or other
  misc_feature (203)..(203): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggaatttgggctgagctggctttttcttgtggctattttaaaaggntccagtgtgaagtgcagctggtggagtcgngggggagcttgatccagccgtggggggtccctggagactctccgtgtcgcacgtcctcgtcgggttacacccggtcacgttaccacctaacctacgagttacggacgtccggttcggggtaccccggcccgtacgggacccttccgggaaagggggtaacgggggtccgttaggggaacggttcggtccgtttacgttttaaccttttttaaggtttaacgtaaggtttaacggttacgggtttaacgtaaccgtacttaaccggttcccggacgtaaaccggtccgtttccggggtagggtaccgggggacctaaccgtttccaaccgttactccgtaccgaaggtacgtaactaacgttaacccaaacggtaacctccgtacgtttacgttttactaacgtaaacgttcaacgtacggaccttagggaacgtacggacccgtaagtaccggtaaccgtaccgggttacgttacgttacgttaaccgtggtcggaacggaggtaacggtccgggtaccgggtaccctaaacgggtaccggttaacctacggtacgttacggtacgggcccggttacgggtccggggtaaaccccggg

SEQ ID NO: 183351 - DNA, 714 bp, Homo sapiens
  misc_feature: GYAE6OF01BF6Y8.13.76.G10.1.454.CMB.1.raw
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (297)..(297): a, c, t, g, unknown or other
  misc_feature (297)..(297): n is a, c, g, or t
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
tcagtcacgtactacacgaccggtgctcgatttagtcactcatacagggggggagaggagcccagcactgggattccgaggtgtttccattcggtgatcagcactgaacacagagactcaccatggagttttggctgagcgttcgggtttttccttgttgacttaaatttttaaaaaggtcgtacccaggttgtaggaggtgctagcgtgggtggagtcgtggaggaggtcttagatccgaggtccggtcgggggtccctgagtctcctcctgngcngtaccgtgtcggtccacgtnacgtcaccactanatgactccgtcggcccgcgacgcgtacggagggacggngtggacgttcgtacgttcgtttacgttttaagtagttaggttcgtaaggtagtaacgtactaccgtaccgacgtaacgtccggtaacgtcgggaccgggtacgttctaccacgtactccacgtaagacgtaactaacgtaaccgaaacgaaccgtaccgtcgttacgtttacctaactaaactaccgtaacgacgtaccgtacgaacggcgtaaccgagtaccggaccgtaccgggtcgttaagttacgtagtacgcggtaagtacgagtaaccgggtacccggaaccggtaccggtaaacgttccgtaccggtacgttacggacggtacgggtccgaacggggtacccgtaaacgggtaccccgg

SEQ ID NO: 183352 - DNA, 813 bp, Homo sapiens
  misc_feature: GYAE6OF01DT5YT.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagagactcaccatggagtttggctgagcttggttttccttgttgcttaattttaaaaggtcgcctagtgtgagtgcagcgtggtggagtcgtgggaggaggcttgactccgaggccggtcgggggtccctgacgtactcctccgtgtgcacgtcctcgttcggttccaccgtcacgtcaacctacctacagtggacgtcggttcgggtcccgcgtacggccgtacggaggggagggtcgtggagtgtcgttctttacttttattagttagtaggtcggttagtactacgtacctccgacgtacgtacgttccgggagggtaccgggtcctacttaccaaccctacgttaccgtaccgtaaggtaacctaacctaaaccttaaccgaaacggtaaaccgtccgtttaccgtttaccttttaccgtaacgttaaagtaacgtaaacccgtacgtaccggtaaggacggtaaccggtaccggtacgttaacccggaaaccgtacccgggttaccggtttagttaaaccttccgggtggtacgggtaaccgtagggtaacgggttaaccggggtaccccgggggtaaacccctaaaccggggtttaaaccggtttaacccgtaaccggttacggttaaccgggttacccggggttaccgtccgggggttaacccggggaaccccgggtaaacgggtaacccccgg

SEQ ID NO: 183353 - DNA, 764 bp, Homo sapiens
  misc_feature: GYAE6OF01EZVCV.13.76.G10.1.454.CMB.1.raw
  modified_base (711)..(711): a, c, t, g, unknown or other
  misc_feature (711)..(711): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgcccagtgtgaggtgcgagctgggtggagtcgtgggaggaggcttgatccgagccgtggggggtccctggagtacctctccgtgtgcacgtcctcgtggttcaccgtcacgtccacacctacatgacgcgtcgggtccgccgacggtccgtccggaggggaacggggtcgtacgggacgttcggccgtttcttacgtttttaatttagttagttaggttaggttacgtaactacttaccgtccgacgtacgaccgttcgggtagggacggggtacccgtacgttaccaaccgtactacctaccgaaggacgtaaccgtaaacgtttaccccgaaaaggtaaccctacgttaccgtttacggttttaccaaaccgtaaagttccgaaaccgtaccgaccgttaggaaccggtacgacccgtaagtcccggtaaccgtaccgggttacccttaagttaaacgtttcggacggttaccgggaccgaaagggtaccggaacggggttcccggggaaccccctaaacgggttaaccccggttanacccgggtacgttagtacccggggttacccgtggggtaccgggggaaacccgg

SEQ ID NO: 183354 - DNA, 697 bp, Homo sapiens
  misc_feature: GYAE6OF01AX7MN.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctaattttaaaaggtgcccagtgtgaggtgcagctggtggagtcgtggaggaggcttgatccagccgtgggggtccctgagactctcctgtgcagcctcgtcggtcaccgtcagtccacacctacatgagcgtcgggtcccgccgaggccgtccggaggggaaggggcgtgggacgtcgtcgttctttactttttaagtttagtaggttacggttaggttacgttaacacgttacccgtccgacacgtaccgtccggtgggacggggtccctagttaccaccgtactcctaccgaagactaacctaacttaccgaaacgtaacctacgttctttacgttttcctaaacgtaaagtcgaaacctacggtccctaggaacgtacgcgaacgtacggaaccgtaccgggtccgtttagttacgttacggtggtacgacggtaaggacgtacggtaccgggggacccctaaacggttaaccgtttaccgacgttagtacggtacgggtaccggttccgggacggggaccgaacgggtacccgg

SEQ ID NO: 183355 - DNA, 795 bp, Homo sapiens
  misc_feature: GYAE6OF01EPH3O.13.76.G10.1.454.CMB.1.raw
tcagtcacgtactacacgaccggtgctcgatttagtcactcatacgaggggggggagaggagcccagcactgggattccggaggttgtttcccattcggtggatcgagcactgaacacagaggactcaccatggagttttggctgagcgttgggttttccttgttgctattttaaaaggtgcccagtcgtggaggtgcagcgtgggtggagtcgtgggaggaggtcttgactccacgtccggtggggggtccctagacgtactccgtccgtgtgcgtagtcccttcgttcgggttccacccggtacacgtaccaccaacctacatacggacgtcgtccggtccgccgtagtccgtaccggaagggggtacggggcgtagggtacggtcggtcgtttaccgtttacttttagtttaagttaggttaggttacggttacgtaactacgttaccaccgtacgtacggtacctaccgggtacgggacggggtcccgtacttacccgtaccctacttccggtacctaacggactaaccgtaaccgttacgaaacgtaaccgtccggttctttacgttttacctaaacgtaaagttcgaaacctcgtcgtagggaacgacgaccggaagtaccggaccggtaccgggttacgttgttaacttccgggtggtacggaccggtaaggtacggtaccgggtccccgggaacctaaacgggttaaccgttaaccgacccggaattaccgggtaacccggttaccggtacgggtaccgggggacccccgttaaaacgggggccccc

SEQ ID NO: 183356 - DNA, 1006 bp, Homo sapiens
  misc_feature: GYAE6OF01A47UU.13.76.G10.1.454.CMB.1.raw
tcagtcacgtactacacgaccggtgctcgatttagtcactcatacaggggctgggcctcaggaagcagcatcgggaggtgcctcagccatggcatggatccctctcttcctcggcgtccttgcttactgcacgaggactccggtcggcctcctagtgacgcctgacctcgacgccccacctcgacggtcggtcccgtcggtaccccgaggaccacggaccacggcccaaggcctactaccctaccttcggaccgttagtaacggtaaaattaaacggttcgggaactaaaggtaaacttaaaacgttaccgttaaccgtttacccgtagggttaaacctcgaacggtaaccgtaaaggtaacggtacccgacgggtacccccttaaccggttcccccggtggttacggtaccggttccgtaacgtaccttaacgttaaaccggtacgtaaacgggtctaccccgggtaaaccggacccggggtaccccgtacccccgttaaggggacgggtttaccccctacccgggtaagggacccgtttacggtaccccgttttaaccgggtaccccgggtacggttaacccccgttaacccggtttaccggggttaaccccggggtaaacgggtaaccccttacccgggtaaccccggtaccccgttaaccggtacgttaacccgggtaacccgtacgggtacccggggaacccgggggtaaccccgggtaacccgggtaacgggttaaccggacgggttaccggtacgggttaaccggtacgggttacccttaaggtttacccgttaacgttaacggggttcggtaccgggtaacggggtcggtaaaccggggtaccgaacggttaccgacccggtcccgtaaccggtacccggtcccgttaactaccggttccggttaaccgggttcggaaccggttaaccggacccggttaaacccgggttaccgaacccgggttacccgtaaacccgggttaccgacccgggtaacccg

SEQ ID NO: 183357 - DNA, 671 bp, Homo sapiens
  misc_feature: GYAE6OF01AVXD2.13.76.G10.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
  modified_base (264)..(264): a, c, t, g, unknown or other
  misc_feature (264)..(264): n is a, c, g, or t
  modified_base (412)..(412): a, c, t, g, unknown or other
  misc_feature (412)..(412): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccacgcactccacctgcctacgtagaaataagttcgacanaataatntacttctgtatcacganagaacgtcgacggaccaccgtcccctgtcgtcgtcggtactatctatacaagctagaccacggccgtccagacggtactcccgaggtacgtcgtacttccgtgtccggtactacccgtaacgtcgtacggtaactccgacgtaccctntaccgtaccgtacctacgtccgaccggaccggaacccgtaaggtactaaggtgggacgttaacggcggtacttacgttacgttacggttcgtacggtacgggtacgggtacgggacggtaaccacgtaccggacgtacccgtaccgtacccgtccgtaacgttacgggtttcccgtaaccgttacgggaaccgtaccgggacccgtttaccggaccctaacccggttccgaaaccgttcccggaccccggtaaaccccg

SEQ ID NO: 183358 - DNA, 798 bp, Homo sapiens
  misc_feature: GYAE6OF01CEPGV.13.76.G10.1.454.CMB.1.raw
tcagtcacgtactacacgaccggtgctcgatttagtcactcatacagggtctgggagaggagcccagcactgggattccgaggtgtttccattcggtgatcagcactgaacacagaggactcaccatggagttttggctgagcgttgggttttcttgttgtcttaagttttaaaaggtcgccctaggtggtggtaggtgcagtcgtggtgggagttcgtagggaggaggcttagactccgacggtccgggttcgggggtaccctgacgacctcctcgtgtgcgacgtccgttcggtcggttcctaaccgtcgtacgtaccaaccgtaacctaacgtagttggacggtacggtcgggtccccggccgacggtccgtaccggggtaaggggtaccggggcggtacggagttcggtcgttcttttattttagtttagtaggtttagtaggtaagtacgacttaccgtacgcgtaacgtaccggtacggtggaccggggtacctacgttacccaaccgttactcccgtaacggaacgtaacgtaaacttaaactaacccgtaaacgtaaaccgtacggttacctttacgtttaacttaaacgtaaagtacgtacgacgtaccgtagaacggcgtaccgagtaccgtaccgtaccgggtcgttaacgttaacgttacgttacgggcgtacgggtaacggacggtacggggttcccgggaaccccggtaacgtaacccggtttaccgaacggttccgttacgggaacggttcgggttaaacccggggtcggggaaaaccccggg

SEQ ID NO: 183359 - DNA, 778 bp, Homo sapiens
  misc_feature: GYAE6OF01EUKA2.13.76.G10.1.454.CMB.1.raw
  modified_base (188)..(188): a, c, t, g, unknown or other
  misc_feature (188)..(188): n is a, c, g, or t
  modified_base (281)..(281): a, c, t, g, unknown or other
  misc_feature (281)..(281): n is a, c, g, or t
  modified_base (316)..(316): a, c, t, g, unknown or other
  misc_feature (316)..(316): n is a, c, g, or t
  modified_base (444)..(444): a, c, t, g, unknown or other
  misc_feature (444)..(444): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttggttttctgttgcttaatttaaaggcgaccagtgtgaggtnctagcgtggtggtacgtcgtagggtaggacggtccttggactaccggacgtccgggttcgggggtaccctaggactacctccgtcctggcgcncgtccttggtcggttcaccgctacgtcactacctntacgtgaccgtcgtacgggccctcgtacggtccgaccggaaggggtacgggtcgtagggtcgtagtccgtttcgttttaaccttttagttaaggtagttgttaacggttacgtaactcgttaacccgngtacgaccgtaccgttcgggacggtacgggtacctacgttaccaaccgtaccgttaccgtaacgtaccgggaaactaaccgttaaaccgttaacccgtaaacgaaccgtaccgttacgtttaacccgtttaccgtaaaccgttaaacgtaaacgtacggttaaccgtaacgtacggttaacggacgtacccggaacgtacgtaccgtaccggtacgttacttaccggtacgtcgtacgtaaggacgacggtaccggtaccgggtaacccgtaaaccgtacgttaacccggacgtacgttacggttacggccgggtacggttccggaaaccgggg

SEQ ID NO: 183360 - DNA, 811 bp, Homo sapiens
  misc_feature: GYAE6OF01CINMS.13.76.G10.1.454.CMB.1.raw
  modified_base (136)..(136): a, c, t, g, unknown or other
  misc_feature (136)..(136): n is a, c, g, or t
  modified_base (209)..(209): a, c, t, g, unknown or other
  misc_feature (209)..(209): n is a, c, g, or t
  modified_base (504)..(504): a, c, t, g, unknown or other
  misc_feature (504)..(504): n is a, c, g, or t
tcagtcacgtactacacgaccggtgctcgatttagtcactcatacagggggcctgggcctcaggaagcagcatcgggggtgccgcagccatggcctggaccgctctcctgctgacgcctccttgctctactttacngtcttctgtcggcctctatgagttgactcgacgccactctcgagttcgtaccgacggtccgggaccccggaancggtaccggaccaacctaaccgtttcccgtaggtacgggaaacgggtaaaacctaaccgtttaaggaaacgtccgaaagtaacgttcgtaacccgtagttaccggaaccgacgaccgtaaggtaacggtccgaacgggacccgtaccgggtcccgttgggtcggtaggtacctacttacgtaacgtacgaaagtcgtaccggaccgaaccggcccggtaccgtacggtacgggtaccttcccggagtacggcgttacttccgtcgtcgtacctaccgtacgtcggtacggtaccncgaccgacctactcgtacgaccacgtaccgacggtacccggaccgtagtaccgttaaggacggtagtacgggaacggtacgttacgtaacgtttacgttacggtacggttaccgggacgggtacggggtaacgtacgaacgaccggttaccggaacccttcggtacccggtaccgttacgttcggttacccggtttacgggaacggtaaacccggtacgggtaacccgtaccggtaccccttaaccggttacgtaaccgaccgacccggaacccgtacccggaacccctaccctgtccctaacccgg

SEQ ID NO: 183361 - DNA, 889 bp, Homo sapiens
  misc_feature: GYAE6OF01A54TU.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttagttttaaaaggtgtcccagtgtgaggtgcagtcgtggtggaggtcgtggaggaggtcttgactccgagtcccggttccggggggtccctaggcgtacctcctccgtgtcgacgacgtccgttcgttcgggttccgtacccgtcgtacgtacaacctaaccctaccagtacgacggtccggtcgggtccccgaccgacggtccgtaccggtacggggaacggggtccggtgggaacggtcgttccggtttaccttttacgtttttaacgtttttaagtttaacggtttaagggttacgggtttaacggttaaacgtaacccgtttacccgttaccccggacgtaaccggtaccccgttaccggggtaccggggtaaccgggggttacccgttaacgttaccccgtaacctaccttcccgtacccggtaaagtaaccgtaaaacttaaccccgtaacggtaaaacccgtaaacccgtaccgtttaccgttttacttttaacccgttaactaaaacggtacccgtaaaccgtaacggtcccgttaagggaccgaacgttaccggtgtaaccgaccggtacccgggttacgttagtttacgtacggtacggtcgaccggtagtaccggcggtacccgggaacccgtaacggttacccgtaaacggtacgtcccttaacggggtaccttacccgggtaagggacccggggtaacccgtaaaccgggtccccggg

SEQ ID NO: 183362 - DNA, 917 bp, Homo sapiens
  misc_feature: GYAE6OF01DOR8B.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggtagttttggctgagtcgttgggtttttccttgttgtacttaagttttaaaaggtcgccctaggtgtagtaggtgcgacgtcgtgggtggtagtcgtgggaggaggtcgttcgactccgacggtccgggttcggggggttccctggacgtaccgttctccgtcggtcgccgacgtccgttcggttcggttacccaccgtacgtacgtacctaacctaccgttacgagtcggacgtcccggtaccgggtacccggcccgtacggtaccggacggggaacgggggaacgggtcgtgggacggtcgttcgtttaccttttacgtttttagttaagtacggttaggtaacggttactaaccgtacttaccggtccgacgtacggtacctcgggttacgggacgggtaccctaacgttaccgaccgtaccttaccgtaaccggacgtaaacccgtaaacttaacccgttaaacccgaaaaccggttacccttacccggtttacgtttaacccgttttaaacccgtaactaaaaacggttaaccaacccgggtttacggtacccgtaagggaaccggtaaccccgttaaacggcggtaaaaccccggtccggtttaacccgggtcgtttaaaggtttaaacctcgggtggtaccggaaacgggtccgggtaaacggacccccggggtttacggaaaccccggttaagtaaacccggtttccctcggggtaaaccgttggggtaaccccggtttacggggaccccggtcgggggtaaaacccgaccggggttaaccccc

SEQ ID NO: 183363 - DNA, 723 bp, Homo sapiens
  misc_feature: GYAE6OF01AGH0N.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttttggctgagctgggttttccttgttgctattttaaaaggtgcccagtgtgaggtgcagctggtggagtcgtggaggaggcttgatccagccgtggggggtccctgagactctcctgtgcacgcctcgtcgggttctaccgtctagtccaccacctacagtgacggtcgtcgggtcccgccgacggccgtaccggaggggagggtcgtgggagtcggtcgttctttctttttaactttatagggttagttacgggttaagtactacgttaccgtccagaacgtccgtcggtcggacggggtcctacttaccgacctatccctacgagacgtaacaacgttcaaacgacctacgtcttacgtttactaacgtaagtaccgaacctaggtcccgtaggaaccgtaggtacccgacgtaacggcccgtaacccgggtcgttaacgtttacgtttacgtggtccgtacggagtaccgggtaaccgggtcccggggtaaccccgtaacggttaacccggtttacccgtaacgtcgtaaccgggttcgggtacccggttccggggtaccggggtaacccgtaacggggtaacccccgg

SEQ ID NO: 183364 - DNA, 938 bp, Homo sapiens
  misc_feature: GYAE6OF01A14V6.13.76.G10.1.454.CMB.1.raw
  modified_base (360)..(360): a, c, t, g, unknown or other
  misc_feature (360)..(360): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggtagtttttggctgagtcgttgggtttttcctttgtttgtcttaagtttttaaaggtcgccctagtggtggaggtgcgagcgttgggtggtagtcgtgggaggaggtcttggactccgacggtcccgggttcgggggggttcccctggtaacgtaccttccgttcccgttggtcgcacgtcccgttcggttcggggttccctacccggttcacgttaccacctaaccctaancgttggacgtcggtccggggtcccgccggacgggtcccgtccgggaagggggaacggggtcgtacggggtacggtggttccgtttctttttacgtttttttaagtttaaggttagggtttaacgggttaaggtttaacgttaaacgtaacgtttacccgtaccgtacgaaacggtccgtttacccggggtacggggtaccggggttaccccgttaacgtttcccaacccttaccgttacccgggtaccaacggtaaacgaaacctttaacttaaaccccggaaaggaacccttaacggttccctttttacgttttaaccttaacgaaaagtttacgaaccgtacgtcccggtaagggaacgggttacccaccggttaaccgcggtaaaccccgggtcgggttccctttaagggtttaaccttcggtacggttaccgggaaaggaaagggttcgggtaacccggggtacccggggtaaccccccttaaaagggggtttacccctttaacgggaacccttaccgggttagggtaaccccggtttccggggaccgggttaacccggggggtaaaccccggg

SEQ ID NO: 183365 - DNA, 745 bp, Homo sapiens
  misc_feature: GYAE6OF01DGM2A.13.76.G10.1.454.CMB.1.raw
  modified_base (275)..(275): a, c, t, g, unknown or other
  misc_feature (275)..(275): n is a, c, g, or t
  modified_base (308)..(308): a, c, t, g, unknown or other
  misc_feature (308)..(308): n is a, c, g, or t
  modified_base (334)..(334): a, c, t, g, unknown or other
  misc_feature (334)..(334): n is a, c, g, or t
  modified_base (409)..(409): a, c, t, g, unknown or other
  misc_feature (409)..(409): n is a, c, g, or t
  modified_base (552)..(552): a, c, t, g, unknown or other
  misc_feature (552)..(552): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaggtgcccagtgtgaggtgcagctggtggagtcgtggaggaggcttgatccgagccgtgggggtccctgagactctccgtgtgcacgcctcgtgggttccaccggtacncgtcaccaccttacagtgagtctcggggtcccnccgaggcctccggagggggaacgggngtacgggagttcggcgttacttttcttttaagtttataaggttaggtggttaagtaccgtattaacccgtcccgngaacgtacccgttccgggaggaacggggcccgttaattcctaaccgacttacctaccgaaggaacgaaccctttaaacttcccggaaaagaaaacccgttcgggtacttttaacgttttcccgttaaagaaacgtcggaaacnccgttacccgtaaggaacggacgtaacccaagttacgaacccgtcggggtacccgttagttaccgtttaaggtcgtaggacgaagtaccgggtacggtcccggggaacccctaaagggtacccgttttacgaacccggtacttacgtccgggacggttcggtaaccggggggacccgtaaacgggtaccccgg

SEQ ID NO: 183366 - DNA, 696 bp, Homo sapiens
  misc_feature: GYAE6OF01CN9TZ.13.76.G10.1.454.CMB.1.raw
  modified_base (133)..(133): a, c, t, g, unknown or other
  misc_feature (133)..(133): n is a, c, g, or t
  modified_base (371)..(371): a, c, t, g, unknown or other
  misc_feature (371)..(371): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (447)..(447): a, c, t, g, unknown or other
  misc_feature (447)..(447): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacgnggactccgtggcctccgtatgagctcgactcacgccctacctcagtcgtccgttccgcccgaaggacacgacacgccgacgtcactacctcgtcgtaccttacgtaaggtaaaatttaaggttcggacaaaggtaaattaaacttacgttaccttaccgttaggtactacgaacggtagaacgtacgtcgaaccgtaccgtaccgttccccgtgtcgtacgttcgtctactacactanaagacgtaccacgacgcccgtccgacgnggtacctacgnggactctacttctcgcggcctaccgactggacgaccncacgcctacgtcctacgtaccacgtacggaccggtccggaacgtcggtacgtagtaggacggtacggacgttaggtaacttacgttacgtacgtcggtagaccgggtcgggtagacggtcgaaccgtgaacccgtcggacccgtccttagttaccggtacggttaccggtaaccggtcggggaccgtaaccggaccgtttaacccggtacccgtaaaccgtccgaacccggtaaccccggtaaccccgg

SEQ ID NO: 183367 - DNA, 824 bp, Homo sapiens
  misc_feature: GYAE6OF01BK70V.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacgaggatccgtggcctcctatgagctgactcacgcccaccctcagtcgtccgtcgtccccgaggacacgacacgccagcactccgactcgctcgtaaggaaacttaagttggacaagtaataaagtacttacgttccgtaggttactcgacgactaaggtaacgtccgaccggaccctaccggttacccccgttggtcggtaccgttccggtactacttaccttacgtaaccgaacgtacgtaccgaccgaaaccggtcccggtacccgtacggaacgggtaccttacccgacggtacgtccgttaccgtttccgtcggttaccggtacccgttacccgtaaccgtttccggtaacgggttacctacccgtaccggtaccctaccgttaccgtaccggaacctacggtacccggaaccgggtaccccgggtaaccgacggttacccgtaaggtcgggtaacgtacggacgttaccgtacgttaactttaccggttacggtccgtaaccgggtaggggtaccgggtaagggtaccgacggaccgtacggaccccgtacggtaccccggttccgtaaccggtttcgtacccgggtttacggtaacgggtaaccggtacccgggtaacccgttaccggtacccgttaacccgggtaacccgttaaccgggtaacccgtaccccggtaaaacccccgg

SEQ ID NO: 183368 - DNA, 945 bp, Homo sapiens
  misc_feature: GYAE6OF01E0A3W.13.76.G10.1.454.CMB.1.raw
  modified_base (160)..(160): a, c, t, g, unknown or other
  misc_feature (160)..(160): n is a, c, g, or t
  modified_base (176)..(176): a, c, t, g, unknown or other
  misc_feature (176)..(176): n is a, c, g, or t
tcagtcacgtactacacgaccggtgctcgatttagtcactcatacagggggcctgggcctcaggaagcagcatcggagttgcctcagccatggcatggatccctctcttccctcggcgtccttgcttactgcacaggactccgtggcctcctatgagctnactcacgcccaccctnagtcgtccgtcgtccccgaggaccagacagccagcactccacctgtcctagtacggtaaaattaatcggacaagtaataaatattaccttccgttaggtactaccgagtacgaagtaacgtacgacggtacccctaccgtcccccgttggtcggtacgttggtacctacgttaccttataccgaaagtacgtaccgacccggtaacggacccccggtacccgtacgggtaaccgggtacccttaccccggtacggtaacggtaccgttacccgttttccgttaccggtcccggtaccccttaccccgttaaacccggttcccggtaaccggggtaaaccccttaccggtacccttaacccccgttaacccttacccggtaaccccttaaccctaacggtaccccggtaacccggggaaccccccgggtaacccggtaagggttacccgttaaggggttaccggaacggttaccggtaaccgggtttacccggtacggtttaaaccgttaacccggttttaccgtaacgggttaccgggtaacgggttacccgggtaccgggtaaccggacggtaccggtaaccgccccgttaacccggtcccggtaaccccgttacggttaccggtttccccgggtttaacccggggtaacccgggtttaaccggggtaaaccccgggtaacccgttaacccggggttaaaccccccgttaccgggtttaaaccccttaacccggtaccccggtaaaaccccccggtaaaccccccggg

SEQ ID NO: 183369 - DNA, 758 bp, Homo sapiens
  misc_feature: GYAE6OF01DH8EF.13.76.G10.1.454.CMB.1.raw
  modified_base (416)..(416): a, c, t, g, unknown or other
  misc_feature (416)..(416): n is a, c, g, or t
tcagtcacgtactacacgaccggtgctcgatttagtcactcatacaggggagaggagcccagcactgggattccgaggtgtttccattcggtgatcagcactgaacacagagactcaccatggagtttggctgagctggttttccttgttgcttattttaaaaggtgcccagtgtgaggtgcagctggtggagtctggaggaggcttagatccagccggtcggggggtccctgacgctctacctgtgcagtcctcgtgggttccaccgtcgacgtcacctacctacatggacgtccgtcggggtcccgaccgagggtaccctaccggaagggggaacggggcgtaggacggttgcgttctttacttttagttagtagttacggtggtaatactagtacgtccgacacggactcggnggacgggctactccactatcctaccgaagtaacgtactaaacgttccgaaaagaaccgtcgttacgtttacgtttacttaaccgaaagttaaccggaacctaacgggtcccgttaagaacccggtacgggtacccgtaagttacccgggaacccggtccgggttaccgtttaattaaacggttttcggacggttaacggaccgggaaacggtacggtaccgggtcccgggggtaaaaccccctaacgggtttaaaaccccgttactaaaccggggtacttaaccgggttacggtacccgggttcgggtaaacccggggcggggtaaaacccggtaccccggg

SEQ ID NO: 183370 - DNA, 807 bp, Homo sapiens
  misc_feature: GYAE6OF01EOO0N.13.76.G10.1.454.CMB.1.raw
  modified_base (778)..(778): a, c, t, g, unknown or other
  misc_feature (778)..(778): n is a, c, g, or t
  modified_base (785)..(785): a, c, t, g, unknown or other
  misc_feature (785)..(785): n is a, c, g, or t
tcagtcacgtactacacgaccggtgctcgatttagtcactcatacaggggctgggagaggagcccagcactgggattccgaggtgtttccattcggtgatcagcactgaacacagagactcaccatggtagttttggctggagcgttgggtttttccttgtttgtactttaaagtttttaaaaggtcgtcccaggttggtggagggtgcagtcgtgggtggtagtcgtgggacggaggttcgttcgacgttcccgacgggtccccgggttcggggggtccctacggtacgtacccgttcctccgtgtcgccgtaccgtccgtcgttcgggttacccgaccgttaccgacgtaccaacccgtacctaacgtagtcgacggtccggtccgggtcccgaccggtacggcccggtacgggaacgggggtaacggggtcgtacgggtacggttccgtccgtttacgttttactttttaaagttttagggttacgttagggtttacggttaacgtaaccgtacgtacccgtccgacgtacgtaccgttcgggtacgggacggtaccgtactaccgtactacgtctaaccgagtaacgtaacctaacgtaaccgaaacgtaccgacggtttctttcggtttaacaaccgttaaagtacggaaacctcgggtaacctagggcgttaacgcccgtaagttccggaaacccgttggttaacccgttgttaccgtttgacgagttcgggagtaccggaggtcccgggaccctaaggttacctcgacgtnttacggnggaccgttgggccgggtaaccg

SEQ ID NO: 183371 - DNA, 784 bp, Homo sapiens
  misc_feature: GYAE6OF01BRJ8J.13.76.G10.1.454.CMB.1.raw
  modified_base (335)..(335): a, c, t, g, unknown or other
  misc_feature (335)..(335): n is a, c, g, or t
  modified_base (644)..(644): a, c, t, g, unknown or other
  misc_feature (644)..(644): n is a, c, g, or t
  modified_base (660)..(660): a, c, t, g, unknown or other
  misc_feature (660)..(660): n is a, c, g, or t
  modified_base (736)..(736): a, c, t, g, unknown or other
  misc_feature (736)..(736): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggtttttccttgttgacttagtttttaaaaaggtcgccctaggttgtggagggtcgcagtcgtggtgggagtcggtagggaggggtaggtcttaggactcccaggtcccgggtcggggggttcccctaggacgaccttccgtcccgttggtcgaccgcgtcccgttcggttcgggttcccaacccgtntacgtaccaacccaccgttacagtgtacggtcggtcccgggtccccgaccgtacggtccggtacgggagggggtaacggggcggttacgggtggtccggttcttcctttttagttttaatttaaggttaagggtagttacggtaacgttaactacgtaccgtccgactacggtccggtcggtacgggcggggtacctactcgacctactccgacgtaagaacgtaaacccttagaaaccccaaggtaaccctctttcgtttaaacgtttcaaaccaagttacccgacttacgccgtaagagtacccgangtaaccgcgaccgttntaagttatcggaggtccagggttaaagcggtacccgggttaccgaacccgttagtaacccgttaggaccctacggngtacccggggtaacgtcccggaccggggaaaacgtcccggtaacccgg

SEQ ID NO: 183372 - DNA, 728 bp, Homo sapiens
  misc_feature: GYAE6OF01EHFA4.13.76.G10.1.454.CMB.1.raw
  modified_base (103)..(103): a, c, t, g, unknown or other
  misc_feature (103)..(103): n is a, c, g, or t
tcagtcacgtactacacgaccggtgctcgattttagtcactcatacaggggctgggcctcaggagcagcatcggaggtgcctcagccatggcatggatccctntcttcctcggcgtccttgcttactgcacaggatccggtgcctcctatgacgtctgactcgacgcccacctgagttcgttccgtcgtcccgaggacagacacggccagcactccacgtgctacgtaagggtaaaacttaagttcggacaagtaaataaacttgttacctttacgtaggttatacgaggacaacgtaacgtacgacggtcctaccggttccccgtgtcgtagttcgtacgtactatacaacgtaacgtcgtacgtaacccgaggtacccggtaccgtaccggtaaccggtccgttacccgtagccgggtacttaccgtttaccgcgttacggacccttaccgtaactaccggggttaacggaacctaccggactcccgtaacgttcgtaaccgaaccgtacgtaaccggacccgggtaaccgggtacccgaggttaccgagggtacggtagtcggtaacgtccttaacggactttacttaggacgtacggacgggtgggtaacggctaacgacgacgtacgcccacggtccgtattcgtcggttaccggtacggtaccggaccgggtaacctacgggttaccctccggtaaccgttacgaaccgccggtaaaccccg

SEQ ID NO: 183373 - DNA, 741 bp, Homo sapiens
  misc_feature: GYAE6OF01EB5Z7.13.76.G10.1.454.CMB.1.raw
  modified_base (530)..(530): a, c, t, g, unknown or other
  misc_feature (530)..(530): n is a, c, g, or t
  modified_base (572)..(572): a, c, t, g, unknown or other
  misc_feature (572)..(572): n is a, c, g, or t
  modified_base (696)..(696): a, c, t, g, unknown or other
  misc_feature (696)..(696): n is a, c, g, or t
tcagtcacgtactacacgaccggtgctcgatttagtcactcatacagggggggagaggagcccagcactgggattccgaggtgttccattcggtgatcagcactgaacacagaggactcaccatggagtttggctgagcgtgggttttccttgttgcttaattttaaaaggtgcccagtgtgaggtgcagctggtggagtcgtggaggaggctgatccagccgtgggggtccctgagactctccgtgtgcagtcctcgttcggttcacccgtcgacgttacaacctacctaacagtcgagtcgtcgggtcccgccgtaggccgtccggaagggggaaggggccgtgggagtcggtcgttcgtttacgtttttaatttaaggtaaggttggtacggttaacgtaacgtaagttaccgtaccgaccgaaaggtaacccgttccggtaggggaaccgggggtacccgtaagtttacccaaccctactaccctaaccgaaggaaacgtacctaaaactccgaaaaacgtaaacncccggttatttacgtttccctaaataaaacgtgaaaaccgtncccggtagtaaccggagaacccgtaagtaccaacccgggacggttccgtattaaacttccggtgccgggaagtaaggtacggtagtacccgggggacctaacggtaacccggtttacaaacgtntaaacgggttcggaacctaggtaccggggacctaaacggggaccc

SEQ ID NO: 183374 - DNA, 772 bp, Homo sapiens
  misc_feature: GYAE6OF01CPYJT.13.76.G10.1.454.CMB.1.raw
  modified_base (278)..(278): a, c, t, g, unknown or other
  misc_feature (278)..(278): n is a, c, g, or t
  modified_base (362)..(362): a, c, t, g, unknown or other
  misc_feature (362)..(362): n is a, c, g, or t
  modified_base (723)..(723): a, c, t, g, unknown or other
  misc_feature (723)..(723): n is a, c, g, or t
tcagtcacgtactacacgaccggtgctcgatttagtcactcatacgagggggggggagaggacgcccagcactgggattccgaggttgtttccagttcggtgatcagcactgaacacaggagactcaccatggtagttttggctgagcttgggttttccttgttgactttaagttttaaaggcgcctaggtggtgaggtgcagtcggtggtacggagtcgtgggacgggtacgtcttagacgtccgacggtcccggggtcggggtcctgacgtcctcncgttgcgcgtcgtccgttcggttaggtaccctccgtacgactaccacctaccagtagtcggacggtcggtccggtccggaccgngggaccgtacggggaggggtacggggtcgtaggggcgttccgttcgtttaccttttacgtttttagttagtaggttacggtaggttaactacgtaccgtaccgtcggacgtacggtaccggtccgggtaggggtaccggaccttaactaccgaccttcgtaccgtaccgaagtactaaaccgttactaaccgaaacgtaacgttattccgtttacttacgtaaacgactacgtaacgacggtcgtaacggacgaccgtagtacggtaccgaccggtaccgttggttacgtacgttccggtagtacggacggtagtacggtccggggtaccgaaacccggttggtaaaccctacgtacccgngttacggccgttaacgggccgggtaccgggaccggtaaccgggtacccg

SEQ ID NO: 183375 - DNA, 699 bp, Homo sapiens
  misc_feature: GYAE6OF01ET2YG.13.76.G10.1.454.CMB.1.raw
  modified_base (284)..(284): a, c, t, g, unknown or other
  misc_feature (284)..(284): n is a, c, g, or t
  modified_base (537)..(537): a, c, t, g, unknown or other
  misc_feature (537)..(537): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggtagttttggctgagcttgggtttttccttgttgcttattttaaaaggtgcccagtgtgaggtgcagcgtggtggagtcgtgggaggaggctggatccaggccgtggggggtccctgagtactctctgtgcagtcctctggtcacgtcacgtcacncctacatgagcgtcgggtaccgccgaggcctacccgaggggaacggggctgggagttcggcggtttcttactttttagtttagttagtaggttggtagtaactattactccgacgacgtccgtcggtagggacgggacccgtagttacacctacttcctaccgtaagacggactaacttaccccgaaagaaacctcgtactttcgtttaacttaccggaaattcgaactcgacagtacggaacgtaccgacgngtaccggaaccggtcgttaaccggttatttacgtggtcggtacggaaacggtcggtacgggtaccgggggtaacccccgaagggttaaaccccgttacgtaacccgggttacttaaccgggttagggacccggtttccgggtaccggggggaaacccccggg

SEQ ID NO: 183376 - DNA, 717 bp, Homo sapiens
  misc_feature: GYAE6OF01E1GBT.13.76.G10.1.454.CMB.1.raw
  modified_base (190)..(190): a, c, t, g, unknown or other
  misc_feature (190)..(190): n is a, c, g, or t
  modified_base (201)..(201): a, c, t, g, unknown or other
  misc_feature (201)..(201): n is a, c, g, or t
  modified_base (249)..(249): a, c, t, g, unknown or other
  misc_feature (249)..(249): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
  modified_base (387)..(387): a, c, t, g, unknown or other
  misc_feature (387)..(387): n is a, c, g, or t
tcagtcacgtactacacgaccggtgctcgatttagtcactcatacaggggctgggagaggagcccagcactgggattccgaggtgtttccattcggtgatcagcactgaacacagaggacctcaccatggagttttggctgagcgttgggtttttccttgttgcttattttagagtgtcagtgtgaggtncagctggtggngtcggtgggggggtcttggccagccgtggggtccctgagctctctgtncncgcctntgtattctacttttagtaggtagttggtagtggggttcgggtcccncgacgtcctaccgaagaggaaggacgtgggagtggggtacgaccaaagtaacgtaaagggaatagtagggaaagtagaaaggtntaacgttagttggtagtacctgtaggtaggaacggtcccgtattcaaccctagttccgtacccgaagaacgaaaccgaaccgtacccgaaaagttaacccttacctaacgttagtacgtaccttaggaacccgtaggtaattacccgaccgtaacgccgtaaggagtacggtaccggaagggttaccttagggtcttaggttaagtttgttaagttttcgggacggtacgtaaagggtccgtaaggttcggggaacccttaacggggtaactttaaggtttacgggtaggttaaaccgggttggtaaaccggggtccgggggtaacccgg

SEQ ID NO: 183377 - DNA, 718 bp, Homo sapiens
  misc_feature: GYAE6OF01BXU67.13.76.G10.1.454.CMB.1.raw
  modified_base (183)..(183): a, c, t, g, unknown or other
  misc_feature (183)..(183): n is a, c, g, or t
  modified_base (283)..(283): a, c, t, g, unknown or other
  misc_feature (283)..(283): n is a, c, g, or t
  modified_base (313)..(313): a, c, t, g, unknown or other
  misc_feature (313)..(313): n is a, c, g, or t
tcagtcacgtactacacgaccggtgctcgatttagtcactcatacaggggctgggcctcaggaagcagcatcgggaggtgcctcagccatggcatggactccctctcttcctcggcgtccttgctttactcgcacgaggactccggtcggccttcctatgacgctcgactcacgcccacctcnggtcgtccgtcgtcccgaggacacgacacgccagcactccactgctacgtagaaattaagtggaacaagtaataacttacttacctcgtacgtactcganacgagacgtcacggtcctaccgtccgtgtncgtcgtctactactctaacgacgacgtccgacgaacggtccgaccgtacgacggtcctaccgtcggtacgtccgttacttccgtacggtaccgtaccgttaactaccggtacgtacggaccgtaccgaccgtaccgtcgtaacctaccggaccttaacggacccggaccgggtaccggaaccgtaggtaccgtgaaccggtgggtaccgtacggtacttcggtaacgtttacgtacgtcggtagggaccggtacggtacgggacacgacgacgcctaccggtaccgtccgtacggtttccgaccgggtttaccggtaaaccgggtccggtaacccgggtaccgtaaaccggttaccggttacccgtaaaccggttaacccgcccggaaacccctaaaccccgggg

SEQ ID NO: 183378 - DNA, 847 bp, Homo sapiens
  misc_feature: GYAE6OF01EM4C7.13.76.G10.1.454.CMB.1.raw
  modified_base (319)..(319): a, c, t, g, unknown or other
  misc_feature (319)..(319): n is a, c, g, or t
  modified_base (468)..(468): a, c, t, g, unknown or other
  misc_feature (468)..(468): n is a, c, g, or t
tcagtcacgtactacacgaccggtgctcgatttagtcactcatacaggggggagaggagcccagcactgggattccgaggtgtttccattcggtgatcagcactgaacacagagactcaccatggagttttggctgagtcgttgggttttccttgttgcttaattttaaaaggtcgaccctagtcgtagacggtgcgagtcgtgggtggacgtcgtgggaggacgtcgttgactccgacgtccggttcgggggtaccctgacgtacctctccgtgtacgcacgtccgtcgtcggtcaccgtctcgtaccacctacctanagtgaacgtcgtcggtccacgagtccgtcggaaggggtacgggcgttggacgtggtccgttttactttagtttttaactttacggttaaggtacggttaggttaactaacgtacgttccccgtacggacgtaccggacgttacccgggngggtaaccgggtaccccttaacgtttacccgtaacccgtacttacccgtaaccggaacgttaccgaaaacctttaaccgttaaccgaaaacggtaaccctacccgtacgtttttaccgtttaacctaacgtaaacggttaacgaccgaaccgttcggttaacgacggtaaccggtaactcggtacccggaaccggtttaccgggacccggtttaagttaccgtttaacccggtggtaacgggaaccgttagggaaacccgggttacgggtacccccggggtaacccctaaaacgggttaaccggttcccgaacgggtttactacggggttaccggtaccggtaccggggtaacggaccccggtaaaggtaccccccggg

SEQ ID NO: 183379 - DNA, 1035 bp, Homo sapiens
  misc_feature: GYAE6OF01BVXF8.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttggctgagtcgttgggttttccttggttgacttaagtttttaaaaggtgccctaggttgtggaggtgaccaggtcgtagggtggagtcgtagggagggacggtcgttgacgtcctacggtcccggtcgggggggttcccctggtaacgtaccgttccgttccgttggtacgaccgacggtcccttcggttccgggttaccctacccgttcgaccggttaccaaccctaacccgttacaaggtcggtaacggtcggttaccggggttccccgaccggacgggtacccgttaccggggtaacgggggtaacggggtacggtaggggtaacggtttcgggtacgttttaccgtttttaacgtttttaagtttttaacggttaacggtttagggttagggttaacgtttaaacctaacgttaaccggttcccggtacgtaacgggttacccggtccgggtacggggtaccggggtacccgttacgttaccccgtaactacccgttcccgttaaccgaaccggtaaccgtaaaccccgttaaactttaaacccccgaaaggtaaacccttaaccgggttcctttaacggtttttaaccctaaacgttaaaccttaacggtaaccggtaccgttaacccggtacggtaacgggacggtcccgttaaacgggccgggtaacccgtaacccggggttccggtttaaagggtttacgttaaccggttacggttacggaaaccgggtaacgggtaccggtaaacccgggggtcccggggtttaaaacccccgaacggggttaaaaccccgtttcccgaaaccggggttaaccgtttaacgggttacggggtaccccgggttaacggggttaaccccggggggtaaccggtaaaacccccggggggtaaccccgg

SEQ ID NO: 183380 - DNA, 695 bp, Homo sapiens
  misc_feature: GYAE6OF01BUC3L.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcttccttgccttactgcacaggactccgtggcctcctatgacgctgactcacgcccacctcagtcgtccgtcgccccgaaggacagacacgccagccactccgacctgacttacgtaaggtaaaattaagtggactaagtaaacttaaatacttaccgttccgtaggtaactacgaagtacaagtaacgtcgacggtcccgtacgttcccctgtcgtacgtcggtactacgtactactactaagacgtacgaccgaacggtccgacccgtaggacggtcctacccggagtacgtcgtacgttccgtcgtccggtacctaaccgtacgtacggtacggtaacctcgaccgcctactccgtacaccgtacgtaccggaccggacccggaaccgtagtacgtagtaggtaacgtcggacggtactacgtaacttcgttagtacgtacgggtacggtaccgggtacggtacgacgacgaccggtccgaccgttcccggaccgttcttacggttcgtccggttaaccggacggtaccgtaaccggtacgtacccgtaccgtacgttaaccgcgaacccgaaccccgg

SEQ ID NO: 183381 - DNA, 786 bp, Homo sapiens
  misc_feature: GYAE6OF01CUFAT.13.76.G10.1.454.CMB.1.raw
  modified_base (676)..(676): a, c, t, g, unknown or other
  misc_feature (676)..(676): n is a, c, g, or t
  modified_base (771)..(771): a, c, t, g, unknown or other
  misc_feature (771)..(771): n is a, c, g, or t
tcagtcacgtactacacgaccggtgctcgatttagtcactcatacagggggggagaggagcccagcactgggattccgaggtgtttccattcggtgatcagcactgaacacagagactcaccatggtagttttggctgagcttgggtttttccttgttgcttaagtttaaaggtcgcccagtgtgaggtgcagtcgtggtggagtcgtgggtaaggaggtcttacggactccgacggtcccgggttcggggggtcccctggacgtaccgttccgtccgtggtcgccgtacgtcccgttcggttcgggttcctaccggtctacgtaccacctaaccctaacatggacgtcgtccgggccccgccgacggtccgtaccggaagggggagggcgtggtacggtcgtcgtttactttcgttttaattagtagttacggtagttaacgtactagttaccgtcgacgtacgaccgttccggtaggaccgggtctacgtcccactacgtctacgaaacgtacgaccttaaacgtacccaaaacgggtaccctacgttacgttttaccgtttaccgtaaacgtaaaagccgtaaaacgtccggacccgttaagacgtacgggtactaagtccgggaaaccccgtcggggttattacgttacgttaccgtcgtacggaaaagggngtaacggtacgggtaaccccgggaaccccctaaggttaaaaccggttccacggtagtttccggccgggttaaacgtccggggtaaaccccggggngaaacccgggtcccc

SEQ ID NO: 183382 - DNA, 755 bp, Homo sapiens
  misc_feature: GYAE6OF01AHEP2.13.76.G10.1.454.CMB.1.raw
  modified_base (173)..(173): a, c, t, g, unknown or other
  misc_feature (173)..(173): n is a, c, g, or t
  modified_base (187)..(187): a, c, t, g, unknown or other
  misc_feature (187)..(187): n is a, c, g, or t
  modified_base (192)..(192): a, c, t, g, unknown or other
  misc_feature (192)..(192): n is a, c, g, or t
  modified_base (401)..(401): a, c, t, g, unknown or other
  misc_feature (401)..(401): n is a, c, g, or t
  modified_base (513)..(513): a, c, t, g, unknown or other
  misc_feature (513)..(513): n is a, c, g, or t
  modified_base (610)..(610): a, c, t, g, unknown or other
  misc_feature (610)..(610): n is a, c, g, or t
tcagtcacgtactacacgaccggtgctcgatttagtcactcatacaggggggagaggagcccagcactggattccgaggtgtttccattcggtgatcagcactgaacacagaggactcaccatggtagttttggctgagtcgttggttttccttgttgtcttattttaaaggnccctagtgtgagtncgagngtggtggagtcgtggtagggacgtcgttgacttcccgaggccggttcggggggtcctgacgtaccttcgtccgtgtagctacgtccgttagtcggttcctaccgtcgacgtccactaacccgtatacgtcggatccggttccgggtccccgtcggaccggtccggtaccggaacggggtacggggtcgtagggacgtccggtccgtttntttacgttttagtttaagttacggtaggttacggttaacgtaacgttagtacccgtccgtacgacgtaccgtcccggtaggtacccgggacgtacttacccgaccgttaacncccgttaagacgtaggtacctaaccgtccgaaagaccgtcgtactttacgttactaacgaaattccgaaccgtacgaccgtagtccggaatcccggntaaccggtcgacccgggttagttgttacgtacgtaagtcggaggtacgtacgggtcggtaccggtaaaccgaccgttaagggtcccctaaagtaccggttggtaaaccggtcgtaccgggaccggtaaacggccggttaacccgg

SEQ ID NO: 183383 - DNA, 1092 bp, Homo sapiens
  misc_feature: GYAE6OF01AVNB2.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggtagtttggctgagtcgttgggttttccttgttgtcttaagttttaaaaggtcgtacccagttggtggaggtgcgagtcgtgggtggtagtcggtagggaggacggtctagtacgtccgtacggtccgggttccggggggtcccgtacggaacgttacccgttccgttccgttcggtccgtaccgtaccggttcccgttcggtttaccggggttaccccgtaacccggttaccgtaccggttaaccccgaacccttaacccttaaccgtaaggttcgggtacggtacccggggttcccggggtacccccgggtaccccgggtaacccgggttacccggtaacccgggggtaacggggggggtaaccgggggttaccgggttacgggggtacgggttcccgggtttaccggtttttaaccgtttttacgtttttttaaagttttaacgggttaacgggtttaagggttaacgggttaaccgttaaccgttaaccggttaacccgtacccggtaacggtaaacccggtccggttacccggggttacgggggtacccggggtaacccgttacccgttaacccgtaacccgtaccgtttaacccgacccgtaaaacggtacctaaacccgtttaacccggtaaaacgtaaacccgaacccgtttcccggtttaagtttacccgttttaaacctaaaaccgtaaggtaacccggaaacctccgggttaaccgtaacgggtaacccgaaccggttaccgtacccgggaaaggtaacccccgggtacggggtttacccctttaaggttacccggtttaaccgggtgtaaacccgggaacgggttagggaaacggggttccccgggaacccgggttaaacccgtaaccgggttttaaaacccggccgtttaaccggaacgttaggggttacccccgggaaaggttccccggggaaccccggggtaaacccg

SEQ ID NO: 183384 - DNA, 833 bp, Homo sapiens
  misc_feature: GYAE6OF01CKWZ7.13.76.G10.1.454.CMB.1.raw
  modified_base (230)..(230): a, c, t, g, unknown or other
  misc_feature (230)..(230): n is a, c, g, or t
  modified_base (470)..(470): a, c, t, g, unknown or other
  misc_feature (470)..(470): n is a, c, g, or t
tcagtcacgtactacacgaccggtgctcgatttagtcactcatacgagggggggagaggacgcccagcacgtgggattccgaggtgtttccattcggtgatcagcactgaacacagagactcacgatggtagtttggctagacgtcgttcgggtttttccttggttagacctttaaagttttaaaacgggtcgacccgtaggtgtggtacggtgccgagtgtgggtaggngtcggtgggtaggacggtcgttcgacgtcccgacggtccgggttcgggggttccctaagcgtcctcgtcctaggtaccgcgacgtccgtcgttcgggtaccacgttactcgtaccaacgtaccgtacagtcggcggtccggtcggcccgtagcgggtaccgacggggaagggtcgggcgtaagggtcgtacggtcgtttccttttagtttaagttgttaaggtggttagtaacggttacnccgttacgtcccgtaagcgttacgtccgggtaaggtacggtaccttcgaacctacggttccacgtaccgacggtaaccgttaacctaccgaaaccgtaacgtaccgtaacgtttacgttacctttaacgtacctaaccgtaacgggtactaccgggtaacgtcggtaacggaaccgttaccgtaaaccggtccggtacccggtaaccgggtactttaacgggttcccttaaacggttcggacggtagtaacgggtccggttaaccgggaccccggtaacggttaacccgtaccggttaccgaccgttagttaccgggaacggttccgggtaacggtaccggggaccgtaaccggtaacccggg

SEQ ID NO: 183385 - DNA, 874 bp, Homo sapiens
  misc_feature: GYAE6OF01BG4PN.13.76.G10.1.454.CMB.1.raw
  modified_base (717)..(717): a, c, t, g, unknown or other
  misc_feature (717)..(717): n is a, c, g, or t
tcagtcacgtactacacgaccggtgctcgatttagtcactcatacgaggggggaggaggagcccagcactgggattccgaggtgtttccattcggtgatcagcactgaacacagaggactcaccagtggtagtttggctgagcgttggttttccttgttgacttaattttaaaaggcgacccaggtgtaggaggtagcaggcgtgggtgagtcgtaggaggagtcttagactccgagtccggtgggggtccctggacgactccgtccgtgcgacgtacgtcctcggtgggttaccaccgtacgacgtacctaacctaaccgtaagacgttacgacggtcggtaccgggtaccgtaccgacgggtccgtaaccgggaagggggtaacgggtaccgtgggtacggttccgtcgttttaccgttacggtttttaaagttaggttaaccggttaagggttaacggttaaacggttaaacctaaacggtttaccccggaccgtaccgtaaaccggtccgttaaccgggacgggtaacggggtaccctaaacggtttaccaaacccgttagttaccccgtaaaccggtaaggtaaaccgtaaccctaaacgtttaaccccggaaaagggtaacccgtaaaccggttcgttttaacgttaaacctaaccggtaaaagttaccgaaacgtacgtacccgtaacgggaagaaccgtaccgggtaanacccggtaaaccgtccgggttaacgttaacggtaacgttaccgtaggtaacggaacgttaagggacccgttaagggttacccgggaaccctaacggtaacttaccgacgttacgtaacgtggtaccgggtacgaacggggtacccaaaggggtaccc

SEQ ID NO: 183386 - DNA, 588 bp, Homo sapiens
  misc_feature: GYAE6OF01ECCEQ.13.76.G10.1.454.CMB.1.raw
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (448)..(448): a, c, t, g, unknown or other
  misc_feature (448)..(448): n is a, c, g, or t
  modified_base (460)..(460): a, c, t, g, unknown or other
  misc_feature (460)..(460): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggtcacgtcagtcanacctanatgngctgggcnccaggctccgagggaaggggctggagtgcgttctcttttattatagtagtggtagtacatactaccgcagactaccggtggtaagggggcccgtaagttcccaactactctcccgaagaagaacaaactttcccaaagaaacacgctgttttcctanaaaagtgaaacngtaccctggaagagccgaatacgacaccgggcctagtaacgttactgtgacgaagagacgtgggggacccctaaacggaaacttaccgacgtacttaagtggggaaccgtccgtgggggaaacccccg

SEQ ID NO: 183387 - DNA, 623 bp, Homo sapiens
  misc_feature: GYAE6OF01CWAHT.13.76.G10.1.454.CMB.1.raw
  modified_base (256)..(256): a, c, t, g, unknown or other
  misc_feature (256)..(256): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttgggctgagcttgggttttccttgttgctaatttttaaaaaggtgcccagtgtgaggtgcagctggtggagtcgtggagggaggcttgatccagcgtggggggtccctgagactctcctgngcacgcctgtgggttacaccgtcagtcacacctacgatgagcgtgggtccaccaggcctccgaggggaaggggcgtgggagtgcttcttcttttattatagtagtggtacgtanatactccanacgactccggnggacggggccattccaaccactactaccagaacgaacgtaaacttacccaaaaggaacctaacgcgttacgtttaccttaactaaatacggaacacgcctacgagaacgccgatacgaccgacggtaccgttagtacgttatggtgacggagtaacggaaggtaccgggacccgaaaccgtaaaccgttactaaccgtactaaggtaggaacggtccggtcggggaaacccgg

SEQ ID NO: 183388 - DNA, 737 bp, Homo sapiens
  misc_feature: GYAE6OF01BT47C.13.76.G10.1.454.CMB.1.raw
  modified_base (717)..(717): a, c, t, g, unknown or other
  misc_feature (717)..(717): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatcggtagtttggctgagtctgggttttccttgttgtacttaagtttaaaaggtcgacctagtgtggaggtgcagcgtggtaggtgtcgtggaggtacggtcttcgactccgacgtccggtacggggggtccctaggaacgtctccgtcgtggtacgctacgtcctcggttcggtacaccgtgacgtaccacacctacagtacgtacgcggtcggtccgccgaacgtcgtaccggaagggtagggtccgtggacgtcgtaccgtttactttacgtttaagttacgtacgtaggttacgtaataaccgtatacccgtacggctaacgtaccgttcgggtacggacgggtaccttagtccctaaccgtactccgtaccgaagtaacgtaacgttaccaaacgaaacgtaccgtacgtctttacgttaacttacgaaagttaccagtaccgtaccgtagaacgacggtacaacggtcgtaaccgtcggttaagtacttaccgtaggtaccgacggaagtacggtacggtacgggtaacggggaccccttaaacgggtaccgtacgtacccgtagtaccgtacggggttaaccgngggtacccgggtaaaaccgg

SEQ ID NO: 183389 - DNA, 818 bp, Homo sapiens
  misc_feature: GYAE6OF01DDZWN.13.76.G10.1.454.CMB.1.raw
  modified_base (696)..(696): a, c, t, g, unknown or other
  misc_feature (696)..(696): n is a, c, g, or t
tcagtcacgtactacacgaccggtgctcgatttagtcactcatacgaggggggagaggagcccagcactgggattccgaggtgtttccattcggtgatcagcactgaacacagagactcacatggtagtttggctgagtcgttgggttttccttgttgtcttaagtttaaaaggtcgccctagtggtgaggtgcagtcgtggtggagtcgtggtagggaggtcttgactccgaccggccgggttccggggggttccctaggtaacgtccgttcgtcggttgtcgcgtacgtccgttcgtaggtttaacgtttttacggtttacgtacgtaacgtttactaccggtaacctaacggttaggaccggttccggtcccggggtcccccggtaaccccgacgggtacccgtaacccggggaacgggggtaaccgggggttccggttaggggttaaccggggtttttcgggggtttttaccgggtttaaaggttttcgggttacgtttccccgttagtttaggttagtaaggtacgtacggtaactaacgtaacttagttaacgcgtaaccgtacgttaacccgtacggtacggtcctaccgtacctaccgtacttccgacgaacgtacgtaactaaccgtacaaacgtaacctaactacgtactatacggtataacgagtaacgtaacgagtacccgggngaccgggacggtaccgaacgtcccgggttacttcgttaccgtactaccgtgtaccggtaaagaagttagttaacggttgtaaagtgtagtacgtagtccgttacgacgttttaccgttaacg

SEQ ID NO: 183390 - DNA, 1058 bp, Homo sapiens
  misc_feature: GYAE6OF01CEMUH.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagaggactcaccagtggtagttttggctgagtcgtttcgggtttttccttgttgtactttaaagttttaaaaacgggtcgacccgtaggttggttaggaggtcgcgtacggtcgtgggtggtaggttacggtagggtaagggtacggtcgtttacggtaactacccgtacgggtccggggtttccggggggtccccttaggaaccgtccgttccgttccgtgtcgtcgtacggtccgttccgggttcggttacccgtaccggttacgtaaccgtaccctaaccttaccgtaaccgagttcgggtacggttcccggttccgggtaccccggtaacccggtaccgggtacccgggtaaccgggggtaacggggggtaacggggtcccggttaagggggtaccgtttccgggtttaccgttttaaccgttttttacgtttttaaacggtttaaggtttaacggggtttaacggttaacggttaacgttaaccgtaacccgtttaacccggtaccccgtaaccggtaaccggtttaccgggttaaccgggttccggggtaacccggggtaccgttaacccttacccgtaaccccttacgttaccctaacgaacggttaaccctaaacggtttaacccgttaaacgaaacccggtaaaccctttaccggttcttttaacgtttacgttaaacctaacggaaacgtaccggtacgtacccgttagggaaccgttaccgacggtaccgtaacggtaccccggtacggtttacggttaactttaccggttagacgggttaccggagtaacgggtaaacccgggacggttaaccccggtaaaccccgtttacccggttaaacggttacccgtaacgggtttaaccgttcgggtaacccggggtttacccggaggggtaaaacccccgggggtccggaaaccccgggttaccccgg

SEQ ID NO: 183391 - DNA, 917 bp, Homo sapiens
  misc_feature: GYAE6OF01BS6Y8.13.76.G10.1.454.CMB.1.raw
  modified_base (810)..(810): a, c, t, g, unknown or other
  misc_feature (810)..(810): n is a, c, g, or t
tcagtcacgtactacacgaccggtgctcgatttagtcactcatacaggggggggagaggagcccagcactgggattccgaggtgtttccattcggtgatcagcactgaacacagacggacctcaccagtggtagttttggctaggagtcgtttgggttttccttgttgtactttaagttttaaaaggtcgacccgtaggttggtacggaggtcgacgaggtcgttgggtaggtacggtcggtaggggaacggtcggtcttacggacctccgtacgggtcccggggttccgggggttacccctaggaaccgttccttccgtaccggtgtccgaccgtcggtccccgttacgggttaccggttaccacccggttacgtaccgtaaccctaaccgtaaccgtaacgtaggtcggtaccggttccgggtccggtacccgacccggacggtcccggtacggggaagggggtaccggtcggtacgggtacggttcgttaccttttacgttttaacgttttaggtttaaggttaggtttaaggtaccggttaacttacctacgttacccgtaccgacggtacgttacccgggtacgggtacgggaaccgggttaccctacgttaccccgaaccgttaccgttacccgaacgtaacgtaacccgttaaaccttaacccgtaaacgtaaaccgttaccggtaaccgtttcttttaaaccgtttaacccaaagtaacgttaacgaacccgtacggtaccggtaagaccgtaccggtaacgtacgtaaccgggtcccgtaacggttcgttacgttaaccgngtacggacggagtaccggagggtaccggtacccgtaacgttaacgacccgtgtacggtacgtccggtaacgggccggttaaccggacgggacccgacggtaaccccg

SEQ ID NO: 183392 - DNA, 866 bp, Homo sapiens
  misc_feature: GYAE6OF01DE83S.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggccgttccttgcttactgcacaggactccgtggcctcctatgagctgactcagcccaccctgagtcgtccgtcgtaccccgaggacaagacgacgccacgcactccacctcgactcgtaaggtaaataagttggactaagaaataaacttacttacgttacctaggtactacgagacaaagagtacgacggcctacgtccctaggtgtacgtcggtactattactacgtacaagtacgtcgaaccgacggtccccggacccgtaagggaccggtaccttacccggtagaccggtacggttacttccgtacgtttccggacccttaccgtacgttccggtaacggaaccttaccgaacctaccgtacctcggtaaccgaacccggttaactaccggggaacccggaccccggggttaaccgaacggttacgttacccgggtggtaacggtacggggtaccctacggttacggttaaaccttttacgggttaccgtacggggtaaccgggtacggggtaccgggtacgggaaccgttacgggaccctagggttaccccgtaacccgggttcccaacccggtttacggtaccggttttacccgggtaaaccgggttaaaccccgggggtttaacgggtaaacccggggtaaaccccccggttaaccgggggttaaccccccttaacccggggtttaaaaccgttaacccccgggtaaacccgggtaaccccggttaaacccccccggtaaaccccggg

SEQ ID NO: 183393 - DNA, 721 bp, Homo sapiens
  misc_feature: GYAE6OF01CAN0U.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagagactcaccatggagttttggctgagtcttgggttttccttgttgcttattttaaaaggtgcccagtgtgaggtgcagctggtggagtctgggaggaggtcttgatccagccgtgggggtccctggacgactctcctggtgcgacgtcttcgttggttccaccgtcacgtcactacctactatgatcgcggtccgcgacgtcgtacggaggggaacgggcgtggaggtcgtcggttctttacttttaatttaagttacggttaggttacggtacgtaacgtacttacccgtccgacgtacggaccgttcggtgggaaccggggtcctagttcccacctactcctaccgaagaccgtaacgtaaacttacgaaacgtaaccctagtcccttttacgtttaacctttaacgaaactttacggaacaccgtcgtaacgaacggtaccgacgtaacgtcggtaccggtacccgggttgttaacgttagttaaccgtggttacgcgggtaaagtcggtaacggcccggggtaaaccccttaagggtaaccgtaacgttaacggtcccttaaagggtccggaccgggtttcccggacgggggtaaacccccg

SEQ ID NO: 183394 - DNA, 730 bp, Homo sapiens
  misc_feature: GYAE6OF01B5VBB.13.76.G10.1.454.CMB.1.raw
  modified_base (508)..(508): a, c, t, g, unknown or other
  misc_feature (508)..(508): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctcctatgagctgactcacgcccacctcagtgtccgtcgtccccaggacagacagccagccactcacctcgctactaggtaaacttaagttggacaagtaattaaatacttaccttcctaggtaatcaagacagtaagttcgacggcctacgtccccctagtcgtcgtaggtaccatctatacgaagactagacccgaaggcccggtcccctacgaccgggtacctcccgtagaccggtacgtacgttcccttcgtcggacccttaccgaaccgttcgtacggtaaccctcgtaacgtaccctaccgtaccgtaccgtacctaacgtccggacggtacccgggaacccacgggtaccgtaaggngggtacgtcgggtacggtaccgtcggtttaacttaaaccgtttgtcggtaccggacgggtacgggttacgggacttaacgggaccgacggtcccgaacgttccgtccccggttacgttaccgttaccggttacggtaaccgggtacccggtaaccgggtaaacccgtacggggtcccgttaacccggtaacccgttacaccggtaccccggtaaacccccgg

SEQ ID NO: 183395 - DNA, 800 bp, Homo sapiens
  misc_feature: GYAE6OF01BXVIG.13.76.G10.1.454.CMB.1.raw
  modified_base (691)..(691): a, c, t, g, unknown or other
  misc_feature (691)..(691): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgtctattttaaaggtgcccagtgtgaggtgcagcgtggtggagtcgtgggaggaggcttggatacccgacggcccggttcggggggtcccctggacggtaccttccgttcccgttggtcgaccgtacgtccgttcgttcggggttccaacccggtcacgtccaactaccctacatggacgtcggtccgggtcccgaccggacggtccgtaccgggaagggggacgggtcgtgggtagttcggtccgttcgtttacttttagtttaagtacgttaggttaggttaactacgtaacgttaccgtaccgtcgaacgtaccggttaccggtagggcggggtaccgtaactttcccgaacctaccgttaccgtaccgaagaaccgtaaacgtaaccttaacccggaaacgtaaaccgtccgttacctttacggtttaaccttaaccgtaaagttaccgaaacgtcgtacccgtaggacgacgtaccgaagtaccgaccggtacggtccgttagttacgtacgtggtacgtggaaacggnggtaaccgggaccggtacccggtaaacggttaacctaccggttaagtacccgttaaggtcccgggtacggttaccgggtaccgggaacccggtaacccggtaacccggg

SEQ ID NO: 183396 - DNA, 801 bp, Homo sapiens
  misc_feature: GYAE6OF01EDG2H.13.76.G10.1.454.CMB.1.raw
  modified_base (596)..(596): a, c, t, g, unknown or other
  misc_feature (596)..(596): n is a, c, g, or t
  modified_base (610)..(610): a, c, t, g, unknown or other
  misc_feature (610)..(610): n is a, c, g, or t
tcagtcacgtactacacgaccggtgctcgatttagtcactcatacagggctgggagaggagcccagcactgggattccgaggtgtttccattcggtgatcagcactgaacacagaggactcaccatggagttttggctgagtcttgggttttccttgttgcttaattttaaaaggtcgccctagtgtgaggtgcagcgtggtggagtcgtggaggaggtcttgactccgaggtcccggtcgggggtccctaggacgtaccgtcctccgttggtgccgacgtccgttcgttcgggttaccaccgtctacgttaccaacctacctaacagtgacgtccggttacgggtcccgaccgacgggtcccgtaccggaagggggaacgggtcgtgggtacgtcgtccgtttactttactttttaagtttagtaaggttaggttacggttaacgttacgtacgttaccgtcccggacgtaacggtacccgttacggtacgggacggggtaccctatttacccgaacctacgtccgtaccgaacgtacgtaacttaaccgttacccgaaaacgaaccttacggtccttttacgtttaaccctaanaaacgtacggaacncgtactgaacgccgaacgtacgtacgtaacgttccggtacgttaggttaccttacggttcgagggtaccggtaagtaccgggtaaccgggtacccggggtaccccctaaacgggtaacccgtttaccgaacccggtacgttaaccggggttaaccgggtaccgttcccgggggaccggggtaaacccccgg

SEQ ID NO: 183397 - DNA, 607 bp, Homo sapiens
  misc_feature: GYAE6OF01AWW61.13.76.G10.1.454.CMB.1.raw
  modified_base (102)..(102): a, c, t, g, unknown or other
  misc_feature (102)..(102): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
  modified_base (314)..(314): a, c, t, g, unknown or other
  misc_feature (314)..(314): n is a, c, g, or t
  modified_base (442)..(442): a, c, t, g, unknown or other
  misc_feature (442)..(442): n is a, c, g, or t
  modified_base (515)..(515): a, c, t, g, unknown or other
  misc_feature (515)..(515): n is a, c, g, or t
tcagtcacgtactacacgaccggtgctcgatttagtcactcatacaggggctgggcctcaggaagcagcatcggaggtgcctcagccatggcatggatcccnctcttcctcggcgtccttgcttactgcacaggactccgtggcctcctatgagctgactcagccaccctcagtcgtccgtgcccaggacngtacngcagcatcgacctgctctaggaaacttaagtcggacagtataaatacgtacttccgtaggtactcagctagaacgtnaacggcctacgtccctgtacgctggcatctatacanaacgngacaacggccgcccgtagacgggacttccgtggactcggtcttacgtcgtacgtcctaccgtacgtacgtcggtaaactccggaacctctaactctacgacctacggtcacccgggccggttacccgnggtaacctgttaggacgtagcggtactacggtacttacttacgtgtcgaacgggttcggacgcgagacggacncgttaccgcgacccgttacgtcgcgttccgttaacggcgtaaccgggaacttaccggtccgttacccggattaaccgcgacccgaaccccgg

SEQ ID NO: 183398 - DNA, 854 bp, Homo sapiens
  misc_feature: GYAE6OF01ANMCZ.13.76.G10.1.454.CMB.1.raw
  modified_base (368)..(368): a, c, t, g, unknown or other
  misc_feature (368)..(368): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggtttttccttgttgacttaatttttaaaaggtgtaccaatgtgagctgcagcgtggtggagtcgtgggggtaggtttggacagccgagggccgtcctgagtactcctccgtgtcgcacgccttcgtcgggttccaccgtcgacgttcacctacctacagtcgacggtcgtcggggttcccgccgtagggccgtaccgggaagggggtaacggggcgtaggggngttacggtccgttttctttactttttaagtttagttaaggttgggttaggttaacgttaccgtaaactttccggtacccgtaagtaacggtaaccgtttcccgggtaagggaaccggggttcctaacgtttaccccgaaccttacgttacccgttaacccggaaggtaaaccgtacttaaaaccgttcccgaaaaacggttaacccgtaacggtttaacccgttttgtttttaaccctaaaaccgtaaagtttaaccggaaaccgtaaccggtaccgttaagggaaccgggtactaacccgggttacggtacccggtaaccggttacccggggtaccgtttaaggtttaccgtttacgcgggtaacggaacggtacggtagggtacccggtacgggtaacccccgaaggtttaaccgttacggacgttaccgttaaggccggtaccggttacgggacgggacccgaaacgggttcccgtaacccgg

SEQ ID NO: 183399 - DNA, 854 bp, Homo sapiens
  misc_feature: GYAE6OF01APBTD.13.76.G10.1.454.CMB.1.raw
  modified_base (684)..(684): a, c, t, g, unknown or other
  misc_feature (684)..(684): n is a, c, g, or t
  modified_base (696)..(696): a, c, t, g, unknown or other
  misc_feature (696)..(696): n is a, c, g, or t
  modified_base (706)..(706): a, c, t, g, unknown or other
  misc_feature (706)..(706): n is a, c, g, or t
  modified_base (755)..(755): a, c, t, g, unknown or other
  misc_feature (755)..(755): n is a, c, g, or t
  modified_base (796)..(796): a, c, t, g, unknown or other
  misc_feature (796)..(796): n is a, c, g, or t
tcagtcacgtactacacgaccggtgctcgatttagtcactcatacagggggggagaggagcccagcactgggattccgaggtgtttccattcggtgatcagcactgaacacaggaggacctcaccatggtagttttggctgagtcttgggttttccttgttgtactttaagttttaaaaggtcgacccgtaggttggtaggaggtcgactggtcgtgggtaggacgttcgtgggagggacggtcttgacgtcgacggttccgggtcgggggtccctagtacggtaccttccgtccgttgcgtacgcgtcccgttacggttcggttacccaaccgtcgtacggtaacccacgtaaccctaccgtagtacggtacgtccggttcccggggacctacccggacggtaccggtccggggaaaacggggggtacgggtcgggtaacggtccggtcggtttcccgttttacgttttagtttttaagtttaacggtagggtttacgggttaacggttaaccggttaactacgtcccgtacccggtaaccgtaacggtttacggtcccgggggacggttaaccgggggtacccttcttaaccccgacgtccgacccgttaacgaaggtaacctaaacctaaccgtaacgtaaccgtacttccggtttaacttacctttaacgaccgttaaanaccggttaaccncggtacgtanaaccggtaccgtacggacgacggtccgttacggactttggaacttcggngaacgtgggacgtacggcggtcccgaacgtaaggttacccncggttacaccggttacggtcggacccggtagggccgggtaaacgcccggggttaaccc

SEQ ID NO: 183400 - DNA, 779 bp, Homo sapiens
  misc_feature: GYAE6OF01A7YI8.13.76.G10.1.454.CMB.1.raw
  modified_base (512)..(512): a, c, t, g, unknown or other
  misc_feature (512)..(512): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctggagcttgggtttttccttgttgcttattttaaaaggtgcccagtgtgaggtgcagcgtggtggagtcgtggaggaggtcttgatccagtccgtcgggggtccctgacgactcctcctgtcgcacgccttggttcgggttccaccgtcagtaccacctaccgtacacttggacggtccggttcggggtaccccgacccgagggtccgtacccgggaaagggggtaaccggggccggttagggacggttcggtccggttttacgttttactttttaagttttacgtagggttaacggttggttacgtacgtacttaacgttcccgagtacgtacgttccggtagggacggggtccgtacttaccgactacttaccncctaagaacgactaactaccgaaacgactaacgtcgtttactttaccttacgaaagttacgaaccgtaactacccgtagggacgaacggtcccgtaaggtaccgtaaccggtacccgggtacgttttaaggttacctttaacgggtcgtacggttacgggaagtgggtaaccggtccgggaaccccggtaaggttaaacccgtttaccgtaccggtcttaagggttccgggaacgttacggggacgggtcccggaaacggggtcccg

SEQ ID NO: 183401 - DNA, 709 bp, Homo sapiens
  misc_feature: GYAE6OF01ASGLR.13.76.G10.1.454.CMB.1.raw
  modified_base (527)..(527): a, c, t, g, unknown or other
  misc_feature (527)..(527): n is a, c, g, or t
  modified_base (649)..(649): a, c, t, g, unknown or other
  misc_feature (649)..(649): n is a, c, g, or t
tcagtcacgtactacacgaccggtgctcgatttagtcactcatacgagggggggagaggagcccagcactgggattccgaggtgttccattcggtgatcagcactgaacacagaggactcaccatggtagttttggctgacgtcgttgggttttccttgttgtcttaattttaaaggtcgccagtcggtgaggtgcagtcgtggtaggtcgtcgtgggaggaggtcgttgacgttcccgaggtccggttcggggggtaccctggtacgtacttccgtccgtggtccggacctcggtccgttcggttcgggttacctaccggttccgaacgtaccaaccgtacccgttacgacgttcggtacgtccgtggggtccccgcgtacggccgtacgggaagggtacgggcgtaggtcgtcgtacgtttctttacgtttaattcgtagtacggttggttaactacttacgtacgtccgtaacacggtaccgtaccggtaggaccggggtccttaaacgtcctacctaccggtntacccgaggtaacaactaaccgtacaaccgaacgtactacttggtttaccaactaacgtacgaacacgtccctaagtacgccacgacgtcgacgtacggtactggtaacttcggcgtcgagngaacgtccggtacgaccgtagtacgtctaggctggtgacggtcgacggtcgacgtacccg

SEQ ID NO: 183402 - DNA, 916 bp, Homo sapiens
  misc_feature: GYAE6OF01BMKG2.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcacgcccacctcagtcgtccgtcgtcccaggacagcagccagcactcacctgcctagtacggtaaattaacgttggactaagaattaaattacttacttaccgtaggtatcgaacgacgtaaggtaacgtctaacggtaccccgtacgtttccccccgtggttaccgtaccggtttacggttacctaattacccttaaagttaaccgtaaagtaccgtacggtaacccggtaaacgggtacccccgggttacccccgtaccgggtaagggtacccttaccccggttagggaaccggtaccggtttaacctttccgggtacgttaccgggtacccttaacccgtaaacccggtttccgttaaaccggggaacccttaccgaaccgtaccctaccgttaccgtaccgtaaaccttaaccggtacccggaaccgggtaaacccgggacccgtaacgggttaccttacggtaacgggtaaggttaccgtaacggacgtttaacttaaaccgtttaacggtttaaccggtttacgggttaaccgggtaacgggtaacggggtttaccgggaaacgacccgggttagaaaccccggtaaccgtcccgggttaccccgggtacccgtttaggttacccggtttaaccggtttaccgggtaaccggggttaaacccggaccggggttaaaacccggttacgtaacccccggttaacccggttaacccgtaaccggtaaccggaaacccccggttaaaaccccgggg

SEQ ID NO: 183403 - DNA, 694 bp, Homo sapiens
  misc_feature: GYAE6OF01ASKA0.13.76.G10.1.454.CMB.1.raw
  modified_base (659)..(659): a, c, t, g, unknown or other
  misc_feature (659)..(659): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctcctatgagctgactcagcccacctcagtcgtcccgtcgtaccccgaggacacggacacgcccagcctacgtccacctgaccttctaggaaaactaagttcggactaagtaataaacttacttaccttcccgtaggttaactcgaacgacgaaggtaacgtccgaacggtccctaacgtcccccgtaggtcgccggttcgtcaacgttctaacggtaccaaggtcttacgacccgtaaggtcccggtacccctagtaaccgggtcctaaccccgtgaacggtccttaacgttccgtacgtcgggtaccctcgtaaaccgtcggtaggaacccttcacggtaccctacgtaccgtactaccgacgttcgaccggtaccggaccgacggtacgtagtcgtacgcggtacgacgtcgtaacgttcgtacgtcgtcgtacggtacggtcggacgtacgacgacgacgtacctccggcctacggtacgttcgtaccggtacggtaacgtccgggtaacncgtaaccgttcctactaccgtcgtacgtaaccccg

SEQ ID NO: 183404 - DNA, 783 bp, Homo sapiens
  misc_feature: GYAE6OF01EGKCR.13.76.G10.1.454.CMB.1.raw
  modified_base (172)..(172): a, c, t, g, unknown or other
  misc_feature (172)..(172): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacgaggatccgtggcctcctatgagctgactcagcccaccctnagtcgtccgtcgtccccaggacagacacgccaggtacttaccgtgggtacggggaaacaacgtagttaggaaagtaaaagtgtacgcacgtacggtaccagacgaacgaacgccgacggacccgacggtccctggtcgcgttcggtccgttacttagttggttacgtaagttaccggcccggtacccggcccgtcggacgggtacctcccgtaggacggtcgtacgttccggtccgggtaccttaccgaacgttccggacgggtaaaccgcccggtaccctaacgtccgtaccggaacctacgtacgaacgggttacgggtaaccgggaacggggtcccgggtataccggggaacggtacccgttaacttcgttacgtacgtcgggtacgggttgggtaggtaacgtttaggtcggttacggtggacgtcgttaggttgggttacgggtagggttcccgggaagggtaaccggtaaccaacggttccggaccggttaccggtggtaacccgacgggtaacccgacgggttcccgtccccggtccccccggttacgtacccgtacccgttcccgttaccccccgttcccctacccgtttccgttaaacccgg

SEQ ID NO: 183405 - DNA, 790 bp, Homo sapiens
  misc_feature: GYAE6OF01DDGVE.13.76.G10.1.454.CMB.1.raw
  modified_base (217)..(217): a, c, t, g, unknown or other
  misc_feature (217)..(217): n is a, c, g, or t
  modified_base (305)..(305): a, c, t, g, unknown or other
  misc_feature (305)..(305): n is a, c, g, or t
tcagtcacgtactacacgaccggtgctcgatttagtcactcatacagggctgggaggaggagcccagcacgtgggattccgaggtgtttccgattcggtgatcagcactgaacacagaggactcaccatgggtattttggctgagtcgttgggtttttccttgttcgtcttaatttttaaacgggcacccgtagtggtgaggttcgcagtcgtgggnggtacgtcgtagggaaggcggtctttacgaactccgacggtccgggttcgggggtaccctagaacgtccttcgtccgttgtccggacnccgtccgttggttaccggttaccctccggtactaccgtacctaaccaccttacagtacgaggccggttcggtaccgcgtacggtcccgtacgggaagggggtacgggtcgtcggtacggtcgtccggtttacttttcgttttaagtttaccgtaggttacggttacggtaatacgaccttaccgcgactacggccgtcggggacgggtacccggcgttactacccgtctactttccgacccgaagtaaccctaacgtacctaaacccgtaacggaacccgttacgttccggttttatttaacctaaacggaaccttgaacccgtttgacgtaaggtccggaactcgtaacgtagtacccggagttccctttagtacgtacgtcgggtccacgggtaagtacgggtccgggaaacccgtacggttaggttaaccctttaacgcgtaacgttaaccggttgggtaccgtgggtaaaccccgacgggg

SEQ ID NO: 183406 - DNA, 773 bp, Homo sapiens
  misc_feature: GYAE6OF01BGIY8.13.76.G10.1.454.CMB.1.raw
  modified_base (275)..(275): a, c, t, g, unknown or other
  misc_feature (275)..(275): n is a, c, g, or t
  modified_base (309)..(309): a, c, t, g, unknown or other
  misc_feature (309)..(309): n is a, c, g, or t
  modified_base (491)..(491): a, c, t, g, unknown or other
  misc_feature (491)..(491): n is a, c, g, or t
tcagtcacgtactacacgaccggtgctcgatttagtcactcatacaggggggagaggagcccagcactgggattccgaggtgtttccattcggtgatcagcactgaacacagaggactcaccagtggtagttttggctgagtcttcgggttttccttgttgtacttattttaaaaggtgcccagtgtgagtgcagctggtaggtagtcgtagggaggaggtccgttggactccgagtccggtggggggtccctggacgacgtctccgtgtcgacncggccttcgttgggtccaccgtcgactctaaccncgtacatgacgtcgtcgggtcccgccgccggtactaccgggaacggggacgggtcgtagggtcggttcggtccgtttccttacgtttttagtttacgttagttacggttaggtacgtaactacgttacgtccgcgaaccgtcgtccggtaggccggggtactacgttccactactccgtacngtaaccgactaaacgtccccgaaagtaaccgtaccgtacttacttttaactaccgtaaactacggaaccgtacgacccgttacggtaacgaccgtaacgacgttaacccgtacgggaccggtaccggtttaacgttaacttaacccggtaggtggtaacgtaggtaaccggtacgggtaacggggtccccttaaacggggtaacccgtttaaccgttcggaaacccgttaggtacgggtcccggtaccgggtaacggggtaaccggtaaacccgggtaccgg

SEQ ID NO: 183407 - DNA, 736 bp, Homo sapiens
  misc_feature: GYAE6OF01B2ZPL.13.76.G10.1.454.CMB.1.raw
  modified_base (134)..(134): a, c, t, g, unknown or other
  misc_feature (134)..(134): n is a, c, g, or t
  modified_base (180)..(180): a, c, t, g, unknown or other
  misc_feature (180)..(180): n is a, c, g, or t
  modified_base (252)..(252): a, c, t, g, unknown or other
  misc_feature (252)..(252): n is a, c, g, or t
  modified_base (303)..(303): a, c, t, g, unknown or other
  misc_feature (303)..(303): n is a, c, g, or t
  modified_base (348)..(348): a, c, t, g, unknown or other
  misc_feature (348)..(348): n is a, c, g, or t
  modified_base (567)..(567): a, c, t, g, unknown or other
  misc_feature (567)..(567): n is a, c, g, or t
  modified_base (622)..(622): a, c, t, g, unknown or other
  misc_feature (622)..(622): n is a, c, g, or t
tcagtcacgtactacacgaccggtgctcgatttagtcactcatacgagggggggaagccgtgggaacacttagccttcatgagtcgtaccccacatggcctggatgatcgcttctcctcggactccttgcttanggatcaggagtggattctcgagactggtcgcgaaccccaggggacnccctagttccgttcacgtacggtcgtccgtccgtagggacgggtaactgtaccacgtactccacgttgcggnttacgagtctacggctacgtagtccgtacttaagtacgttaccctacccgnggtacctaggtacccaaagacccgacccgacggaccgacggtccncccggaacgccgtaaccgtcacctactaccaacgacaacctaaacctccgttacgcgttccttaccggtcgggttacccctgtacgtaccgttcctccttagtccggtcctacctacggtacccgtacgggtaaacacgtctaccggtctaacgacgacgtcggaccggacgacgtcaaaggagtacgagttaacacgtacgttaattctttaacgggntttaacgtacctttagggtaacgtcggttacttcgtaacttcggtgttaaccggnttacgggtggtaaaccgggtggtaaccgtaccggtaccgttcggacggttaccccgttcgtacgggtaccctaccggtaccggacgttacccgcctcccggtacccgttaccgg

SEQ ID NO: 183408 - DNA, 725 bp, Homo sapiens
  misc_feature: GYAE6OF01BSBQ9.13.76.G10.1.454.CMB.1.raw
  modified_base (250)..(250): a, c, t, g, unknown or other
  misc_feature (250)..(250): n is a, c, g, or t
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacgaggactccgtggcctcctatgagtctgtactcacgccctacctctaggtcgtccgtcgtacccgaggacagacgcgaccagcactccacctgtcttacgaaggtaaattaagtcgganaacgtaataaattacttacttaccgtagtacncgancggaatacgtcgacgtccgtaccggtcccgttagcgtcgttacggtactacgtctaacgtacaacggtctaccgtacccggaccggttacccgaccgtagtaccggtaccgtcccggtagacggtaccttacttccggtcgtaccgtaccgtaccgttaccgacggtccgtaaaccgctaccggtactaccgtcaccgtaccgtactccgggacggtaccggaccgtaggtaccgtagagtacggcgtacgggaccttacgtaacgttacgtccgttaacgggcggtaccgggtaacgggtcggtactaccgggacgtaccgacggttcctaacccgggtctaaacggttccggtacgttacccggtaacggacgtacccggtaacgtaccggttaacccgtcgtaacccggtcgtaaacccgggcccgtaaccccggg

SEQ ID NO: 183409 - DNA, 772 bp, Homo sapiens
  misc_feature: GYAE6OF01AL6VR.13.76.G10.1.454.CMB.1.raw
  modified_base (268)..(268): a, c, t, g, unknown or other
  misc_feature (268)..(268): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtgccctagtgtgaggtgcagcgtgggtggtagtcgtgggaggaggtcttgactccgacgtccggtcgggggtccctgacgtcctctcctgtgcncgcctcgtcggtccaccgtncgtcacctacctanatgcgcggtcggcccgccgacggccgtaccgggaggggacggggtgtgggtagtcgtccgtttcttttacgtttttaagtttaagttaggttaggtaggttaaccgtactacgtaccgtcccgcgtacgaccggttccgggtagggaccgggtcctacgttccctacctactccctaaccgaagtaacctaacgtaaacctaccgaaaagtaacccgtcgttcgtttacgtttacctaactaaagtacgaacgtcgcgtagaacgtccgaccgagtacccgaccggtaccggtttaccggtatttacgttacgtgggacggtacggtaacggaggtacccgggtaacccggggtaaacccccggttaacgggttaaaccccggtttccaaccgggttaacctacggggttaacccgggtacccgggttccggggacccggggtaaccccgggaaacccgggtaccccggg

SEQ ID NO: 183410 - DNA, 836 bp, Homo sapiens
  misc_feature: GYAE6OF01DNUPE.13.76.G10.1.454.CMB.1.raw
  modified_base (338)..(338): a, c, t, g, unknown or other
  misc_feature (338)..(338): n is a, c, g, or t
tcagtcacgtactacacgaccggtgctcgatttagtcactcatacagggggggagaggagcccagcactgggattccgaggtgtttccattcggtgatcagcactgaacacagagactcaccatggtagttttggctgagcttgggttttccttgttgacttaagtttaaaaggtcgccctagtgtggagtgcagctggtggagtcgtgggaggaggtccttaggactccgacggccggttcggggggtccccttggacgtaccttcctccgtgacgtccgaacgtcccttcggtacggtttcccaccgggttactacggtacctaaccaccccttanaccggtggaagtccgttccgggtaccccgtcacggtcgtaccgggtagggggtaacggggcggtacggtacggtggtccgtttacttttacttttaacggttaagttggttaagggttaacggtacgttaactagttaccccgtaccgtactacggaccgttccgggtacgggtcggggacccgtaacttccaaccgactttcccggaacctaacggtaaacgaccgtaaacttacccgaaaacgaaaccgtccttacctttacgtttaaccgttactaaactaacggaaacctacggtaccgttacgggaacttaccgggacgtaaccgaccggtaaccgtacccggggttaccgttacggtttaacgttaccgtaggttaccgggacgttaggaccgttacggacccggggtaacctaacgttaccggtttaaccgacgttacggtacgtttaccgggacgttacgggaccgggtacggtaacccggtaccccggg

SEQ ID NO: 183411 - DNA, 874 bp, Homo sapiens
  misc_feature: GYAE6OF01A2IG8.13.76.G10.1.454.CMB.1.raw
tcagtcacgtactacacgaccggtgctcgatttagtcactcatacgagggggggagaggagcccagcactgggattccgaggtgtttccattcggtgatcagcactgaacacagaggactcacagtggtagtttggctggagtcgttcgggtttttccttgttgtacttaagtttttaaaaagggtcgcccaggtgtggtagggtcgacaggtcgtgggtcggaacgttcggtagggaggggagggtcttggtaactcccgtacggtcccggggttcggggggttcccctaggaacgttaccgtccttcccgttggtcgaccgtacggtccccgttcggttaccgggttcctaacccgttctaacgtaccaacctaacctaaccgtaagtcggaacggttccggttaccggggtcccgacccgtaacggtccgtaaccgggaacgggggtaacggggtcgtgggtacggtcggttacgttacttttacgttttaagtttagtaaggtttacgggttagttaaacgtacttacgtaccgtcgaaccgtacggtccgttaaccggtcggggaaccgggtaccttaacgttcctaacctaaccgtccgtaacgacgtacgtaaaacctaacgtaaaccgtaaacgaacgtaccgtatttaccgtttaacttaagaaacgtacgtaacctagtaccggagtaacgaaccggtacgcgtaacggaccgtacggtaccgttaagttccttaacggtcggtacggacgaaaggtacggtacccgggtaacggggaacccctaaacggtaaaccgttccggtaacgtacggtggtaacccggggtcgtaacggtaccggggaaccggtacccggaacccggg

SEQ ID NO: 183412 - DNA, 799 bp, Homo sapiens
  misc_feature: GYAE6OF01APQCE.13.76.G10.1.454.CMB.1.raw
  modified_base (194)..(194): a, c, t, g, unknown or other
  misc_feature (194)..(194): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttgctgagcgttgggtttttccttgttgcttaattttaaaaggtgccctagtgttgaggtgngagcgtgggtggtagtcgtagggaggtaggtcttagactaccgacggtccgggttcggggggtccctagacgtcctcctccgtgtacgcgtacgtccgtcgttcgggtacctacccgtcgtacgtacctaacctaccgtaacgtgtaggacgtccggttcgggtacccgccgtacggccgtacgggaggggaacgggtcgtagggtaggtcgttccgtttcgttttacttttaagtttaggtacggttagggttacggtacgttactaaccgtacgtcccgacgtaccggtaccggtcggtagggaccggggtacctacgtaccacctaccttcgaacctaacgaagtaaccttacgtaccgaaactaaccgtccgttacgttacttttacccaaagtacgtaacgactcggacgtaggtacgaccgtagtacgacgaccggtcgttacgtagttaactcggtagtacggagacggtacggccgggtacccggggtaaacccttacgggttaaaacccgttctaacccggggtttcgtaccggggttcgggttacccgggaaccgggtacccccgggggtaaacgggtaaccccgggtacccggg

SEQ ID NO: 183413 - DNA, 963 bp, Homo sapiens
  misc_feature: GYAE6OF01BCSTL.13.76.G10.1.454.CMB.1.raw
  modified_base (885)..(885): a, c, t, g, unknown or other
  misc_feature (885)..(885): n is a, c, g, or t
tcagtcacgtactacacgaccggtgctcgatttagtcactcatacaggggtctgggagaggagcccagcactgggattccgaggtgtttccattcggtgatcagcactgaacacagagactcaccatggtagttttggcgtgagtcgttgggtttttcctttggttgtacttaaagtttttaaaaggtcgtacccgtaggttggttaggtagggtcggtcgacggtcggttgggtgggtacggttcggtggggagggtacgggtctttggacgtaccgtacgggtccggggttccggggggttaccccgttaggaaccggttccttcccgttaccgttgggttaccgaccgtaccggtcccgttccggttaccgggttacccgtaaccggtaccctaaccggttacctaaccctaaccggggggggtaactacggtacggtaccggtccgggttccgggtacccggtcccggtaccgggtccggtaaccggggaacggggggtaccggggtacgggtacggggttacggtccggttaccgttttaccgtttttaaccgttttttaacgtttaggtttaaggttacggggtttaaggtttaaccgttaaacgtaccgtttacccgtaccgtaccggtaacgttacccggtcggggttacgggtaccgggtaccgttaccgttaccgtaacccgttacgtacctaccggtaaacgaaccgttaaaccgtaacgttaaacccgaaccgtaaaccgttacgtttacctttaccgttttaacttaacgtaaacgttaacgtaaccgacgttacgaacggtacgaccggtacgtacgtacgtaaccggtaccggttacgttagttacgttacgtcggtacgtagtaacggnggtaccggtacccggtaaccgtacgtaccggttaactaccgtacgtaccggtacgggtcgtaccggtcgggtaacccg

SEQ ID NO: 183414 - DNA, 811 bp, Homo sapiens
  misc_feature: GYAE6OF01CP3E8.13.76.G10.1.454.CMB.1.raw
  modified_base (770)..(770): a, c, t, g, unknown or other
  misc_feature (770)..(770): n is a, c, g, or t
tcagtcacgtactacacgaccggtgctcgatttagtcactcatacgagggggggagaggagcccagcacgtgggattccgaggtgtttccattcggtgatcagcactgaacacagaggactcaccatggtagtttggctgagtcgttgggttttccttgttgtctttaagttttaaacggtcgacccgtaggtggtggtaggtgcgaggtcggtgggtggtacgtcggtagggagggtggtcttgacgtccgtacggtccgggtcgggggttcctaggtaactccgttccgtccgttggtcgccgtaccgtccgttccggttacggttccgtaccgtacgacgttaaccacctaaccgttacgagtcggaccggtccggttccgggtacccgccggtaccgggaccggtaccggggaagggggtacgggttccggtgggtacggttcgttaccggttttacgttttacgtttttaagttaacggtttaaggtttaacggtaggttaaccgtaaccgtacgttaccggtaccgtaacgtacggtacccggtccgggtagggtaccgggtacctacgtaccgactacgaccgtaccgagtaactacgtaaccgtaaccgaaacgtaccgtacgttactttactactaaccgaagtaccgaacgtacgtcgaagtacggacacggttacacgaccggttacgtcgttaagttacgtcgtagacgtagacgggtacggcgtacccgggactaaccggttaacttcgaaccggtnttcggcccggtagtccggaacgggtaccgacgggtacccgg

SEQ ID NO: 183415 - DNA, 866 bp, Homo sapiens
  misc_feature: GYAE6OF01EEAKI.13.76.G10.1.454.CMB.1.raw
  modified_base (180)..(180): a, c, t, g, unknown or other
  misc_feature (180)..(180): n is a, c, g, or t
  modified_base (346)..(346): a, c, t, g, unknown or other
  misc_feature (346)..(346): n is a, c, g, or t
  modified_base (374)..(374): a, c, t, g, unknown or other
  misc_feature (374)..(374): n is a, c, g, or t
  modified_base (391)..(391): a, c, t, g, unknown or other
  misc_feature (391)..(391): n is a, c, g, or t
tcagtcacgtactacacgaccggtgctcgatttagtcactcatacaggggcgtgggagaggagcccagcactgggattccgaggtgtttccattcggtgatcgagcactgaacacagaggactcaccatggagttttggctgagcgttgggttttccttgttggtcttaattttaaaggngccctagtgtgaggtgacagcgtggtggtacgtcgtgggaggaggtcctgatcccgagccggtggggggtccctggacgtacgtctcgtcgtagccacggccttcggttgggttcctaaccgtccactaccacctacctcgatggacgtcggttcggaccgtccgngtaccggaccggagggtacgggggtacngggacgtcggtcgtttntttaccgtttttagtttaaggtacgttacgggtaacggttacgttaaccgtaacgtttaccgtacccggggtaccctacgggtacccccgtaccggggtacggaaccggggggttccctaaacttttcccaaccgttacgttaccctacggaacgtaacggtaacctaacgtttaaacccgaaacggaaccgtacggtaccctttcggttttaaccttaaacgaaccgtttaacggaaccggtgtaacccccgggtagttaacggaacccggaccgttaaggtaacccgggtaccccgttaacgggttacccggtttaacgtttacccgtttaaggttacccggtaagggtacggtagtaaacggggttaaccgttaccccgggggggaacccttaaccgttaaccccggttaacgtacccggttaaccgtcgttacggggcccggttacggggttaccggggtaaacccccggg

SEQ ID NO: 183416 - DNA, 625 bp, Homo sapiens
  misc_feature: GYAE6OF01AHMLE.13.76.G10.1.454.CMB.1.raw
  modified_base (604)..(604): a, c, t, g, unknown or other
  misc_feature (604)..(604): n is a, c, g, or t
  modified_base (613)..(613): a, c, t, g, unknown or other
  misc_feature (613)..(613): n is a, c, g, or t
tcagtcacgtactacacgaccggtgctcgatttagtcactcatacaggggctgggcctcaggaagcagcatcggaggtgcctcagccatggcatggactccctctcttcctcggcgtccttgcttactgcacaggatccgtggcctctatgagctgacctcagcctacctcagtcgtccgtgtccccaggaccagacagccagcactcacctgctcgaggaataagtggacagactaatctactcctgtactcagctagacgtcacggcctacgtccctgtcgacgtgtcatactatacgagtctcgactacggccgtcctcggaggtcctccgtgacgtcgtacttacgtcgtcgtcctaccctaacgtcggtacggtacctcgacgtccctacgtccgtaacaccgtactccgggaaccggtacccggtaccgtaggtaacttacggaggtcgtacggacgtcgtaacgttaacttacggttactcgggacggtagggtacccgggtaggacctacgggacctacgtaccgtcgccggtaccccgtagttcgttccggtcggtaacggacggtaccgtacgtaccggtacttacccgtaccnggttacccncggtaaaccccg

SEQ ID NO: 183417 - DNA, 782 bp, Homo sapiens
  misc_feature: GYAE6OF01CSQ7U.13.76.G10.1.454.CMB.1.raw
  modified_base (340)..(340): a, c, t, g, unknown or other
  misc_feature (340)..(340): n is a, c, g, or t
tcagtcacgtactacacgaccggtgctcgatttagtcactcatacaggggcgtgggagaggagcccagcactgggattccgaggtgtttccattcggtgatcagcactgaacacagaggactcaccatggtagtttggctgagcgttgggtttttccttgttgacttaagtttttaaaaggtcgcccagtgtgaggtgcagcgttgggtggagttcgtagggaggacggtcttgactccgacgtcccggttggggggtccctaggacgtaccttccgtcccgtggtcgcctacgtccgttacgttcgggttacctaccggtctacgtaccacctacctanatgacgtccggtcgggtcccgaccgacggtccgtaccgggaaggggacgggtcgtggagtcgtcgtttctttacttttaagttagtaggttaggttaggtaacgtaacgtacttaaccgttcccgagtaacgtaccgtaccggtgggaccgggtaccgtatttacccgacgtactcctaccgaagaacgtaactaacttaccgaaacgaactacgttccgttttactttacctaacgtaaacgtacgtaaccgtacgtacgttaaggacggtaaccgaccgtaagtacccggaccgtaaccgggttcgtttacgttaacgtttaccggagttcggacggaaccggagggtaacccggtcccggtaacccggtaacggttaaacccgttacgaacccgtacgttaaccggtcgggtaaccgtccggggacggtaaaccccggg

SEQ ID NO: 183418 - DNA, 895 bp, Homo sapiens
  misc_feature: GYAE6OF01DDK0T.13.76.G10.1.454.CMB.1.raw
  modified_base (251)..(251): a, c, t, g, unknown or other
  misc_feature (251)..(251): n is a, c, g, or t
  modified_base (452)..(452): a, c, t, g, unknown or other
  misc_feature (452)..(452): n is a, c, g, or t
  modified_base (471)..(471): a, c, t, g, unknown or other
  misc_feature (471)..(471): n is a, c, g, or t
tcagtcacgtactacacgaccggtgctcgatttagtcactcatacaggggctgggcctcaggaagcagcatcgggaggtgccctcagccatggcagtggactcccttctcctttccgtcgggcgttccttcgtcttacgtcgaccacgacggacttccggtcggtcccttacctagtggacgtctcgtaacctcaacccgccctaccctcgtacgttcggttaccccggtccggtaccccgaagggaaccncgaacccgacggacctagacctaactacccggtaaccttcgacctttacggtaaaacggtaaaaacttaacggttcggaacgtaaattaaacgttaaaacttacgttaacccgttacggttaaggtacctaaacggtacgaacgtaaacggtaacgtcccgaacgtaccgacccgttccggtgtaccggtcgtcgttaccngttaacgttaacacggtanacgtaccgtaacccgaccgtaccccgaccgttacgacggtacctcggtacgcctttaaggtcctttacgccggttccggaacctacgtacgttacgaacggtaaccttccgaaaccttccgacctactaaccgtacctaacggtaccggcccggtaaccggaacgtacgaccggttacgggtagtaaccggtaggtcgtaacccgttacaacgtttaccgttacgtaccggtacgggtcggacgggttaaccggaccgtacgaccggttaccgccggtacccgtaccgtaaccggttctttaaaccgggtcccgggttaaccgtttacccggaaaggttaaccccgggtaaaaccccgggttccgtaacccggttaacccgttaacccgaaccccggtccggttaaaccccggtaaacccccgg

SEQ ID NO: 183419 - DNA, 519 bp, Homo sapiens
  misc_feature: GYAE6OF02IVVTW.13.76.G10.1.454.CMB.1.raw
  modified_base (456)..(456): a, c, t, g, unknown or other
  misc_feature (456)..(456): n is a, c, g, or t
tcagtcacgtactacacgaccggtgctcgatttagtcactcatacagggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactcgtgaggggccattcaccatctccagagacaattccaagacacgctgtttctcaaatgaacagcctgagagccgatgacacggccgtgtattacngtgcgagagagtggggcccaagaacgttacacgctagtggacgtcgtggggccaagggacccg

SEQ ID NO: 183420 - DNA, 476 bp, Homo sapiens
  misc_feature: GYAE6OF02G6EZU.13.76.G10.1.454.CMB.1.raw
  modified_base (431)..(431): a, c, t, g, unknown or other
  misc_feature (431)..(431): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggatccctgagcgattctctggctccaactctgggactcagccactctgaccatcagcgggacccaggctatggatgaggctgactattactgtcaggtcgtgggacagcagcactgcccgntagtgtcttcggaactgggaccaggtcaccgtctagtcagacccg

SEQ ID NO: 183421 - DNA, 475 bp, Homo sapiens
  misc_feature: GYAE6OF02F0FWW.13.76.G10.1.454.CMB.1.raw
  modified_base (431)..(431): a, c, t, g, unknown or other
  misc_feature (431)..(431): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtcccaaggacagacagccagcatcacctgctctggaaataaattggcagataaatatacttcctggtatcagcagaagtcaggccagtcccctgtgctggtcatctatcaagatgccaagcggccctcagggatccctgacgcgattctctggctccaactctgggaactcagccactctgaccatcagcggacccaggctatggatgaggctgactattactgtcaggcgtgggacagcagcactgcccgntatgtcttcggaactggaccaggtcaccgtcctagtcagacccg

SEQ ID NO: 183422 - DNA, 523 bp, Homo sapiens
  misc_feature: GYAE6OF02GMYUN.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttattatagtagtggtagtacatactccgcagactccgtgaggggccattcaccatctccagagacaattccaagaacacgctgttcttcaaatgaacagcctgagagccgatgacacggccgtgtattactgtgcgagagagtggggcccacggaacgttactacgctagtggacgtcgtggggccagggacccg

SEQ ID NO: 183423 - DNA, 477 bp, Homo sapiens
  misc_feature: GYAE6OF02GFTKR.13.76.G10.1.454.CMB.1.raw
  modified_base (429)..(429): a, c, t, g, unknown or other
  misc_feature (429)..(429): n is a, c, g, or t
tcagtcacgtactacacgaccggtgctcgatttagtcactcatacagggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcatgcccgntatgtcttcggaactgggaccaggtcaccgtctaagtcagcccaacgg

SEQ ID NO: 183424 - DNA, 477 bp, Homo sapiens
  misc_feature: GYAE6OF02F5QVS.13.76.G10.1.454.CMB.1.raw
  modified_base (432)..(432): a, c, t, g, unknown or other
  misc_feature (432)..(432): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntatgtcttcggaactgggaccaggtcaccgtcctagtcagacccg

SEQ ID NO: 183425 - DNA, 572 bp, Homo sapiens
  misc_feature: GYAE6OF02I8471.13.76.G10.1.454.CMB.1.raw
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
  modified_base (451)..(451): a, c, t, g, unknown or other
  misc_feature (451)..(451): n is a, c, g, or t
  modified_base (456)..(456): a, c, t, g, unknown or other
  misc_feature (456)..(456): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttcgtgtagctatttaaagtgccagtgtgaggtgcagctggtggagtctggaggaggcttggatccagcctggggggtccctggagctctcctgtgcagcctntgggttcaccgtcagtcacacctacatgagctgggtcccgccaggcctccaggggaagggctgggagtggcgtcttacttttatttanaggttagtggttagtacatacgtccgcagactccggtgagggggcccagttcgacctatcctccagacgacaattcccaaagaacacgacttgtttctactaatcgaaacngtccngagacgacgacgtacgacgacgaccgtacgtacgttacgtcgtagtacgagagacggtacggaccgaacgtaacgtacgtacgtacgtacgtacggtacgtacggtcgggtaccgg

SEQ ID NO: 183426 - DNA, 310 bp, Homo sapiens
  misc_feature: GYAE6OF02IP73Y.13.76.G10.1.454.CMB.1.raw
  modified_base (301)..(310): a, c, t, g, unknown or other
  misc_feature (301)..(310): n is a, c, g, or t
tcagtcacgtactacacgaccggtgctcgatttagtcactcatacagggcttctaatcgggactctgggtcccagagagattcagcggcagtgggtcaggcacttatttcacactgaaaatcgacaggtggaggctgaggatgctgggtctattactgcatgcaagctacacactggcctccgctcaccttcggccaagggacacgactggagatacgaacgaactgtggctgcaccatctgtcttcatcttcccgacatctgatagtacgtgactgagcggctggacaaggcgctatagnnnnnnnnnn

SEQ ID NO: 183427 - DNA, 486 bp, Homo sapiens
  misc_feature: GYAE6OF02IAVKP.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggactcagccactctgaccatcagcgggaccaggctatggatgagctgactattactgtcaggcgtgggacagcagcactcgcccgctagtcgtcttcgggaacttcgggacctaaggtccaccggtcctaagtccagaccccg

SEQ ID NO: 183428 - DNA, 521 bp, Homo sapiens
  misc_feature: GYAE6OF02I22UL.13.76.G10.1.454.CMB.1.raw
  modified_base (390)..(390): a, c, t, g, unknown or other
  misc_feature (390)..(390): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggagggctggagtgcgtctcttttattatagtagtgtagtacatactcgcagactcgtgaggggccattcaccatctccaganacaattccaagaacacgctgtttctacaaatgaacagcctgagacgccgatcgacacggcgttgtacttactgtgcgagagagtcggggacccaacgtaacgttacacgctagtggacgtcgtgggacccg

SEQ ID NO: 183429 - DNA, 500 bp, Homo sapiens
  misc_feature: GYAE6OF02GTB5B.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatcccgtgagcgattctctggctccaactctgggactcagccactctgaccatcacgcgggacccaggcctatggatggagctgactattactgtcgaggtcgtgggacagcagcactgcccgctagtgtccgttacggaacgtacgggaccgaacggtccgaacccgtcctaacgtccacgaccccg

SEQ ID NO: 183430 - DNA, 536 bp, Homo sapiens
  misc_feature: GYAE6OF02IBBKE.13.76.G10.1.454.CMB.1.raw
  modified_base (294)..(294): a, c, t, g, unknown or other
  misc_feature (294)..(294): n is a, c, g, or t
  modified_base (358)..(358): a, c, t, g, unknown or other
  misc_feature (358)..(358): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcgtggtttccgtgttgctatttaaaggtgccagtgtgaggtgcagctggtggagtctggaggaggcttgatccagcctggggggtccctgagactctcctgtgcagcctctgggttcaccgtcagtcacacctacatgagctgggtcccnccaggctccgagggagggctggagtgcgtcttcttttattatagtagtggtagtacatactccncagactccgtgagggggccattcaccctatctcagagacaattcaagaacacgtctgtttactcaaactgaactagcctgagagaccgatgacgacggccgtgtattaccgtgtgcgtagaggatcggggaccctaacggaacgttacgtacgctagtcggacgtccgtgggaaccgg

SEQ ID NO: 183431 - DNA, 558 bp, Homo sapiens
  misc_feature: GYAE6OF02HEW2M.13.76.G10.1.454.CMB.1.raw
  modified_base (169)..(170): a, c, t, g, unknown or other
  misc_feature (169)..(170): n is a, c, g, or t
  modified_base (173)..(176): a, c, t, g, unknown or other
  misc_feature (173)..(176): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtgtttcgtgtagctattaaagtgccatnngtnnnntgngntngngngctgatcagcctgggggtcctgagctctcctgtgcagcctctgggttcaccgtcagtcacacctacatgagctgggcccgccaggcctccgaggggaagggctgggagtgcgtcttcttttatttattagtagtgtagtactatactcgcacgactccgtggagggccgtacttcaccactctccacgagaacaacttaccaacgaacaacgtacttcgtttcttactaactagtaacacgtaccgtagacgacgacgacgtacgacgaccggtaccgtcgttacgttacgtgtgacgagagagtcgggaccgaccgtaacgtaacgtacgtacgtacgtacggtacgtcggtcggtacggacggaaccgg

SEQ ID NO: 183432 - DNA, 561 bp, Homo sapiens
  misc_feature: GYAE6OF02I13ZM.13.76.G10.1.454.CMB.1.raw
  modified_base (358)..(358): a, c, t, g, unknown or other
  misc_feature (358)..(358): n is a, c, g, or t
  modified_base (432)..(432): a, c, t, g, unknown or other
  misc_feature (432)..(432): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtctcttttattatagtagtgtagtacatactccgnagactcgtgaggggccattcaccatctccagagacaatccaagaacacgcttgttctcaaatgacagcctgagngccatgacacggccgtgtacttactgtgcgagacgagtcggggaccccaacggtaaaccgttactaacggtccttaacggtcgggtaaccggttccggtacggggggacccgtaaagggggtaaccccg

SEQ ID NO: 183433 - DNA, 610 bp, Homo sapiens
  misc_feature: GYAE6OF02J21K2.13.76.G10.1.454.CMB.1.raw
  modified_base (289)..(289): a, c, t, g, unknown or other
  misc_feature (289)..(289): n is a, c, g, or t
  modified_base (352)..(352): a, c, t, g, unknown or other
  misc_feature (352)..(352): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcgtggtttcgtgttaggctattttaaaaggtgcccagtgtgaggtgcagctggtggagtctggaggaggcttgatccagcctggggggtccctgagctctcctgtgcagcctctgggttcaccgtcagtcacacctacatgagctgggtccnccaggctccgagggagggctggatgcgtctcttttattatagtagtggtagacatacctccgntagacttccggtaggacggggcccgtattccaccctatccgtaccaagacgaacaattcccaaagaacacggcttgtttactacaaattgaacagccctagacgacgaccgtatcgaccgaccgggccttaggtacttacgtggtacggcgaagtacggtacgttaccgggggaacccccaaggtaaccgtttaccgaacggccttaacggttacggggaccgttacggtaccggggggacccaagggggtaaccccg

SEQ ID NO: 183434 - DNA, 493 bp, Homo sapiens
  misc_feature: GYAE6OF02H0KLW.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggcctcagggatccctgacgcgattctctggctccactctgggaactcagccactctgacccatcagcgggacccaggctatggatgaggctgactatactgtcagggcgtgggacagcacgcactgcccgctatcgtcttcggaactgggaaccaaggtccaccgtaccttaacggtccacgcccaaaccgg

SEQ ID NO: 183435 - DNA, 503 bp, Homo sapiens
  misc_feature: GYAE6OF02G2VPX.13.76.G10.1.454.CMB.1.raw
  modified_base (427)..(427): a, c, t, g, unknown or other
  misc_feature (427)..(427): n is a, c, g, or t
  modified_base (442)..(442): a, c, t, g, unknown or other
  misc_feature (442)..(442): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagccggccctgagggactccctgacgcgattctctggctccaactcgtaggaactcacgccactctgaccatcgagtccgggacccaggctagtggatggagctgactattactgtcaggcgtggacngcagcacgtcgccgntagtcgtcttacggaactcgggacctaacggtcaccggtacctaagtccgacgtaccccgg

SEQ ID NO: 183436 - DNA, 538 bp, Homo sapiens
  misc_feature: GYAE6OF02HQ69E.13.76.G10.1.454.CMB.1.raw
  modified_base (432)..(432): a, c, t, g, unknown or other
  misc_feature (432)..(432): n is a, c, g, or t
  modified_base (492)..(492): a, c, t, g, unknown or other
  misc_feature (492)..(492): n is a, c, g, or t
  modified_base (533)..(533): a, c, t, g, unknown or other
  misc_feature (533)..(533): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttagaaggtgtccagtgtgaggtgcaactggtggagtctgggggaggcttggtccagccgtgggggtccctgagactctcctgtcaagcctctgggttcagcttcagtgtatattggatgagctgggtccgccagactccgagggaaggggctggagtgggtgacaacataaacacagacggaagtgacccatactatgcggactctgtggaagggccattcaccatctccagagacaacgccaagactcatatattgacaaatggaccnctagagagacgaggacacggctagtgttattactgtgcgagagatggagagtggactagngggttcggggacccgggtaacccgtgggtaccacccggtanaaccg

SEQ ID NO: 183437 - DNA, 522 bp, Homo sapiens
  misc_feature: GYAE6OF02HKAAS.13.76.G10.1.454.CMB.1.raw
  modified_base (417)..(417): a, c, t, g, unknown or other
  misc_feature (417)..(417): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactccgcagactccgtgaggggccattcaccatctccagagacaattccaagaacacgctgttctnaaatgaacagcctgagagccgatgacacggccgtgtattactgtgcgagagagtcggggcccagtaacgttacacgctagtggacgtcgtggggccaagggaccc

SEQ ID NO: 183438 - DNA, 529 bp, Homo sapiens
  misc_feature: GYAE6OF02HOL53.13.76.G10.1.454.CMB.1.raw
  modified_base (469)..(469): a, c, t, g, unknown or other
  misc_feature (469)..(469): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgagggaaggggctggagtgcgtctcttttatttatagtagtggtagtacatactccgcagactccgtgaggggccattccaccatctccagagacaattccaaagaacacgctgtttctcaaatgaacagcctgagagccgatgacacggccgttagtattacngtgcgagagagtcggggcccaggaacgttacacgctagtggacgtcgtcggggcaacggg

SEQ ID NO: 183439 - DNA, 293 bp, Homo sapiens
  misc_feature: GYAE6OF02JZY4J.13.76.G10.1.454.CMB.1.raw
  modified_base (279)..(279): a, c, t, g, unknown or other
  misc_feature (279)..(279): n is a, c, g, or t
  modified_base (285)..(293): a, c, t, g, unknown or other
  misc_feature (285)..(293): n is a, c, g, or t
tcagtcacgtactacacgaccggtgctcgatttagtcactcatacagggccactggcgtcccagacaggttcactggcggtgggtctgcgacaaacttcactctcaccgtcaccagactggagcctgaagattttgcagtatattcctgtcaccagtttggtgactcaacgtggacgttcggccatgggaccaaggtggaaatgaaacgaactgtggctgcaccatctgtcttcatcttcccgcatctgatagtactgactgagcgggctggcaaggcncatagnnnnnnnnn

SEQ ID NO: 183440 - DNA, 537 bp, Homo sapiens
  misc_feature: GYAE6OF02IW79C.13.76.G10.1.454.CMB.1.raw
  modified_base (382)..(382): a, c, t, g, unknown or other
  misc_feature (382)..(382): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccagggaaggggctggagtgcgtctcttttatttatagtagtggtagtacatactccgcagactccgtgagggccgattcaccntctccagagacaattccaagaacacgctgtttactcaaatgaacagcctgacgagccgatcgacacggccgtgtattactgtgcgagagagtcggggcccacggaacgttactaacgctagtcgggtaccgtcgtcggggaccgaagggtacccg

SEQ ID NO: 183441 - DNA, 487 bp, Homo sapiens
  misc_feature: GYAE6OF02GLIQV.13.76.G10.1.454.CMB.1.raw
  modified_base (213)..(213): a, c, t, g, unknown or other
  misc_feature (213)..(213): n is a, c, g, or t
  modified_base (390)..(390): a, c, t, g, unknown or other
  misc_feature (390)..(390): n is a, c, g, or t
  modified_base (440)..(440): a, c, t, g, unknown or other
  misc_feature (440)..(440): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcnggaaataattggcagataaatatacttcctggtatcagcagaagtcaggccagtcccctgtgctggtcatctatcaagatgccaagcggcccctcgagggatcccctgacgcgattctctggctccaactctgggaacctcagccactctgaccatcagccgggacccagggctagnggatggagctgacttattactgtacagggcgtgggacagcagcatcgccnctagtgtcttcggaactggaccaggtccaccgtctaagtcagacccg

SEQ ID NO: 183442 - DNA, 733 bp, Homo sapiens
  misc_feature: GYAE6OF02JDQ9C.13.76.G10.1.454.CMB.1.raw
  modified_base (234)..(234): a, c, t, g, unknown or other
  misc_feature (234)..(234): n is a, c, g, or t
  modified_base (292)..(292): a, c, t, g, unknown or other
  misc_feature (292)..(292): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcaggaaataatggcagataaatntacttcctaggtatcagcagaagtcaggccagtcccctgtgctggtcatctatcaagntcgccaagccggtaccctgacgggactccctgacgcgtactttcgtcgtacggcttacccgaaacgttccgtacggggtaaccttccgtaacggccctaaccgttaccgttacggaacccctaacgttacccgaacgggtacccggggaaccccgaacggggtaccttaacggttacggggtaacgtttagggaaccgggtccgttaacggtaaacctttaagtttaacccgttacggtttaccggaaccgggggttaccgggttaccgggggaaaccttacgggaacccgtaacggacccgaacgttcccgggtccccgtaacggttaaccggttcgggtttaaccgtttacccgggaaacggttccggggaaaccccgtaacggggttaccctaaccccggttacccgtaaacggttccccgaaccggtaaccccccgg

SEQ ID NO: 183443 - DNA, 501 bp, Homo sapiens
  misc_feature: GYAE6OF02JIPK2.13.76.G10.1.454.CMB.1.raw
tcagtcacgtactacacgaccggtgctcgatttagtcactcatacagggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggacaaagctgcccttatcatcacggggcccaggcagaagatgaatctgattattactgtgttctttatatggtagtgccatttctgtctgtgttcggagtggcaccggctgaccgtcctcggtcagcccaaggctgccccatccgg

SEQ ID NO: 183444 - DNA, 523 bp, Homo sapiens
  misc_feature: GYAE6OF02GFWQS.13.76.G10.1.454.CMB.1.raw
  modified_base (289)..(289): a, c, t, g, unknown or other
  misc_feature (289)..(289): n is a, c, g, or t
  modified_base (504)..(504): a, c, t, g, unknown or other
  misc_feature (504)..(504): n is a, c, g, or t
tcagtcacgtactacacgaccggtgctcgatttagtcactcatacagggggagaggagcccagcactgggattccgaggtgtttccattcggtgatcagcactgaacacagaggactcaccatggagttttggctgagctgggtttccttgttgctattttaaaggtgcccagtgtgaggtgcagctggtggagtctggaggaggcttgatccagcctggggggtccctgagactctcctgtgcagcctctgggttcaccgtcagtcacacctacatgagctgggtccnccaggctccagggaaggggctggagtgcgtctcttttattatagttagtggtagtacatactccgcagactccgtgaggggccattcaccatctccagagacaattccaaagaacacgctgtttctcaaatgaacagcctgagagccgatgacacggccgtgtattactgtgcgagagatggggcccacgaacggttactacgctatcggacgtntcggggccaagggtacccg

SEQ ID NO: 183445 - DNA, 610 bp, Homo sapiens
  misc_feature: GYAE6OF02JXVN9.13.76.G10.1.454.CMB.1.raw
  modified_base (499)..(499): a, c, t, g, unknown or other
  misc_feature (499)..(499): n is a, c, g, or t
  modified_base (522)..(522): a, c, t, g, unknown or other
  misc_feature (522)..(522): n is a, c, g, or t
  modified_base (544)..(544): a, c, t, g, unknown or other
  misc_feature (544)..(544): n is a, c, g, or t
tcagtcacgtactacacgaccggtgctcgatttagtcactcatacagggggaaggccgtgggaacgacttagccttcatgagtgtcccaccatggcctggatgatgcttctcctcggactccttgcttatggatcaggagtggattctacagactgtggtagacccaggagccatcgttctcagtgtctcctggaaggacagtcacacttcattgtggcttagagatacggctcagtctctagtacgttacctacccagctggtaccaacacgacccaggccaggcctcgccgcacgctcactctacacacaaacactcgctcttccgtgggtccctcgatccgcttctctcggctcccgaattcccttagggaacctaaagcctcgtcccttatccatcgtccgggggacccagggcctagaaacgacttggaaactctagtatttataccttggttgttaacttttacgtagttgggtacgttacgaccttcgtttnttagtccgtggttggtttacggngggtacgtcttaaccccggggnttacgtacccggttccgttcggttgaccggtccctaacgggctaaccggtccccccaagttcccgg

SEQ ID NO: 183446 - DNA, 525 bp, Homo sapiens
  misc_feature: GYAE6OF02HB7U0.13.76.G10.1.454.CMB.1.raw
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatgggtatgcctatttctgtctgtgttcgggaggacgggcacccgggctcgacccggtcctccggtccacggccccgaaggcctcggcccccagtcccgg

SEQ ID NO: 183447 - DNA, 545 bp, Homo sapiens
  misc_feature: GYAE6OF02GJEA1.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcacacctacatgagcgtgggtccgccaggcctccgagggaagggctggagtgcgtctcttttattatagtagtgtagtacatactcgcagactcgtgaggggcctatcaccatctccagagacaattccaaagaacacgcttgttctacaaatcaacagcctgagacgccgatcgaccacggccgtagtattactgtgacgagagagtcggggcccaacggtaacgttacgtacgtacctagtcggaacgtcggtacgggaccgaagggtaccccg

SEQ ID NO: 183448 - DNA, 488 bp, Homo sapiens
  misc_feature: GYAE6OF02HKIZ0.13.76.G10.1.454.CMB.1.raw
  modified_base (307)..(307): a, c, t, g, unknown or other
  misc_feature (307)..(307): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctnagggatccctgagcgattctctggctccaactctgggaactcagccactctgaccatcagcggaccaggctatggatgagctgactattactgtacaggcgtgggacagcagcactgcccgctagtcgttcttcggaactcgggaccaaggtccaaccgttccgtaagtcgacgtaccccg

SEQ ID NO: 183449 - DNA, 631 bp, Homo sapiens
  misc_feature: GYAE6OF02I4PT7.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctcgtgggttccaccggtcagtcacacctacatgagctgggtcccgccaggctccgaggggaagggctggagtgcgtcttcttttattatagtagtggtagtactatacctccgcagtactccgtagacggggccgattccaaccatcctaccgagaacgaactaattacccaagaaccacgtcttagttttcctacaaagttcgaaacacgtcctaggaacgagtacccgaagttcgaaccgtaccgggccgtttagtaacgtttaacgtggttacgacggtaagacggaacggttccgggggaacccctaaacggttaaaccggtttactaaccggaccttaaggtcgggaacccgtttcggtacgggggaacccgg

SEQ ID NO: 183450 - DNA, 544 bp, Homo sapiens
  misc_feature: GYAE6OF02H2ZZX.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccgcaggctccgaggggaagggctgggagtgcgtcttcttttattatagtagtggtagtacatactcgcagactcgtgagggccattcacatctccagacgacaattccaagaacacgctgtttcttacaaatgaacagcctagagacgccgatacgacgacggccgtgtaacttactgtgcgagagacgtcggggcccaacgaacgttacacgctagtcggaccgtcggtacggggaccgaagggaacccg

SEQ ID NO: 183451 - DNA, 588 bp, Homo sapiens
  misc_feature: GYAE6OF02I3L1C.13.76.G10.1.454.CMB.1.raw
  modified_base (239)..(239): a, c, t, g, unknown or other
  misc_feature (239)..(239): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggcaggtccctgagactcncctgtgcagcctctggattcattctttgatgattatgccatgcactgggtccgcaagctccgagggaggcctggagtggtctcgaggtattagttggaatagtggtaacataggctatgcggatctgtgaggccgatcacatctcagagacacgaccaagaactccctagtatctagacaaatacgaacacgccgtaggtaagacgtacgtaggaacggaaccgtaccgggtccctttaggttaacgttttaagtttggttacggtaacctaaaaacggtacttaaccccgttaaacccccgtttaacggttaacgttttttacgggtacggtttacggtttaaaccgg

SEQ ID NO: 183452 - DNA, 495 bp, Homo sapiens
  misc_feature: GYAE6OF02GMVCP.13.76.G10.1.454.CMB.1.raw
  modified_base (441)..(441): a, c, t, g, unknown or other
  misc_feature (441)..(441): n is a, c, g, or t
tcagtcacgtactacacgaccggtgctcgatttagtcactcatacaggggctgggcctcaggaagcagcatcggaggtgcctcagccatggcatggatccctctcttcctcggtgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcgagggactccctgacgcgattctctggctccaactcgtgggaactcgagccactctgaccatcacggcgggacccaggcctagtggatgaggctgactattactgtcaggcgtgggacagcagcactcgcccntagtcgtcttcggaacgtcgggaccacggtccaccgtcctaagtccagaccccg

SEQ ID NO: 183453 - DNA, 527 bp, Homo sapiens
  misc_feature: GYAE6OF02JBIRJ.13.76.G10.1.454.CMB.1.raw
  modified_base (308)..(308): a, c, t, g, unknown or other
  misc_feature (308)..(308): n is a, c, g, or t
  modified_base (446)..(446): a, c, t, g, unknown or other
  misc_feature (446)..(446): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggcccctnacgggatcccgtgagcgattctctggctccaactcgtgggaactcacgccactctcgaccatcgacgccgggacccagggcctagtggatggagctgactattactgtcaggcgtgggacagcagcacgtcgcccgtntacgtcgtaccgttcgggaaccgttcgggaaccctaagggttcccaacccggttacctaaacggtccgacgtaacccccgg

SEQ ID NO: 183454 - DNA, 552 bp, Homo sapiens
  misc_feature: GYAE6OF02JBVEW.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaatggcagataaatatacttcctggtatcagcagaagtcaggccagtcccctgtgctggtcatctatcaagatgaccaagcggccctcgagggactcccgtgacgcgtattctcgtggctccaactcgtaggaactcgacgccactcacgaccatcgacgccgggaaccacgggactagtggatggacgctagacttattacgtgtacgaggcggtgggacaggacacgctaacgtcgcccgtacttacgtcggttacgttacggaacgttacgggaaccgtaacggtccgtacccgttaaccgtaaggtaccgaccgacccggtaaacccgg

SEQ ID NO: 183455 - DNA, 624 bp, Homo sapiens
  misc_feature: GYAE6OF02H6AWI.13.76.G10.1.454.CMB.1.raw
  modified_base (356)..(356): a, c, t, g, unknown or other
  misc_feature (356)..(356): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtccccaggacagacagccagcatcacctgctctggaaataaattggcaagataaatatacttcctggtatcagcagaagtcaggccagtcccctgtgctggtcatctatcaagatgccaagcggccctcagggactcccgtgacgcgattctctcggctccaacttcgaggactnacgcctactctacgacctactcgacggtaccgacccgaggtcctagtacggagtggaacgtcttacgtacttaacgttacgttacgtacgtacgggtacggtcgggaaccgtagaccggacgtaccgaacggtcccgtaccccggtacgttaaccgtttccggttaccggtttaaccgggtaaccgggtacccgggtaacccggtaacgggttaccccggtaacccggtttaacccgtaacggttaccccggacgtaaaccccccggg

SEQ ID NO: 183456 - DNA, 535 bp, Homo sapiens
  misc_feature: GYAE6OF02G7TH6.13.76.G10.1.454.CMB.1.raw
  modified_base (431)..(431): a, c, t, g, unknown or other
  misc_feature (431)..(431): n is a, c, g, or t
  modified_base (504)..(504): a, c, t, g, unknown or other
  misc_feature (504)..(504): n is a, c, g, or t
  modified_base (518)..(518): a, c, t, g, unknown or other
  misc_feature (518)..(518): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaagggctggagtgcgtctcttttattatagtagtggtagtacatactcgcagactccgtggaggggccgattcaccatctccagacgacaattccaagaacacgctgtttctacaaatgaaacngcctgagagccgatgacacggcctagtacttacgtgtagcgagagagtcggggcccaaggtaacgttacacgntagtcggacgtcgngggaccaagggtacccg

SEQ ID NO: 183457 - DNA, 562 bp, Homo sapiens
  misc_feature: GYAE6OF02GY5MH.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaggggaagggctggagtgcgtctcttttattatagtagtggtatacatactccgcagactccgtggacggggccctattccacctatcctccagagacaattccaagaaccacgcttgtttacctacaaattcgaacacgcctagacgacgccgatcgacgacggtccgtagtacttacgtgtcgcgagagagtcggggcccaacggtaaccgttacacgctagtcggtaccgtcggtcggggaccaagggtacccg

SEQ ID NO: 183458 - DNA, 536 bp, Homo sapiens
  misc_feature: GYAE6OF02HTMGJ.13.76.G10.1.454.CMB.1.raw
  modified_base (238)..(238): a, c, t, g, unknown or other
  misc_feature (238)..(238): n is a, c, g, or t
  modified_base (336)..(336): a, c, t, g, unknown or other
  misc_feature (336)..(336): n is a, c, g, or t
  modified_base (367)..(367): a, c, t, g, unknown or other
  misc_feature (367)..(367): n is a, c, g, or t
  modified_base (425)..(425): a, c, t, g, unknown or other
  misc_feature (425)..(425): n is a, c, g, or t
tcagtcacgtactacacgaccggtgctcgatttagtcactcatacaggggctgggcctcaggaagcagcatcggaggtgcctcagccatggcatggatccctctctcctcggcgtccttgcttactgcacaggatccgtggcctcctatgagctgactcagccaccctcagtgtccgtgtcccccaggacagacagccagcaatcacctgctctaggaaataaattggcagataaatntacttcctgtatcagcagaagtcaggccagtcccctgtgctggtcatctatcaagatgaccaagcggccctcgagggactcccgtgacgcgtattccntggctaccaactcgtgggaactcacgctacnctcgaccatccagccggtaccaggacctatcggatggaggcctaggacctaagttacngtcgaggtcgtggaactgcgagccacgcgcccgatacgtcggttaccgttacggaaccgttcgggaaccgtaaggttccgaaccgttccgtaaacggtccacgaaccccgg

SEQ ID NO: 183459 - DNA, 577 bp, Homo sapiens
  misc_feature: GYAE6OF02IO3KR.13.76.G10.1.454.CMB.1.raw
  modified_base (297)..(297): a, c, t, g, unknown or other
  misc_feature (297)..(297): n is a, c, g, or t
  modified_base (430)..(430): a, c, t, g, unknown or other
  misc_feature (430)..(430): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtggtttccgttgttgctatttaaaaggtgcccagtgtgaggtgcagctggtggagtctggaggaggcttgatccagcctggggggtccctgagactctcctgtgcagcctctgggttcaccgtcagtcacacctacatgagcgtgggtcccnccaggctccgagggagggctggagtgcgtcttcttttattatagtagtggtagtacatactccgacagactccgtgacggggcctattccacatcctcagagacaattccaagacacgctgttcttacaaatnaacagcctagagacgccgtatcgaacgacggtccgtagtacttaccgtgtcggacgaaggacgtaaggtccgggggcccaaacgggtaacccgtttaacgtaccggtacgttacgtcgggtaaccgttccggtacgggggaacccgg

SEQ ID NO: 183460 - DNA, 533 bp, Homo sapiens
  misc_feature: GYAE6OF02JERI1.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggagggctggagtgcgtctcttttattatagtagtgtagtacatactccgcagactccgtgacggggccattcaccatctccagagacaattccaagacacgctgtttctacaaatgaacagcctagagagccgatcgacgacggccgtagtattcgtgtgacgagagagtcggggcccagtaacgttacacgctagtcggacgtcgtacggggaccaagggtaccc

SEQ ID NO: 183461 - DNA, 510 bp, Homo sapiens
  misc_feature: GYAE6OF02HDFI8.13.76.G10.1.454.CMB.1.raw
  modified_base (387)..(387): a, c, t, g, unknown or other
  misc_feature (387)..(387): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtgctggtcatctatcaagatgccaagcggccctcgagggactcccgtgacgcgattcgtctggctccaactctgggactcagccactctgaccatcagcggaccaggctanggatgagctgactattactgtacgaggcgtgggacagcgagcacgtcgcccgtgtacgtcgttccgttacggaacgtcgggtaccaacggtcctaccgtacctaacggttccacgtaaccccg

SEQ ID NO: 183462 - DNA, 592 bp, Homo sapiens
  misc_feature: GYAE6OF02J3EJ1.13.76.G10.1.454.CMB.1.raw
  modified_base (292)..(292): a, c, t, g, unknown or other
  misc_feature (292)..(292): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccagggaagggctggagtgcgtctcttttattatagtagtggtagtacatactccgcagactccggtgagggggccgattccaccatcctccagacgactaaacttccgaaagaaccacggtacttggttttactacgaaattcgaaaccagtccctagacgacggcccgatcgacacggtccgtgttactactgtgacgtaggagagtcgggggacccctaggaaccgttacctaaccggcgttaacgtcgggtaacccgttcggacgggggtaccccgaaggggtaccccg

SEQ ID NO: 183463 - DNA, 547 bp, Homo sapiens
  misc_feature: GYAE6OF02HFYNR.13.76.G10.1.454.CMB.1.raw
  modified_base (437)..(437): a, c, t, g, unknown or other
  misc_feature (437)..(437): n is a, c, g, or t
tcagtcacgtactacacgaccggtgctcgatttagtcactcatacagggggggaaaggagcccagcactgggattccgaggtgtttccattcggtgatcagcactgaacacagaccaccaaccatggagtttgggcttacttgggttttccttgttgctattttaaaaggtgtccaatgtgagctgcagctggtggagtctgggggaggtttggtacagccagggcggtccctgagactctcctgtataacttctggattcaacttggggtgattatgctatgaactgggtccgccaggctccaggggaaggggctggagtggggtaggtttcagttaggagcaattctcatgatgggacaacagaatacgccgcgtctagtaaaaggcaagattacaccatctacaagagatgagtccaagaagcatcgcctttcngcagatgagtagcctgaacgacgagacacagaccatactattactgtacgtctagaggtaagtattgactagttccctacggacctgacgttagtcgggggtccttgggg

SEQ ID NO: 183464 - DNA, 527 bp, Homo sapiens
  misc_feature: GYAE6OF02JFAZT.13.76.G10.1.454.CMB.1.raw
  modified_base (289)..(289): a, c, t, g, unknown or other
  misc_feature (289)..(289): n is a, c, g, or t
  modified_base (411)..(411): a, c, t, g, unknown or other
  misc_feature (411)..(411): n is a, c, g, or t
  modified_base (440)..(440): a, c, t, g, unknown or other
  misc_feature (440)..(440): n is a, c, g, or t
  modified_base (456)..(456): a, c, t, g, unknown or other
  misc_feature (456)..(456): n is a, c, g, or t
  modified_base (467)..(467): a, c, t, g, unknown or other
  misc_feature (467)..(467): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcgtgtaggctatttaaagtgccagtgtgaggtgcagctggtggagtctggaggaggcttggatccagccgtggggggtccctgagactctctgtgcagcctctgggttcaccgtcagtcacacctacatgagctgggtcccncaggctccgagggaaggggctggagtcgcgttctcttttattatagtgtggtactacagtactcgcagactcgtgaggggccattcacatctcagacacatccaagacacgcttgttcctanaatgaacagcctgagagccgaatcgaacncgccgttgtattacgngtcgacgtagngagtcggggcccaagagttaccagtctagtcggaacgtcggtacgggaccaaaggggccc

SEQ ID NO: 183465 - DNA, 524 bp, Homo sapiens
  misc_feature: GYAE6OF02IXTSA.13.76.G10.1.454.CMB.1.raw
  modified_base (292)..(292): a, c, t, g, unknown or other
  misc_feature (292)..(292): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaatggcagataaatatacttcctggtatcagcagaagtcaggccagtcccctgtgctggtcatctatcaagntgccaagccggccctcgagggactcccgtgagcgattctcgtggctaccaactctgggaactcagccactctcgaccatcgaggccgggacccaggcctagtggatgaggctgactagttacgtgtcgaggcgtgggacagcagccacgtcgcccgtctagtcgtaccgttacgggaacgttcgggaacctaaggtccctaacccggtacctaacggtccgacgtacccccg

SEQ ID NO: 183466 - DNA, 484 bp, Homo sapiens
  misc_feature: GYAE6OF02I09E0.13.76.G10.1.454.CMB.1.raw
  modified_base (418)..(418): a, c, t, g, unknown or other
  misc_feature (418)..(418): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataattggcagataaatatacttcctggtatcagcagaagtcaggccagtcccctgtgctggtcatctatcaagatgccaagccggccctcgagggactcccgtgagcgattctctcggctccaactcgtagggaactcgagccactctgaccatcacgccggaccaggctagtggatgaggctgactattactgtacgnggtcgtgtgacagcagcactcgccnctntcgtcgtacgactggaccaggtccaccgtctagtcacg

SEQ ID NO: 183467 - DNA, 584 bp, Homo sapiens
  misc_feature: GYAE6OF02JYHNI.13.76.G10.1.454.CMB.1.raw
  modified_base (340)..(340): a, c, t, g, unknown or other
  misc_feature (340)..(340): n is a, c, g, or t
tcagtcacgtactacacgaccggtgctcgatttagtcactcatacagggacccaaaaaccacaccctccttgggagaatcccctagatcacagctcctcaccatggactggacctggagcatccttttcttggtggcagcagcaacaggtgcccactctcaggttcagctggtgcagtctggagctgaggtgaagaagcctggggcctcagtgaaggtctcctgcaaggcttctggttacttcttaccactacggtatcacctgggtgcgacaggcccctggacaagggcttgagtggatgggatgggtcaggcgctgacacgtggacacacagacgtangcacagaagttccagggcagagtcacgatcaacacagacatactcacgaacacacgacctacagtggaggtagaggacgtccgtagagactacgtagaccgacgaccggtaccgtttaattacgtgtacggcgaagtaggacgtacgtaacgacggttaacgtcggaacccgtaaaacgttcgggtttacccggaccccggttagggggaccccgtaacggggtaccccgtacggttaccccgg

SEQ ID NO: 183468 - DNA, 551 bp, Homo sapiens
  misc_feature: GYAE6OF02I1VRV.13.76.G10.1.454.CMB.1.raw
  modified_base (389)..(389): a, c, t, g, unknown or other
  misc_feature (389)..(389): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcatgtgcggcctctgggctcaccgtcaacaccaactacatgagctgggtccgccaggctccagggaagaggccggagtgggtctcagttatttatgtcgacggtgccacattctacgcagactccgtgacggggccggttcaccatcncagacgacaattccaagaacacggtgtatcttacaaatgaacagcctgagagccgatcgacacggccgtgtattactgtgcgagagagtcggggcccaacggaaccgttacgtacgtctaagttcgggacgttcgtacgggggacccaaggggtaaccccgg

SEQ ID NO: 183469 - DNA, 196 bp, Homo sapiens
  misc_feature: GYAE6OF02GPGS6.13.76.G10.1.454.CMB.1.raw
  modified_base (193)..(196): a, c, t, g, unknown or other
  misc_feature (193)..(196): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagtttgggctgcctggtcaaggactacttcctagtacgtgactgagcgggctggcaaggcgcatagnnnn

SEQ ID NO: 183470 - DNA, 615 bp, Homo sapiens
  misc_feature: GYAE6OF02I35NG.13.76.G10.1.454.CMB.1.raw
  modified_base (232)..(232): a, c, t, g, unknown or other
  misc_feature (232)..(232): n is a, c, g, or t
  modified_base (285)..(285): a, c, t, g, unknown or other
  misc_feature (285)..(285): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcactgctctggaaataattggcagataanatactctgtatcagcagaagtcaggcagtccctgtgctggtcatctatcaagntgccaagcgaccctgagggactccgtgagcgattcgtctggctccaactcgtagggaacctccaacgcctaactccgtacgacctaagtccgaacggccggggaacccagggtacctagtcggagtaggaggtcgtacgtaactactttaacgtgttaccgagggtcgggttacgggaacacggacgaccggtactaccgttccggaccccggtactttaacgttcggtttaacccgttacggggtaaaacccggttcggggtaaccccgtaaacgggttaccctaaccccggttaccggtaaaccggttaccacccgggtaacccccgg

SEQ ID NO: 183471 - DNA, 567 bp, Homo sapiens
  misc_feature: GYAE6OF02GLE4N.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgaggggaaggggctgggagtgcgtcttcttttattatagttagtggtatacatactccgcagactcgtggacgggccattcaccatctcagagacaataccaaggggaacacgcttcgtttacttactaatacgaacacgcctagagacgccgatacgacgacggccgtagttacttacgtgtcgcgagagagtcgggacccgaccggtaaccgttacctacgcgtacgtcggtaccgtcggtcgggaccgaacgggtacccgg

SEQ ID NO: 183472 - DNA, 511 bp, Homo sapiens
  misc_feature: GYAE6OF02GZW4X.13.76.G10.1.454.CMB.1.raw
  modified_base (314)..(314): a, c, t, g, unknown or other
  misc_feature (314)..(314): n is a, c, g, or t
  modified_base (414)..(414): a, c, t, g, unknown or other
  misc_feature (414)..(414): n is a, c, g, or t
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcnctcttctggggtccctcatcgcttctctgctccatccttgggaacaaagctgcccttatcatcacggggcccaggcagaagatgaatctgattattactntgttctttatattgggtatgctaattctgtctgtgttcggaggtaggccgaccggctgacccgtcctcggtcacgcccgaaggcctcgcccatccgg

SEQ ID NO: 183473 - DNA, 503 bp, Homo sapiens
  misc_feature: GYAE6OF02HWT8U.13.76.G10.1.454.CMB.1.raw
  modified_base (293)..(293): a, c, t, g, unknown or other
  misc_feature (293)..(293): n is a, c, g, or t
  modified_base (446)..(446): a, c, t, g, unknown or other
  misc_feature (446)..(446): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccacctcagtgtccgtgtccccaggacagacagccagcatcacctgctctaggaaataaattggcagataaatatacttcctggtatcagcagaagtcaggccagtcccctgtgctggtcatctatcaagntgccaagcggccctcgagggactccctgagcgattctctggcctccaactcgtagggaactcacgccactcctcgaccatcgacgccgggacccaggctatggatgagctgactattactgtacgaggcgtgggacagcgagcactcgcccgntacgtcgtccttacggaactcggaaccaggtccacccgttacaacgtccacgacccg

SEQ ID NO: 183474 - DNA, 564 bp, Homo sapiens
  misc_feature: GYAE6OF02G5HEY.13.76.G10.1.454.CMB.1.raw
  modified_base (492)..(492): a, c, t, g, unknown or other
  misc_feature (492)..(492): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtgggtccgccaggctccgaggggaaggggctggagtgcgtcttcttttattatagtagtggtagtacatactcgcagactccggtggaggggcctattccacctatctccagacgactaattccaaagaaccacgtcttgtttcctacaaattgaaacacgcctagagacgccgagtcgacgacggccgtagttacttacgtgngcgagagaggtcggggacccaacggtaacgttactacgctagtcggacgtcggtcggggaccaagggacccg

SEQ ID NO: 183475 - DNA, 491 bp, Homo sapiens
  misc_feature: GYAE6OF02FLYXC.13.76.G10.1.454.CMB.1.raw
  modified_base (435)..(435): a, c, t, g, unknown or other
  misc_feature (435)..(435): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccagggctatggatgaggctgactattactgtcaggcgtgggacagcagcacgtcgcccgntagtcgtcgttacggaactcgggacctaaggtccaccgtcctaagtccagaccccg

SEQ ID NO: 183476 - DNA, 567 bp, Homo sapiens
  misc_feature: GYAE6OF02GGY6B.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgaggggaaggggctggagtgcgtcttcttttatttatagtagtggtagtacatactccgcagactccgtggaggggccgattccacctatctccagagacaattaccaagaacacgcttgtttctacaaatgaacagcctgagacgccgatcgacgacggccgttgttacttacgtgtgcgaggagagtcggggccccaacggtaaccgttacgtaccggtctaagtcgggtaccggttcggtacgggggacccaaggggtaccccg

SEQ ID NO: 183477 - DNA, 526 bp, Homo sapiens
  misc_feature: GYAE6OF02GEMWV.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtcccgccaggctccgaggggaaggggctgggagtgcgtctcttttatttatagtagtggtagtacatactccgcagactccgtgaggggccattcaccatctcagagacaattccaagaacacgctgtttcttacaaatgaacagcctgagagccgatcgacacggccgtgtattactgtgcgagaggatcggggcccacgaacgttactacgctagtggacgtcgtgggaccg

SEQ ID NO: 183478 - DNA, 581 bp, Homo sapiens
  misc_feature: GYAE6OF02HHLFY.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacaggggcgtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagntgccaagccggccctcgagggactccctgacgcgtattctcgtggctaccaacttcgtgggaacctcgacgcccactctacgaccatcacggccggacccgaggcctagtgggaatggacggctagtacttacttacgtgttacgagggtcgtgggaaccaggtacacgccaccgttcggcccgtacgttacgttcggtaccgtttacgggaaccggttacggggaaccgttacgggttaccctaacccggttacccgttaaacggtacccgaacggtaacccccgg

SEQ ID NO: 183479 - DNA, 590 bp, Homo sapiens
  misc_feature: GYAE6OF02GT9VM.13.76.G10.1.454.CMB.1.raw
  modified_base (364)..(364): a, c, t, g, unknown or other
  misc_feature (364)..(364): n is a, c, g, or t
  modified_base (428)..(428): a, c, t, g, unknown or other
  misc_feature (428)..(428): n is a, c, g, or t
  modified_base (444)..(444): a, c, t, g, unknown or other
  misc_feature (444)..(444): n is a, c, g, or t
  modified_base (542)..(542): a, c, t, g, unknown or other
  misc_feature (542)..(542): n is a, c, g, or t
tcagtcacgtactacacgaccggtgctcgatttagtcactcatacaggggggagaggagcccagcactgggattccgaggtgttccattcggtgatcagcactgaacacagaggactcaccatggagttttggctgagctgggttttccttgttgctattttaaaaggtgcccagtgtgaggtgcagctggtggagtcgtggaggaggcttgatccagcctggggggtccctgagactctcctgtgcagcctcgtgggttccaccgtcagtcacacctacatgacgctgggtcccgccaggctccgaggggaagggctggagtgcgtctcgttttattatagtagtggtagtacattactccgntacgactccggtggacggggccgtattccgacctatctcccaagacgtacaacttacaagaacncgtactgtttccttanaaatcgaactacgcctgaagcaccgtatagacccaacgggcttagttatacctaggtcgacgaaggagagtccggggaaccccaagtaaccggtttanacggtacctagtacgggaccgtccggttacggggactaacggggaccc

SEQ ID NO: 183480 - DNA, 539 bp, Homo sapiens
  misc_feature: GYAE6OF02GMR1H.13.76.G10.1.454.CMB.1.raw
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcactcgcttctctggcctccatccttagggaacaaagctcgccctttatcatcgacggggcccaggcagaagatagaatctagtattattacttgttgtttctttatagttgggttagtcgtctatttcgtgtcgtgttgttcgggaggaggccgacccggctcggacccgtccgtcgtccgacgccgaacggctcgccccagtccgg

SEQ ID NO: 183481 - DNA, 757 bp, Homo sapiens
  misc_feature: GYAE6OF02F8Y2H.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtggttcaccgtcagtccacacctacatgagcgtcgggtccgccgaggccgtaccggaaggggaacggggcgtgggaggttcggtccgttctttcttttaatttagtaggtagttggtaacgtactacttaccgtccgacgtacgtaccgtccggtagggacgggggtaccctactttacccgaacctacttcccgtaccgaaggtaacctaaacctaaacgttacccgaaaacgtaaacccgacggtttacctttacggttttaaccctaaacgtaaaacgttacgaaaccgtcggtacccgtaggaacgtaccgaccgtagtaccggaccgtaaccgggtcgttagttaacgtttacgtggtacgacggaaggtacggtacgggtacccgggtaaccccgtaaacggtttaaccggttaccgtacggtaccgtttaacgggtcccgggttaaccgggttaccgggaccggggtaacccggtaaccgggtaacccccggg

SEQ ID NO: 183482 - DNA, 505 bp, Homo sapiens
  misc_feature: GYAE6OF02I3WMM.13.76.G10.1.454.CMB.1.raw
  modified_base (407)..(407): a, c, t, g, unknown or other
  misc_feature (407)..(407): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctaggaaataattggcagataaatatacttcctggtatcagcagaagtcaggccagtcccctgtgctggtcatctatcaagatgccaagccggccctcgagggactccctgagcgattctctggctccaactctgggaactcgagccactctgaccatcagccggaccaggctatggatgaggctgactattacngtaccaggcgtgggacagtcagccactcgcccgtctagtcgttccgttacggaacgtcgggaccgtaaggtccaccggtctaacgtccgacgtacccg

SEQ ID NO: 183483 - DNA, 541 bp, Homo sapiens
  misc_feature: GYAE6OF02I42X7.13.76.G10.1.454.CMB.1.raw
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactccgcagactccgtgaggggccgattcaccatctccagagacaattccaaagaacacgcttgtttcctacaaattgaacagcctagagagccgatcgacacgggccgtgtacttacngtgcgagagngtcggggcccaacggaacgttactacgcttagcgggacgtcgtcggggaccagggacccg

SEQ ID NO: 183484 - DNA, 515 bp, Homo sapiens
  misc_feature: GYAE6OF02F0CCW.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagntgccaagcggccctcagggactcccgtgacgcgtattcctcgtggcctaccgaactctcgggaacttcagccctactctacgaccatcgagccgggacccaggctagtggatggagctgactattactgtcaggcgtgggactagcagcacgtcgcccgctagtcgtcttacgggaactcgggaaccaaggtccaaccgtccctaagtccgacgtaaccccg

SEQ ID NO: 183485 - DNA, 526 bp, Homo sapiens
  misc_feature: GYAE6OF02GLTRY.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactcgcagactccgtgaggggccgattcaccatctccagagacaattccaagaacacgctgtttctacaaatgaacagcctgagagccgatgacgacggccgtgtacttactgtgcgagagagtcggggcccaacgaacgttacacgctagtcggacgtcgtcgggccagggacccg

SEQ ID NO: 183486 - DNA, 528 bp, Homo sapiens
  misc_feature: GYAE6OF02FSOFI.13.76.G10.1.454.CMB.1.raw
  modified_base (292)..(292): a, c, t, g, unknown or other
  misc_feature (292)..(292): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccagggaagggctggagtgcgtctcttttattatagtagtggtatacatactccgcagactccgtgaggggccattcaccatctccagagacaattccaaagaacacgctgtttctacaaattgaacagcctgagacgccgatgacacggccgtgtattactgtgcgagagatggggcccaacggaacgttacacgctagtggaccgtcgtggggacctaagggacccg

SEQ ID NO: 183487 - DNA, 539 bp, Homo sapiens
  misc_feature: GYAE6OF02GQWJ5.13.76.G10.1.454.CMB.1.raw
  modified_base (292)..(292): a, c, t, g, unknown or other
  misc_feature (292)..(292): n is a, c, g, or t
  modified_base (429)..(429): a, c, t, g, unknown or other
  misc_feature (429)..(429): n is a, c, g, or t
  modified_base (464)..(464): a, c, t, g, unknown or other
  misc_feature (464)..(464): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaaggggctggagtgcgtctcttttattatagtagtggtagtacatactccgcagactccgtgaggggccgattcaccatctccagagacaattccaagaacacgctgtttcttcaaatgaacngcctgagagccgatgacacggccgtagtattacgngtgcgaggagagtcggggcccaacggtaacgttacgtacgctaagtcgggaccgtcgtcggggccaagggacccg

SEQ ID NO: 183488 - DNA, 607 bp, Homo sapiens
  misc_feature: GYAE6OF02FWG7P.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtgggtcccgccgaggcctccgaggggaacggggctgggagtgcgtcttcttttattatagtagtggtagtacatactccgcagtactccgtggacggggcctattccacctatcctccgaagacgaacaaacttaccaaagaaccacgtcttcgtttactacaaattcgaaactcgacctgagacgaccgatcgaccgacggccgttagtacttacgtggtacgacgagagacggtccgggggaccctaacggtaacccgtttaccgtacgtacgttacgtcgggtacccgttcggtacggggaccgaacggggtaaccccg

SEQ ID NO: 183489 - DNA, 482 bp, Homo sapiens
  misc_feature: GYAE6OF02GH2A6.13.76.G10.1.454.CMB.1.raw
  modified_base (433)..(433): a, c, t, g, unknown or other
  misc_feature (433)..(433): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtccccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgntagtgtcttcggaactggaccaggtccaccgtcctaacgtcagaccccg

SEQ ID NO: 183490 - DNA, 614 bp, Homo sapiens
  misc_feature: GYAE6OF02GJHGR.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatacaagntcgacaaggccgccctcgacggtactcccgtgacgcgtacttctcgtcgctaccaactcgtacggaactcgacgcctactctacgacctacgtacgacggaccgggaacccacggtactacggtacggacttacgggacggtcgtacgtaacctttaactttaccgtcgttaccgacgggtccggttacgggaacgacgtaccgaacgtccacgtcccgacccgttacgtacgttcggttacccgttaacgggtaaccggtaccgggtaaccgaacgggttcccgtaacccgtacgtaaccgtaccgacccgtaaccccgg

SEQ ID NO: 183491 - DNA, 761 bp, Homo sapiens
  misc_feature: GYAE6OF02JG6M9.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagtttggctgagctgggttttccttgttgctattttaaaaggtgcccagtgtgaggtgcagctggtggagtctggaggaggcttgatccagccgtgggggtccctgagactctcctgtgcagcctgtgggtcaccgtcagtcacacctacactgacgcgtcgggtcccgccgaggccgtaccgaaggggaacgggcctgggacgtggaccgttcttcgttttagttacgttaggtagttaggtacgttacgtactaccgtccgtacagtaccgtcccggtagggtaacggggcccgtaagtttacccgaaccgtactccgttaccgaagaacgtaaccaaactttccgaaaacggtaaccctacgtaccgttacgttttacccttaacgtaaaacgttacgaaacccgacggtaccgttacggaaacggaccggtaacccgtaagttaccggaaccggtacccgggtaccggtttagttaaacgtttacgtcgggtaacgaccggtaaggtaccgggaagggttacccgggggtaacccctaacggttaaacccgggtttaaccaaccgggtaacttacgggtacgggtacccggttacgggtaccgggggaacccgtaaccgggggtaacccccgg

SEQ ID NO: 183492 - DNA, 634 bp, Homo sapiens
  misc_feature: GYAE6OF02JBGCM.13.76.G10.1.454.CMB.1.raw
tcagtcacgtactacacgaccggtgctcgatttagtcactcatacagggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataatatactcctggtatcagcagaagtcaggccacgtcccctgtcgctggtctatctatcaagatcgccaagccggccctcgagggactcccgtgagcgattcctcgtcggccttccaaactcgtacgggaactcgacgccactcctcgaaccactacacggaccgggacccgagggtctagtacggtagtggaacgggtcttaggaacctttaacgtttaccgttggtaccgtacgggtccggttaggggaaccaagggtccgaacggtaccgtaaccgttcgggacccccgtacgttagtccggtttaccgttaaccggggaaccgttccgggggaaccctaaccgggttacccgtacccggtttaaccctaaaccggtccgtaaccggaccccccgtaaaccggg

SEQ ID NO: 183493 - DNA, 520 bp, Homo sapiens
  misc_feature: GYAE6OF02IWICL.13.76.G10.1.454.CMB.1.raw
  modified_base (346)..(346): a, c, t, g, unknown or other
  misc_feature (346)..(346): n is a, c, g, or t
  modified_base (364)..(364): a, c, t, g, unknown or other
  misc_feature (364)..(364): n is a, c, g, or t
  modified_base (447)..(447): a, c, t, g, unknown or other
  misc_feature (447)..(447): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgaccaagcggccctcgagggactccctgagcgattctctggctccaactcngggaactcagccactctnaccatcgagcgggaccaggctagtggatgaggctgacttagttactgtacgaggtcgtgggacagcagccacgccgacccgtnttacgtcgttaccgttacgggaacgtcgggaacctaacgggttccacccggtacctaacgtccgacgaccccg

SEQ ID NO: 183494 - DNA, 524 bp, Homo sapiens
  misc_feature: GYAE6OF02F37SL.13.76.G10.1.454.CMB.1.raw
  modified_base (449)..(449): a, c, t, g, unknown or other
  misc_feature (449)..(449): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcagtctatcaagatgccaagcggccctgagggactcccgtgacgcgattctctggctcaactctgggaactcagccacgtctgaccatcgagtccgggaccaggctagtcggatgagctgactattacgtgtacgaggtcgtgggactagcaggccaacgtcgacccgntacgtcgttaccgttaccgggaacttcggggaaccaacgggttccaacccgttacgtaacgtccacggaaccccg

SEQ ID NO: 183495 - DNA, 628 bp, Homo sapiens
  misc_feature: GYAE6OF02JSFB7.13.76.G10.1.454.CMB.1.raw
  modified_base (242)..(242): a, c, t, g, unknown or other
  misc_feature (242)..(242): n is a, c, g, or t
tcagtcacgtactacacgaccggtgctcgatttagtcactcatacagggctgggcctcaggaagcagcatcggaggtgcctcagccatggcatggatccctctcttcctcggcgtccttgccttactgcacaggatccgtggcctcctatgagctgactcagccaccctcagtcgtccgtgtcccccaggaccagacagccagcatccacctgctctaggaaataagttggcaagataaatntacttctgtatcagcagaagtcaacggcacgtcccctgtgctggtacactctagtcaagtatcgccgtaagccggccctgacgggtatccccgtaggacgtcgtactttcgtcgtacggtcccttaccaacttcgtacgggtaacctcgaacgccctaacgtcctaacgacctagtccgacggaccggtacccaggtccctagtagacgtacggcgtaccgtagtaacgttacgttacgtaggtaccgagggtccgttcggggaaccacgacgaacgtacggaaccgtcgtacccgtacgtacgttccggttaccgttacggtaaccggttacggaaccgtaccggtaccgtacccgttaccgtaacgttaccgacccgaacccgg

SEQ ID NO: 183496 - DNA, 483 bp, Homo sapiens
  misc_feature: GYAE6OF02FUVTS.13.76.G10.1.454.CMB.1.raw
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtccccctgtgctggtcatctatcaagatgccaagcggccctcagggatccctgagcgattctctggctccaactctgggaactcagccactctgaccatcagcgggacccagggctatggatgaggctgactattactgtcaggcgtgggacagcagcacgtgcccgctatgtcttcggaactgggaccaaggtcaccgtccaagtcagcccaacgg

SEQ ID NO: 183497 - DNA, 573 bp, Homo sapiens
  misc_feature: GYAE6OF02JDK3D.13.76.G10.1.454.CMB.1.raw
  modified_base (349)..(349): a, c, t, g, unknown or other
  misc_feature (349)..(349): n is a, c, g, or t
  modified_base (387)..(387): a, c, t, g, unknown or other
  misc_feature (387)..(387): n is a, c, g, or t
tcagtcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacagaccccaggccaggctccgcgcacgctcatctacaacacaaacactcgctctctcggggtccctcatcgcttctctgctccntcctggaacaagctcgccttatcactcgaccggggccnggtcagaagatgaatctagtattacttactgttgttctttagttagttgggttaagtcgtaccttatttccttgtaccgtggttcgttcggtaggtaggtccgtacccgggcgttacggtacccgttccgtccgggttacgacggtaccccgaacgggtccgtaccgcccccgtacgttacccggg

SEQ ID NO: 183498 - DNA, 730 bp, Homo sapiens
  misc_feature: GYAE6OF02H0BAS.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggttttccttgttgctattttaaaggtgccagtgtgaggtgcagctggtggagtctgggaggaggcttgatccagccgtggggggtcctggagactctcctgtgcacgccttcgtcgggttccaccgtcagtcacacctacatgacgcgtcgggtcccgccaggcctaccgaaggggaacggggtctagggaggtgccgttcttctttttaattagttagtacgttggtagtactattaaccgtccgacacgtacctccgggtaggacgggggtccgaacttccgaacccgtattcctacccgtaaggtaacgtaacctaaacttacccgaaaaggtaaaccgaaccgttccgtttacgttttacccttaacgtaaaattacgaaactacggtaccgtaggaacggaacggtaccgtaacgtacggaaccgtaccgggttaccgttaacgttaacgtttaacgttggttacggaccggtaagggtaacgggtacggtacccgggggaccctaaaccggttaaaccggtttacgtaaccggtacgttaacggttacggaccggttaccgggtacgggtaacccggg

SEQ ID NO: 183499 - DNA, 614 bp, Homo sapiens
  misc_feature: GYAE6OF02HNF4M.13.76.G10.1.454.CMB.1.raw
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccaggctccgaggggaggggctggagtgcgtcttcttttattatagtagtggtagtacatactccgnacgctcgtggacggggcctattccacctatcctaccagacgaactaaacttcccaaagtaaccacgtcttacgttttaccttaacaaaattcgaaaccngtaccctagacgacgcccggaatcgaaccgaccggtccgttagttattacgtgtacgacgaggagtacggtcggggaccccaacggtaaccgttacgaaccgtcttaacggtcgggaccggttcggtacgggggacccgaacggggtaccccg

SEQ ID NO: 183500 - DNA, 607 bp, Homo sapiens
  misc_feature: GYAE6OF02IPZ89.13.76.G10.1.454.CMB.1.raw
  modified_base (330)..(330): a, c, t, g, unknown or other
  misc_feature (330)..(330): n is a, c, g, or t
  modified_base (480)..(480): a, c, t, g, unknown or other
  misc_feature (480)..(480): n is a, c, g, or t
tcagtcacgtactacacgaccggtgctcgatttagtcactcatacagggggggggggctgagcccttctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggactccctctcttcctcggcttccttgcttactgcacaggactccgtggccctctatgacgctgactcacgcccaccctcacgtcgtccgtcgtaccccaggacagacncgccagccactccacctcgcttacgtaggtaaattaaacgtcggactaacggtaataaattacttactttaccgtggtaatcgagtacgtaagaacgtacgacggtacccgtacgtccccgtgttcgacgttcggtactacgttacttanaccgtaagtactacgaccgaagcccggtacccgtagaacgggtcctccgtacggacgtccgtatttacccgtcgttacggtcccttaacccgtacgttcggtacggtaacctcgtaccgcccgtacg

SEQ ID NO: 183501 - DNA, 563 bp, Homo sapiens
  misc_feature: GYAE6OF02JSBTD.13.76.G10.1.454.CMB.1.raw
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (508)..(508): a, c, t, g, unknown or other
  misc_feature (508)..(508): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtgggggtccctgagactctcctgtgcagcctctggttcaccgtcagtcaccacctacatgagcgtcgggtccgccgacggcgtccgacgggaagggcgtggagtgcgtctcttttaattatagtagtggtagtacatacgtcgcagtactcgtgagggtccgattcaccgatcaccaggaacncgagtgaccgactaactcccgtaanctatcggaacaaatcgaaaccgtagtctacgggagttcagggactaccgggctttgattttccggtgacgtaggttacngaggtgtcttaggtacctacgagtacggtggtcctaggtcgggaccgaaggtccg

SEQ ID NO: 183502 - DNA, 565 bp, Homo sapiens
  misc_feature: GYAE6OF02ICOLA.13.76.G10.1.454.CMB.1.raw
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccncaggctccgagggaagggctgggagtgcgtcttcttttatttatagtagtggtagtacatactcgcagactcgngacgggcatcacatctcagagacaattccaagacacgcttgtttcttacaaatcgaacagcctgagacgccgatcgaccacgggtccgttagtacttaacgtgtgacgagacggaggtcggggaccccaacggtaaccgtttaacgaccgtacttagtcggtaaccgttcggtacggggacccgaagggtaccccgg

SEQ ID NO: 183503 - DNA, 653 bp, Homo sapiens
  misc_feature: GYAE6OF02JV4AA.13.76.G10.1.454.CMB.1.raw
  modified_base (298)..(298): a, c, t, g, unknown or other
  misc_feature (298)..(298): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctccgtgtgcagcctcgtgggttcaccgtcagtcacacctacagtgagcgtcgggtcccnccaggctccgagggagggctggagtgcgtctcttttagttatagtagtggtatacatactccgcgtaacgtcgttccggtaggacgggggtccctagttcccgaaccgtagttcctaccgaagacgtaacctaaacgtttacccaaaggaacctacggtccttacggttttacccttaaccgaaaattcggaaacctacggtaccctggaacggtacgcccgtaagtcgaccgaccggtccgttagttaacgttaccgtggtcgaccggaagagtacggtcccggggaaccctaacggtaacgtttaccgacgtcttaaggtcgggtacgtccgtggggacccaacgggtacccg

SEQ ID NO: 183504 - DNA, 565 bp, Homo sapiens
  misc_feature: GYAE6OF02GZDZ7.13.76.G10.1.454.CMB.1.raw
  modified_base (423)..(423): a, c, t, g, unknown or other
  misc_feature (423)..(423): n is a, c, g, or t
  modified_base (458)..(458): a, c, t, g, unknown or other
  misc_feature (458)..(458): n is a, c, g, or t
  modified_base (500)..(500): a, c, t, g, unknown or other
  misc_feature (500)..(500): n is a, c, g, or t
  modified_base (509)..(509): a, c, t, g, unknown or other
  misc_feature (509)..(509): n is a, c, g, or t
  modified_base (549)..(549): a, c, t, g, unknown or other
  misc_feature (549)..(549): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtccgccgaggctcccgaggggaaggggctggagtgcgtcttcttttattatagtagtgtagtacatactccgcagtactccggtggacggggccgtattccacctatcctaccagacgacaaattccaaanaaccacgtcttagtttactacaaaagttcgaaacncgcctgaacgacgccgatgaccgacggccgttatacgttacngtagcgagngagtcgggacccagtaacgttcacgctagtcggacgtcgngggaccgaaggtcccg

SEQ ID NO: 183505 - DNA, 538 bp, Homo sapiens
  misc_feature: GYAE6OF02G144T.13.76.G10.1.454.CMB.1.raw
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (449)..(449): a, c, t, g, unknown or other
  misc_feature (449)..(449): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttcctgtgctatttaaagtgccagtgtgaggtgcagctggtggagtctggaggaggcttgatccagcctggggggtccctgagactctcctgtgcagcctctgggttcaccgtcagtcacacctacatgagctgggtccnccaggctccgagggaagggctggagtgcgtnttcttttattatagtagtggtagtactatactccgcagtactcgtggagggccatcacatctaccgagagactaattccaagaactacgcttgtttctacgaaatgaactagcctagagtagccgaatcgacncgggccttagtattctgtgcgagagagtcggggccctagtaacgttactacgtctagtcggtacgtcggacggggtacaagggtacccg

SEQ ID NO: 183506 - DNA, 527 bp, Homo sapiens
  misc_feature: GYAE6OF02IX1C7.13.76.G10.1.454.CMB.1.raw
  modified_base (393)..(393): a, c, t, g, unknown or other
  misc_feature (393)..(393): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgacaagcggccctcgagggactccctgacgcgattctctggcctaccaactctagggaacctcgacgccactctgaccatcacgcggacccgagctagngatggagctagactaatacgtgtcgaggtcgtcggacagcagccacgtcgcccgtactacgtcgtaccgttcggaaacgttcgggaaccgtaacggtacctaccggtacccgtaacggtcgaccgtaaccccgg

SEQ ID NO: 183507 - DNA, 706 bp, Homo sapiens
  misc_feature: GYAE6OF02JH8AT.13.76.G10.1.454.CMB.1.raw
  modified_base (323)..(323): a, c, t, g, unknown or other
  misc_feature (323)..(323): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatcagccgtgggggtccctgagactctcctgtgcagcctcgtgggttcaccgtcacgtcacacctacatgagctggtcccgcaggctccgagggaagggctggagtgcgtnttcttttattatagttagtgtagtacatacctcgcgtagacgtcgtggacgggggtccaattccacctatccgttaccgaaggtaacgtaacctaaacttacccgaaaagtaacctaccgtactttacgttttacccttaactaaaacgttcgtaaaccgtacgtacccgttaggaacgtaacgaccgaagttaccgaaccgtaaccgggtccgttacggttaagtttaaccgtaggttacggacgggtaacgtacgggtaacggtaccgggggtaccccctaaacgggtaaaccggtttaaccgtaaccgtaccgtttaacggtaccgggtaaccggtttccgggtacccgggggtaaccgtaaccgggggtaaacccccgg

SEQ ID NO: 183508 - DNA, 636 bp, Homo sapiens
  misc_feature: GYAE6OF02IKKJR.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctacatgagcgtcgggtcccgccgaggcctaccggaagggggaacgggggctgggagtgtcgtcttacttttatttatagtagtgtagtacatactccgacagactcgtggacggggcctattccaccatccacagacgaacaattaccaaagaacaccgtcttgtttaccttacaaagttcgaaccagccctaggacgacgccgtatacgaccggtacggtccgttagttacttacgtgtacggacgtaaggagtacggtacggggaccccgtaacggtaaccggtttaaccgtacgtaccgttacggtccgggttaccgttcccgggtacgggggacccggtaaacggggtaccccgg

SEQ ID NO: 183509 - DNA, 501 bp, Homo sapiens
  misc_feature: GYAE6OF02GXPVQ.13.76.G10.1.454.CMB.1.raw
  modified_base (417)..(417): a, c, t, g, unknown or other
  misc_feature (417)..(417): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcagaagtcaggccagtcccctgtgctggtcatctatcaagatgaccaacgcgccctcgacgggactccctgacgcgattctactggctccaactcgtcgggaactcgacgcccactctcgaccatcacggccggaccaggctagcggatgaggctgactattacngtacaggtcgtggacagcacgcacgtcgccgtctagtcgtcttacggaacgtcggacaggtcaccgtactagcacgcccaacgg

SEQ ID NO: 183510 - DNA, 553 bp, Homo sapiens
  misc_feature: GYAE6OF02H7GML.13.76.G10.1.454.CMB.1.raw
  modified_base (297)..(297): a, c, t, g, unknown or other
  misc_feature (297)..(297): n is a, c, g, or t
  modified_base (425)..(425): a, c, t, g, unknown or other
  misc_feature (425)..(425): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtggggggtccctggagactctcctgtgcagcctcgtgggttcaccgtcagtcacacctacatgagctgggtccncacggctccgaggggagggctggagtgcgtcttctttattatagtgtgtatacatactcacagactcggtggcgggcctagttcaccatctaccagacgaactaattccaaagaacacgcttcgtttntactaaatcgaacagcctgagacgcgactgacacggtccgtagttacttcgtgtcgagagagacgtacggggccctaacggtaacgtaccgtacgactagcggacgtcggacgggaccgaggacccgg

SEQ ID NO: 183511 - DNA, 608 bp, Homo sapiens
  misc_feature: GYAE6OF02J1AMC.13.76.G10.1.454.CMB.1.raw
  modified_base (296)..(296): a, c, t, g, unknown or other
  misc_feature (296)..(296): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtcccgtgtccccaggacagacagccagcatccacctgctctaggaaataattggacagataaatatacttctggtatcagcagaagtcaggccagtcccctgtgctggtcatcgtatcaagntcgccaagccggccctcgacgggactcccgtgacgtcgaattcctctcggcctccaactcgtacgggaactcgacgccactctcgtaccatccgagtccggaccaggctagtcggataggacggtctagcttacttacgtgtaccgtaagggtccgttacggggacaacgggactacggccgtaacgtccggtaccccgtacgttaacggtttcggtaccggttaaccgggtaacccgttacggggtaacccgtaaccgggttcccgaaaaccccggttcccgtaaacgggttccacccgggtaacccccgg

SEQ ID NO: 183512 - DNA, 596 bp, Homo sapiens
  misc_feature: GYAE6OF02JA6HI.13.76.G10.1.454.CMB.1.raw
  modified_base (516)..(516): a, c, t, g, unknown or other
  misc_feature (516)..(516): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtcccgccaggcctccgaggggaaggggctgggagtgcgtcttcttttattatagtagtggtagtacatactccgcagtactccgtggacggggccgtattccaccgtattcctacccgaaggacgaactaaatttcccaaagaaccacgtcttgttttccttacaaattagaacacgcctagacgacgcccgagtgaaccacgggcccgttagtactttacgngtacgcgaagtacgaggtcggggcccctaaggtaaccgttactacggtcttagcgggtaccgttcggtcggggaacccgg

SEQ ID NO: 183513 - DNA, 723 bp, Homo sapiens
  misc_feature: GYAE6OF02JQ3I2.13.76.G10.1.454.CMB.1.raw
  modified_base (551)..(551): a, c, t, g, unknown or other
  misc_feature (551)..(551): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggttttccttgttgcttaattttaaaaggtgcccagtgtgaggtgcagcgtggtggagtcgtggaggaggcttgatccgagccggtgggggtccctgacgacgtcctccgtgtcgcacgtcctcgtcggttccaccgtcacgtccaccacctacatgacgcgtcgggtcccgccgacggccgtaccggaaggggaacggggtcgtagggtaggtcggtccgttcgtttacttttagttagttaggttacggttaggttaagtactacgttaccgtccgtacgacgtaccgtccggtcgggacggggtaccgtactaccgacctacgttcccgaacgagtaacgaacctaaacttacccgaaacgtaacgtacgttccttagttttaccacaaaagttcgaaacncgtcctaaggacgtacgaccgtaagtccgaaccggtccggtaccgttgttaacgttcgtggacggtacgaaggtaacgggtcggtaccggggaaccctaaccggtttaaaccggtacgtaccggtacggttaaggtaccgggtaaccggttcggggtacccgggaaaccggg

SEQ ID NO: 183514 - DNA, 583 bp, Homo sapiens
  misc_feature: GYAE6OF02HND9X.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagaataaatatacttcctggtatcagcagaagtcaggccagtcccctgtgctggtcatctatcaagatgaccaagccggccctacgacgggactcccgtagacgcgtattctcgtcggctaccaactcgtacgggaacctacgacgacctacgtcctacgaaccactacgacggaccgggacccgaggcctagtagggataggacggtcgtacgtaacttattacgtgtaccgagggtcgtagggaaccaggcgacgcctacgtcgacccgtagtacgttcggtaccgttacgggaaccgttcgggaaccctacggtccaacccggttaccgtaacgtccgaacgtaaccccgg

SEQ ID NO: 183515 - DNA, 583 bp, Homo sapiens
  misc_feature: GYAE6OF02F7X38.13.76.G10.1.454.CMB.1.raw
  modified_base (294)..(294): a, c, t, g, unknown or other
  misc_feature (294)..(294): n is a, c, g, or t
  modified_base (396)..(396): a, c, t, g, unknown or other
  misc_feature (396)..(396): n is a, c, g, or t
  modified_base (443)..(443): a, c, t, g, unknown or other
  misc_feature (443)..(443): n is a, c, g, or t
  modified_base (461)..(461): a, c, t, g, unknown or other
  misc_feature (461)..(461): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggggtccnccaggcctccgaggggaacggggctgggagtgcgtcttcttttattatagtagtggtagtacatactccgcagacctcggtggaggggccattccaccatcnccgagacgacaattccaaagaccacgtcttgtttctacaaatgaacngcctgacgacgaccgtangaccgtacggccgttagtacttaccgtggtgacggagacgtagtcgggggacccctaacggtaacgttaaccgtacgtactagtcggaccggttcggtacgggggacccaagggtaccccgg

SEQ ID NO: 183516 - DNA, 711 bp, Homo sapiens
  misc_feature: GYAE6OF02I0VGO.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaaggtgcccagtgtgaggtgcagctggtggagtctggaggaggcttgatccagccgtgggggtccctgagactctcctgtgcagcctcgtgggttcaccgtcagtcacacctacatgagcgtgggtccgccgaggcctccggagggggaacggggctgggagtggtccgttcttactttttaatttagtagttaggttggtacgtaactataccgtccgactacgtaccgttccggtaggacgggggtcctacgttaccacctactcctaccgaagaacgaactaaacttacccgaaagaaaccgacgttcttacgttttacttaaccaaaagttcgaaacccgtacgtcccgttaaggacgaccggaccgtaagtaccggaaccgtaccgggttccgttaagttaactttacgtggtacggacggtaaggacggtacggtaccggggaacccctaacggttaaacccgttaccgaccggtacgttaacggttccggggtaaccgttccgggaccgggggaacccggtaaccggggtaacccccg

SEQ ID NO: 183517 - DNA, 627 bp, Homo sapiens
  misc_feature: GYAE6OF02G8UWQ.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccggtcagtcacacctacatgagctgggtcccgccaggctccgaggggaacggggctggagtcgcgttcttcttttatttataggttagtggtagtacatacctccgcagacctcgtggacggggcctattccaccatctccagagactaattccaaagaacacgcttcgtttactacaaagtgaaaccagccctaggacgtacggacccgtagtacgaccgaccggtccgttagttaactttaccgtggttcgaccggtaaggagtacggttaccggggggacccctaacgggtaaaccgtttaccgaccggtacgtaacggttcgggaaccggttcgggacggggtacccgaacggggtaccccgg

SEQ ID NO: 183518 - DNA, 743 bp, Homo sapiens
  misc_feature: GYAE6OF02JUVVD.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtgggggtccctgagacctctcctgtcgcacgcctcgtgggttccaccgtcacgtccaccacctacatgacgcgtcgggtcccgaccgacggccgtaccgaggggaacgggcgtgggagtcggtcgttcttactttttagttagtaggttaggtggtagtactagttaccgtccgactaacgtaccgtccggtaggacggggtccgtacgttaccgaccgtactccgtaccgaacggacgtaactaaccgttaaccgaaacggtaaacccgtacgggttacgttaacttaccgtttaaacgaaacgttacggaaaccgtaccgtaggaacggtacggtacggaaccgggtacgtacccgggtaccgttacgttaacgttacgtaggtacggaacgtaaacggtcgtagtaccggaaggtaaccgggtaaccggggaacccccgtttaagggtacccgggggttacccgttggggttaccggggttaccgggttttccgttttaccggttacggtacccggg

SEQ ID NO: 183519 - DNA, 580 bp, Homo sapiens
  misc_feature: GYAE6OF02HNQL8.13.76.G10.1.454.CMB.1.raw
  modified_base (511)..(511): a, c, t, g, unknown or other
  misc_feature (511)..(511): n is a, c, g, or t
  modified_base (546)..(546): a, c, t, g, unknown or other
  misc_feature (546)..(546): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagcctggggggtccctgagactctcctgtgcagcctcgtggttcaccgtcagtcacacctacatgagcgtgggtccgccaggcctccgaggggaagggctgggagtgcgtcttcttttattatagtagtggtagtacatacctccgcacgtactccggtggacggggccctattccacctatcctaccagaacgtactaacttaccaaagaaccacgtcttagtttaccttacaaagttcgaaacagtcctagagacgccgtatacgaccgacggcgtagttacttacgtgngcgagagagtcggggcccaaggtaacgttcaccgntagtcggaccgttcggcgggaccacgggtacccg

SEQ ID NO: 183520 - DNA, 547 bp, Homo sapiens
  misc_feature: GYAE6OF02ICPTH.13.76.G10.1.454.CMB.1.raw
  modified_base (273)..(273): a, c, t, g, unknown or other
  misc_feature (273)..(273): n is a, c, g, or t
  modified_base (339)..(339): a, c, t, g, unknown or other
  misc_feature (339)..(339): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (428)..(428): a, c, t, g, unknown or other
  misc_feature (428)..(428): n is a, c, g, or t
  modified_base (464)..(464): a, c, t, g, unknown or other
  misc_feature (464)..(464): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggggtccctgagactctcatgtgcggcctcgtggctcaccgtcaacnccaactcatgagctgggtcccgccagctacgagggaagacggccggagtgggtctcagttatttangtcgacggtgccactattctagcagactcggtgagggccgttcaccatctccagacacaattccaaagaacncgtgtatctanaaattnaacgactgagagccgatgacaccggctgtattacgngtgcgagagagtgggccctaacggtaacttacgtacgacgtagtacggtcggtacgtcgggggaccacggggacctaaccggg

SEQ ID NO: 183521 - DNA, 661 bp, Homo sapiens
  misc_feature: GYAE6OF02JYAJ8.13.76.G10.1.454.CMB.1.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (297)..(297): a, c, t, g, unknown or other
  misc_feature (297)..(297): n is a, c, g, or t
tcagtcacgtactacacgaccggtgctcgatttagtcactcatacaggggcctgggcctcaggaagcagcatcggaggtgccgtcagccatggcatggatccctctcttcctcggcgtccttgcttactgcacaggatccgtggcctcctatgagctgactcagccaccctcagtgtccgtgtccccaggacctagacagccagcatcacctgctctggaactaattggcagataaatntacttccnggtatcagcagagtcaggccagtcccctgtcgctggtccatctatcaagntgccaagcggcctgagggtactcccgtgacgcgtattcctcgtacggcctaccgaacgttcgtacgggaacctcgaacggccctaacgtcctacggtaccagttcccgaacggccgggtaccccagggcctaaggtcggtagtacgggaacggtctacggaaccttacgttaacgtcggtacgtacgggtaccgttacggggaaccaggtaccgaacggtccacccgttacggccccgtacgttacggttaccggttaccgtttaacccgggtaaacccgttacgggggtaacccctaaacggggttaccccgaaccccgggtttaccctaaacgggttcccgaaaccggttaacccccccggg

SEQ ID NO: 183522 - DNA, 588 bp, Homo sapiens
  misc_feature: GYAE6OF02HAKS6.13.76.G10.1.454.CMB.1.raw
  modified_base (372)..(372): a, c, t, g, unknown or other
  misc_feature (372)..(372): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagcctggggggtccctgagactctcctgtgcagcctctgggttcaccgtcagtcacacctacatgagctgggtcccgccaggctccgaggggaagggcgtggagtgcgtctcttttattatagtagtgtagtacatactcgcagactccgnggacggggccattccaccatcctccagacgacaacttacccaaagaaccacgcttagtttccttacaaaattcgaactagccctagaacgacgcccgaagtcgaaccgacgggtcccgttagtacttacgtgtcggacgaggagtacggtccggggacccaacggtaaccgtttacgaaccggtctaagtcggtaccggttcggaccgggaaccgg

SEQ ID NO: 183523 - DNA, 570 bp, Homo sapiens
  misc_feature: GYAE6OF02F74P5.13.76.G10.1.454.CMB.1.raw
  modified_base (297)..(297): a, c, t, g, unknown or other
  misc_feature (297)..(297): n is a, c, g, or t
tcagtcacgtactacacgaccggtgctcgatttagtcactcatacgagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccnccaggcctccgaggggaaggggctggagtgcgtcttcttttatttatagtagtggtagtacatactccgcagactccggtggacggggccgtattccaccatcctccagacgacaattccaagaacacgcttgtttcctacaaatgaacacgcctagacgagccgatcgacgaccggtccgtagttattactgtagcgagagacgtcggggccctaaggaaccgttactacgctacgtcgggaccgttacggtcgggacccgaagggtacccg

SEQ ID NO: 183524 - DNA, 554 bp, Homo sapiens
  misc_feature: GYAE6OF02JIGWZ.13.76.G10.1.454.CMB.1.raw
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
  modified_base (433)..(433): a, c, t, g, unknown or other
  misc_feature (433)..(433): n is a, c, g, or t
tcagtcacgtactacacgaccggtgctcgatttagtcactcatacagggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggagggctggagtgcgtctctttattatagtagtgtagtacatactccgnagactcgtgaggggcctattcacctntctaccagagacaattccaaagactacgctgtttactacaaagtgaaacngtcctagagacgccgatcgacgacggtccgtagtacttacgtgtacgcgtagaggtcggtcggggaccctaacggtaacgttaccgtacgctaagtcgggtaaccgtcggtacgggacccg

SEQ ID NO: 183525 - DNA, 696 bp, Homo sapiens
  misc_feature: GYAE6OF02HOKTC.13.76.G10.1.454.CMB.1.raw
  modified_base (274)..(274): a, c, t, g, unknown or other
  misc_feature (274)..(274): n is a, c, g, or t
  modified_base (506)..(506): a, c, t, g, unknown or other
  misc_feature (506)..(506): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtgggaggaggcttgatccagccgtggggggtccctgagactctcctgtgcagcctcgtggttccaccgtnacgtcacacctacatgagctgggccgcgaggcctccgaagggggaacggggcgtggagtgtccgttcttacttttaatttagtaggttaggttggtaacgtactactactccgactacgacttccggagggacggggacctattaccacctatccgtccaagacgaaacctaaacttccgaaaacggtaacctacgtacgtttcgttttaactaacgtaaaatacgaaaccnggtacctaggagaacggcccgaagtacggaaccgaaccggggtccgtagttaacttacgtgcgtacggaagacggtaacgggtccggggaaaccctaacgggtaaaccggtttaaccctaacggtaccgttaacggtacgggtacccgggttaccgggtaccgggggaacccgaaaccggggtaccccgg

SEQ ID NO: 183526 - DNA, 595 bp, Homo sapiens
  misc_feature: GYAE6OF02G819S.13.76.G10.1.454.CMB.1.raw
  modified_base (442)..(442): a, c, t, g, unknown or other
  misc_feature (442)..(442): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccgaggggaaggggcgtgggagtgcgtcttcttttattatagtagtggtagtacatactcgcagactcgtgagggccatcaccatctccagagactaacttaccaaagaacacgtcttagtttccttacaaattagaaacngacctagagacgaccgatacgaccaccgggccgttagttacttacgtggtacgacgaggagtacgacggggccccaacggtaaccggttaaccgaccgtacttaacggtacgggaccggttccgggtacggggacccgtaaggggaaccccgg

SEQ ID NO: 183527 - DNA, 613 bp, Homo sapiens
  misc_feature: GYAE6OF02JAJG4.13.76.G10.1.454.CMB.1.raw
  modified_base (464)..(464): a, c, t, g, unknown or other
  misc_feature (464)..(464): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcggggtcccgccgacggcctccgaggggaacggggcgtcgggagtggcgtcttcttttatttagtagtagtggtagtacatactcgcacgactccggtggacggggccgtattcacctatctccaagacgactaaacttaccaaagaaccacgtcttgtttacctagaaattgaaacngaccctgacgagacccgatacgacgaaccggtccgttagttaacttacgtgtcggacgagtaggacgtaccggggaccctaacggtaaacgttaacctacggtcttaacgttgggaccgttcggtacgggggacccaagggtaccccgg

SEQ ID NO: 183528 - DNA, 549 bp, Homo sapiens
  misc_feature: GYAE6OF02IE7E3.13.76.G10.1.454.CMB.1.raw
  modified_base (212)..(212): a, c, t, g, unknown or other
  misc_feature (212)..(212): n is a, c, g, or t
  modified_base (220)..(220): a, c, t, g, unknown or other
  misc_feature (220)..(220): n is a, c, g, or t
  modified_base (313)..(313): a, c, t, g, unknown or other
  misc_feature (313)..(313): n is a, c, g, or t
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
tcagtcacgtactacacgaccggtgctcgatttagtcactcatacagggggggaagcctgggaacacttagccttcatgagtgtcccaccatggcctggatgatgcttctcctcggactccttgcttatggatcaggagtggattctcagactgtggtgacccaggagccatcgttctcagtgtctcctggaggacagtcacactcacttgnggcttganatacggctcagtctactagtagttacctaccccagctggtaccaacacgaccccaggccaggcctccgcgcacgctcatctacaacacaaacnctcgctcttcncgggtccctcatcgccttctcngctcatccgttggaacaaagctgcccttatcactcgaccggggcccaggcagtaagatgaactctagtatttatacttgttctttattatagttgggttagtgtaccgtatttctgtctgttcgttacgggagtacgggccacccggtctacggcccgtcctcggtaccgacgtcccgaacggtctaccgccccgagtcccgg

SEQ ID NO: 183529 - DNA, 654 bp, Homo sapiens
  misc_feature: GYAE6OF02J2NBD.13.76.G10.1.454.CMB.1.raw
  modified_base (305)..(305): a, c, t, g, unknown or other
  misc_feature (305)..(305): n is a, c, g, or t
  modified_base (567)..(567): a, c, t, g, unknown or other
  misc_feature (567)..(567): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttggatccgagccgtggggggtccctggacgtactcctcctgtcgcagcctcgtgggttcaccgtcagtcacacctacatgagctggggtcccnccgtaggcctaccgaggggacgggctgggacgtggccgttcttacttttattagtaggtagtggttaacgtacattaccgtccgagtacgaccttcgggtaggacgggggtcccgtattcccgaaccctagtccctccaaggaccgaacctaaactttccccgaaaagaacctaccgtcgtttacgttttacctacgaaacttacggtaaccaacgtcccgtagaacgtcgacccgatcgacgacgtcctagttacttcgtnacgagtagacgtaggtcgggaacccctagtaacggttacccagccgttaggtcggaccgttccggacggggtacccaagggtacccg

SEQ ID NO: 183530 - DNA, 550 bp, Homo sapiens
  misc_feature: GYAE6OF02G2II8.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccaggtcccctgtgctggtcatctatcaagntgaccaagccggccctcgagggactccctggacgcgtattctctcggcctaccaactcgtgggaactcgagccctactctgaccatcacggcgggacccaggctagtggatggagtcgtcgacttattactgtacgaggcgtgggacagcgacgctacgtcgcccgtactacgtcggttccgttacgggaacgttaccggggaacctaacgggtccgtaacccggttaccctaaggttacccacggtaacccccgg

SEQ ID NO: 183531 - DNA, 571 bp, Homo sapiens
  misc_feature: GYAE6OF02GRIO0.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgagggaaggggctggagtgcgtcttcttttatttatagtagtggtagtacatactccgcagactccgtggaggggccattcacctatctccgagacgactaaattccaagaaccacgcttgttttcctacaaattgaaccagccctagacgacgccgatcgacaccgggccgtagttaacttacgtggttagcgagagacgtacggggcccaacggtaaccgttacgtacgctacgtcggaccgtcggtcgggaccaagggtacccg

SEQ ID NO: 183532 - DNA, 621 bp, Homo sapiens
  misc_feature: GYAE6OF02HGR2O.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtcgctggtcatctatcaagatgccaagccggccctcgagggactcccgtgacgcgtattccgtcgggctaccgaactccgtagggaaccacggcccacgtctacgaccatcgaaggtagggtacgaacggccggggtatcgggacggtccgaacgttactttcgtggtcgtagggtggtagggtactaaggtaacgtagttaggtagttagggttaaggtttcgggttttacgggccgggtacgggtaccgaaggtccggtaacggtacccggttaccgtacggtaccgaaccggtacccgaacgggtcccttacccgggtaccccccgttacgggtaccctacccgg

SEQ ID NO: 183533 - DNA, 641 bp, Homo sapiens
  misc_feature: GYAE6OF02HG1AW.13.76.G10.1.454.CMB.1.raw
tcagtcacgtactacacgaccggtgctcgatttagtcactcatacaggggggggggctgagcccttctctggaaaccacacagctcctcctgcagcagcccctgactgctgattttgcatcacgggccgctctttccagcaaggggataagagaggcctggaagaacctgcccagcctgggcctcaggaagcagcatcggaggtgcctcagccatggcatggatccctctcttcctcggcgtccttgccttactgcacgagacgtccgtggcctctatgacgctgactcacgccacctcacgtcgtcccgtcgtccccgaaggacacgacacgccagcacgtccaacctgctacgtaggaaaattaaacgttcggactaagtaaattaaacgtacttacgttccgtagtactacagtacaaggaagtcgaacggaccctacgtaccccgtaggtacgccgttacggtccgtaattctaaacgttaactaaaacgtcgtaaccgaacggtcccggtaccgttacgggaacggttaccgtacccgtacggaccggtacgttacgttccgtccgttacgggtaccttacccgaacggttcccgtaacgggtaaccctaccgtaaccgtcccgtaaccttaccgg

SEQ ID NO: 183534 - DNA, 643 bp, Homo sapiens
  misc_feature: GYAE6OF02IV2VA.13.76.G10.1.454.CMB.1.raw
  modified_base (475)..(475): a, c, t, g, unknown or other
  misc_feature (475)..(475): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtctggaggaggcttgatccagccgtggggggtccctgagactctcctgtgcacgcctcgtggggttccaccgtcacgtccaccaccctacatgagccgtcgggtcccgccaggccgtccgaggggaacggggctgggagtcggcgttcttcttttattatagtagtggtatacatacctccgcacgactccggtggaggggacctattccaccatccgtacagacgaactaacttaccaaagaaccacgtcttgtttacctactaaatcgaaacncgtcctagacgacgccgataccgacgaccgggtccttgttaacgtttctgtagacgagggagtacgggtcccgggggaccccaaacgggttaaccgtttaaccgtaccggtacgttaacggtcgggtaaccggttccggtacggggggacccgaacggggtaccccgg

SEQ ID NO: 183535 - DNA, 506 bp, Homo sapiens
  misc_feature: GYAE6OF02FLI1Z.13.76.G10.1.454.CMB.1.raw
  modified_base (442)..(442): a, c, t, g, unknown or other
  misc_feature (442)..(442): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggactccctgagcgattctctggctccactctgggaacctcagccactctcgaccatcagccgggacccaggcctagtggatggaggctgacttattactgtgacggcgttggactagcagcactcgcccgntagtcgtcgttacggaacgtcgggaaccgtacggtccgacccgttctaacgtccacgtaccccg

SEQ ID NO: 183536 - DNA, 640 bp, Homo sapiens
  misc_feature: GYAE6OF02IWYGX.13.76.G10.1.454.CMB.1.raw
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataattggacagaataaatatacttcctggtatcagcaagaagtcaggccacgtcccctgtcgcttggtcattctatacaagtactcgacccaagtcccggacccctcgaacgggtaccttcccgtaggacgtacggtactttcgtcgtcgggtcctaccctaaccgtcgtacgggaacctcgaacgcctactcctacgaccagtcgacggccgggacccaggtcctagtcggaatcggaggtcctagtaccttaagttacgtgtaccgagggtcgtacgggacacgtacgacgtacgtaccgtccggacccctagttacgttccggttaccggttaccgggtaacccggtacgggtaaacccgtaaccgggtttacccgtaacccgttaccggtaaccggtaccgtacccggtaacccccgg

SEQ ID NO: 183537 - DNA, 550 bp, Homo sapiens
  misc_feature: GYAE6OF02GN42F.13.76.G10.1.454.CMB.1.raw
  modified_base (430)..(430): a, c, t, g, unknown or other
  misc_feature (430)..(430): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (484)..(484): a, c, t, g, unknown or other
  misc_feature (484)..(484): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaaggggctggagtgcgtcttcttttatttatagtagtggtagtacatactccgcagactcgtggacggggcctattcaccatcctccagagacaattccaaagaaccacgtcttgttcctanaaattgaacngcctgagngccgatcgacgacggcgttgtattacgtgtgcgagngagtcgggacccaacggtaacgttacacggctagtcgggaccgttcggcggggaccaagggacccg

SEQ ID NO: 183538 - DNA, 641 bp, Homo sapiens
  misc_feature: GYAE6OF02H6ABO.13.76.G10.1.454.CMB.1.raw
  modified_base (477)..(477): a, c, t, g, unknown or other
  misc_feature (477)..(477): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctgggaggaggcttgatccagccgtggggggtccctgagactctcctgtgcagcctcgtgggttccaccgtcagtcaccacctacatgagcgtcgggtcccgccgaggcctccggaggggaacggggcgtgggagtcgcgttcttcttttatttagtagtagtggtagtactatactccgacagtacctcggtggacggggcctattccacctatcctccgaagacgaactaacttccaaaagaccacgtcttacgttttcctacaaattcgaaacncgcctagacgacgccgatcgaccgacggtccgttagtacgtttacgtggtagacggagaggtacggtaccggggacccctaacgggtaaaccgttttcccgaacggtacgttacggttcggggaaccggttcggtacgggggaccccgtaaacggggtaccccg

SEQ ID NO: 183539 - DNA, 555 bp, Homo sapiens
  misc_feature: GYAE6OF02FZ89N.13.76.G10.1.454.CMB.1.raw
  modified_base (417)..(417): a, c, t, g, unknown or other
  misc_feature (417)..(417): n is a, c, g, or t
  modified_base (453)..(453): a, c, t, g, unknown or other
  misc_feature (453)..(453): n is a, c, g, or t
tcagtcacgtactacacgaccggtgctcgatttagtcactcatacaggggggcctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggcagaataaatatacttctggtatcagcagaagtcaggccacgtcccctgtcgctggtcatctatcaagatcgaccaagccggacccgtcgacgggactcccgtgacgtcgacttctcgtggcctaccaactcgtacgggaactcgacgccctactctcgaaccatcgacggccgggacccaggctagnggagtggacggctacgacttatacgtgtacgcgggnggtggaccgtgctacgccacgtccgccgactagttcgtacgttacggaaccgtcgggaacctaacggtcctacccggtaccgtaacgtccgacgtaccccgg

SEQ ID NO: 183540 - DNA, 586 bp, Homo sapiens
  misc_feature: GYAE6OF02I67EY.13.76.G10.1.454.CMB.1.raw
  modified_base (170)..(170): a, c, t, g, unknown or other
  misc_feature (170)..(170): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataaattggcagataaatatacttcctaggtatcagcagaagtcaggccagtcccctgtcgctggtcatctatcaagatcgccaagcgtccctcgagggactccctaggagcgtattcctcgtcggcctaccctaacttcgtacggggaaccttcgacgtacccaccttcgtacgaacccgattacccgacggccggggaaccccagggtctaacggcggtatcgggaggtcctaggtacttacgttacgtggtaccgagggtccgtgggacaggcgacgcacgtccgccgtagttagttcggtacttacgggtaactcgggaacctacggtcccaccggttactaaccggtccgacgtaacccccgg

SEQ ID NO: 183541 - DNA, 568 bp, Homo sapiens
  misc_feature: GYAE6OF02HH5ZD.13.76.G10.1.454.CMB.1.raw
  modified_base (268)..(268): a, c, t, g, unknown or other
  misc_feature (268)..(268): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (459)..(459): a, c, t, g, unknown or other
  misc_feature (459)..(459): n is a, c, g, or t
  modified_base (483)..(483): a, c, t, g, unknown or other
  misc_feature (483)..(483): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtnagtccacacctacatgagcgtgggtcccgccgaggcctccgaggggaaggggctagggagtcgcgttcgtcttttaagtttanaggttagtggtagtacatactccgnacgtactcgtggagggtccattcacntcncaganacaatcaagacacgctnttctanaaanctaanacgcctagagancgtancgacgacggtctagtattacgtgngacgtagagtaggtaccggggcccaaacgtaccgttacgtaccgacgtaggtcggacgttcgtacggggaccgaacgggtacccg

SEQ ID NO: 183542 - DNA, 504 bp, Homo sapiens
  misc_feature: GYAE6OF02F0T4R.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggatcccgtgagcgattctctggctccaactctgggaactcagccactctgaccatcagcgggacccaggctagtggatgaggctagactattactgtcaggcgtgggacagcagcacgtcgcccgctagtcgtcgttaccggaacgttcgggaaccgtaacggtccacccgttccgtaagtccgacgaaccccg

SEQ ID NO: 183543 - DNA, 550 bp, Homo sapiens
  misc_feature: GYAE6OF02F8A80.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtggtagtacatactccgcagactccgtgaggggccgattccaccatctcagagacaattccaaagaacacgctgtttcttcaaatgaacagcctgagacgccgatgacacggccgtgtattacgtgtgcgtagagtagtcggggccccaacggtaaccgtttacgtaccgtcgttaagtcgggtaccggtcggtggggtaacccgg

SEQ ID NO: 183544 - DNA, 583 bp, Homo sapiens
  misc_feature: GYAE6OF02ITI2V.13.76.G10.1.454.CMB.1.raw
  modified_base (437)..(437): a, c, t, g, unknown or other
  misc_feature (437)..(437): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggcgtggagtgcgtcttcttttatttatagtagtggtagtacatactcgcagactccgtggagggccgatcaccatctcagacgacaattccaaagaaccacgtcttcgtttctacaaattcgaacngcctgaagacgccgagtacgaaccgtacggccgttgtaactttacgtgtgaccgagtaggtacggtcggggcccctaacggtaacgtttaaccgtaccgtagtacgtcgggtaccggtcgtacgggggacccgtaagggtaccccg

SEQ ID NO: 183545 - DNA, 667 bp, Homo sapiens
  misc_feature: GYAE6OF02JHTFU.13.76.G10.1.454.CMB.1.raw
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (282)..(282): a, c, t, g, unknown or other
  misc_feature (282)..(282): n is a, c, g, or t
  modified_base (300)..(300): a, c, t, g, unknown or other
  misc_feature (300)..(300): n is a, c, g, or t
  modified_base (330)..(330): a, c, t, g, unknown or other
  misc_feature (330)..(330): n is a, c, g, or t
  modified_base (528)..(528): a, c, t, g, unknown or other
  misc_feature (528)..(528): n is a, c, g, or t
tcagtcacgtactacacgaccggtgctcgatttagtcactcatacagggcgtgggcctcaggaagcagcatcggaggtgcctcagccatggcatggatccctctcttcctcggcgtccttgcttactgcacaggatccgtggcctcctatgagctgactcagccaccctcagtgtccgtcgtcccccaggaccgagacagccagcatccacctgctctaggaaataattggactagataaatntacttcnggtatcagcagaagtcaggccagtcccctagngcgtgtcatctatcaagntgacccagccggccctagaggacctcccgngacgcgtactttcgacgtcggcctaccctaaacgttccggtagggaacccttcgaacggtcccctaacgtccgtacgaccctaacgtccgaacggtacccgggaacccgacgggtaccctaggtacggaactagggaacgggtcctagtaacgttacgtttaaccgtggttaaccgccgggtagggtacgggtaacgnggacccgtaggcccaacgtcccgggcccgtacttacggttcccggtttacgtaccggggttaaacccgtccggggttaaacccggacggttaccccgtaacccggttaaccgttaccggtaccgacccggtaaccccgg

SEQ ID NO: 183546 - DNA, 547 bp, Homo sapiens
  misc_feature: GYAE6OF02JANU2.13.76.G10.1.454.CMB.1.raw
  modified_base (294)..(294): a, c, t, g, unknown or other
  misc_feature (294)..(294): n is a, c, g, or t
  modified_base (384)..(384): a, c, t, g, unknown or other
  misc_feature (384)..(384): n is a, c, g, or t
  modified_base (473)..(473): a, c, t, g, unknown or other
  misc_feature (473)..(473): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtggggggtccctgagactctcctgtgcagcctctgggttcaccgtcagtccacacctacatgagctgggtccnccaggctcgagggagggctggagtgcgtcttcttttattatagtagtggtatacatactccgcagtacctcgtgacggggtcattcaccntctcagacacaacttaccaaagaacacgtcttgtttacctacaatagaacacgcctgacagccgatgacgacggccgtagtacttacgngtgacgagagtagtcgggacccaacgaaccgttacacgtctagtcggtacgtcggtcggggacctagggacccg

SEQ ID NO: 183547 - DNA, 572 bp, Homo sapiens
  misc_feature: GYAE6OF02FNGY2.13.76.G10.1.454.CMB.1.raw
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (180)..(182): a, c, t, g, unknown or other
  misc_feature (180)..(182): n is a, c, g, or t
  modified_base (185)..(185): a, c, t, g, unknown or other
  misc_feature (185)..(185): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (216)..(216): a, c, t, g, unknown or other
  misc_feature (216)..(216): n is a, c, g, or t
  modified_base (225)..(225): a, c, t, g, unknown or other
  misc_feature (225)..(225): n is a, c, g, or t
  modified_base (228)..(228): a, c, t, g, unknown or other
  misc_feature (228)..(228): n is a, c, g, or t
  modified_base (239)..(239): a, c, t, g, unknown or other
  misc_feature (239)..(239): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (256)..(256): a, c, t, g, unknown or other
  misc_feature (256)..(256): n is a, c, g, or t
  modified_base (290)..(290): a, c, t, g, unknown or other
  misc_feature (290)..(290): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttttggctgagcgggcgtttcggctaaggcgcttaaagtagcagtngngnnngcngngngntgagngntgncngcgtcgggcgtgngctctctgngcncgctctcgtcncgcncgcacacacangngcgtcggtccgccgacgcgcgacggaggcgtggngtcgtcgtcgttctttattagtagtagtagtacgtacgtacgtacgtcgcgacgacgtcggtcggacggcgtactacacactcacgacgacgactaactacaacgaacacgtcgttacttacttaactaacgtaacgaacgacgtacgtacgtacggacgacgacgacgacgaccgtcgtacgttacgttacgtcgtagtacgagagacggtcggaccgtaacggtaacgttacgtacgtacgtacgttacggtacggtcggtacggtaccggacggaccgg

SEQ ID NO: 183548 - DNA, 532 bp, Homo sapiens
  misc_feature: GYAE6OF02H4PBI.13.76.G10.1.454.CMB.1.raw
  modified_base (172)..(172): a, c, t, g, unknown or other
  misc_feature (172)..(172): n is a, c, g, or t
  modified_base (233)..(233): a, c, t, g, unknown or other
  misc_feature (233)..(233): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccacctnagtgtccgtgtcccaaggcagacagccagcatcactgctctgaaataatggcagataaatntacttcctggtatcagcagaagtcaggccagtcccctgtcgctggtacatctactcaagatcgaccaaggccggccctcgtacgggactcccgtagacgcgtacttctcttggaccttccgaacttcgtacgggaacctcgacgccactctcgaccatcgacgcgggaccaggacgtagtggactggacgcttgactattacgtcgtacgnggtcgtagggacagcacgcacgtcgcccngtacgtgtccgttacgacgtcggtacgacggtcctaccgtacgacgtaccgacgacccg

SEQ ID NO: 183549 - DNA, 814 bp, Homo sapiens
  misc_feature: GYAE6OF02J33FW.13.76.G10.1.454.CMB.1.raw
tcagtcacgtactacacgaccggtgctcgatttagtcactcatacgaggggggagaggagcccagcactgggattccgaggtgtttccattcggtgatcagcactgaacacagaggactcaccatggtagttttggctgtagtcgttgggtttttccttgttagtacttaagttttaaaacggtcgacccgtaggtggtaggaggtgcgaggtcgtggtaggagtcgtggaggtaggccttgactccgacggtccggtcggggtcctagacgtctcctcgtgtcgcgtacgtcctacgtcggttaccaccgtctacgtacaacctacgtacgagtcggacggtccgtcgggtacccgaccggtacggtaccgtaccgggaaggggtaacgggtcgtaacgggtcgttacgttcgtttactttacgttttaagttagttacggttaagtacgggttaacctacctaccgttaccgcccggtaacgtaccggtaccgtacgggtacggaccgggtaccctacttacccaacgtacgtacccgtaaccgaagtaaaccgtaactaacgtaaccgaaacgtaccgtacgtttccttagttaaccgaacgtaacgcgtaaacgcgttacccgagaccggtacgacgtagtaccggaaccggtccgtagttacttacggtaccgaggtacgaccggtaagtaccggtaccggtaccggtaaacccttagggttaaacccgttacggtaccggtaacggttacgggtacccgggtaacccggtaccgggtacccggggaaccgttaccgggtaaccccccg

SEQ ID NO: 183550 - DNA, 575 bp, Homo sapiens
  misc_feature: GYAE6OF02FN9X3.13.76.G10.1.454.CMB.1.raw
  modified_base (539)..(539): a, c, t, g, unknown or other
  misc_feature (539)..(539): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgaggggaggggctggagtgcgtcttcttttattatagtagtggtagtacatactccgcagactccggtggacggggccgtattccaccatctccagacgacaacttaccaaagaacacgtcttgtttacctacaaattgaaacacgtcctagacgacgccgatcgaccgacggtccgtagtacttacgtggtgacgagagacgtcggggacccaggtaaccgttacgtacgtntagtcgggtaccgtcgtcggggaccaagggtacccg

SEQ ID NO: 183551 - DNA, 570 bp, Homo sapiens
  misc_feature: GYAE6OF02H1CNK.13.76.G10.1.454.CMB.1.raw
  modified_base (493)..(493): a, c, t, g, unknown or other
  misc_feature (493)..(493): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggttcaccgtcagtcacacctacatgagcgtgggtccgccaggctccgaggggagggcgtggagtgcgttctctttttatttagtagtagtgtagtactatacctccgcagaccgtccggtggacgggggcctacttcacctactcctaccagacgactaaattccgaaagacacgtctgtttctacaaatgaacacgctagagacgccgaatgacgaccggtcgtagttacttacgngtgacgagagacgtcggggccctaacggaacgttacacgtcgtagtcggaccgttcggacgggaccgaagggacccg

SEQ ID NO: 183552 - DNA, 552 bp, Homo sapiens
  misc_feature: GYAE6OF02INYGX.13.76.G10.1.454.CMB.1.raw
  modified_base (515)..(515): a, c, t, g, unknown or other
  misc_feature (515)..(515): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtcccgccaggcctccgaggggaaggggctggagtgcgtcttcttttattatagtagtggtatacatactccgcagactcgtgaggggccattcaccatctccagacgacaattccaaagaacacgcttgtttctacaaatgaacagcctgagagccgatcgaccgacggccgtagtacttacgtgtgcgagagagtcggggacccaacggtaacgttactaccgntagtcgggaccgtcgtacggggacccaaggggacccg

SEQ ID NO: 183553 - DNA, 682 bp, Homo sapiens
  misc_feature: GYAE6OF02H1XEP.13.76.G10.1.454.CMB.1.raw
  modified_base (197)..(197): a, c, t, g, unknown or other
  misc_feature (197)..(197): n is a, c, g, or t
  modified_base (237)..(237): a, c, t, g, unknown or other
  misc_feature (237)..(237): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacngccagcatcacctgctctggaaataattggcagataaatntacttcctgtatcagacagaagtcaggccagtcccctgtcgctggtcatctatcaagatgccaaggccggaccctcgaagggactccccgtagacgacgactttccgtcgtcggtccttcccgaaacgttccgttacgggaacccttcgaacggccctaacttcctacgaaccctaagtacccgacgggtccgggaaccccgacgggtcctaacggttgggaacgttcgggaacgggtaccgtacgtaaaccttaacgtttacgtacggttaccggaacggggtccgggttacggggaacctaaggcccgaaggaccctaccggttccggaccccgtcgttacgttcggttacccggttaccgggtaacgtaccggggaacccgttaaaccgggtcccgtaaacccggttacccgtaaacggttcccgtaaccggtaacccccgg

SEQ ID NO: 183554 - DNA, 631 bp, Homo sapiens
  misc_feature: GYAE6OF02GILPX.13.76.G10.1.454.CMB.1.raw
  modified_base (391)..(391): a, c, t, g, unknown or other
  misc_feature (391)..(391): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaagtgcccagtgtgaggtgcagctggtggagtctggaggaggcttgatccagcctggggggtccctgagactctcctgtgcagcctctgggttcaccgtcagtcacacctacatgagctgggtcccgccaggctccgaggggaaggggctgggagtgcgttcttcttttattatagtagtggtagtacatactcgcagactcgtgaggggcctattccacntctacagagacaattccaaagaaccacgacttcgttttacttacaaattacgaacctacggaccctagaacgacgccggagtcggaaccgaccgggtccgttaagttaacgtttacgtaggttcggacggtaaggaacggtaagggttaccggggaaccccgtaacggtaaacccggttttaacctaaccggtaccggttaagttacgggtacccggttcggtaccggggggtaacccgg

SEQ ID NO: 183555 - DNA, 534 bp, Homo sapiens
  misc_feature: GYAE6OF02G2OOH.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctggtccgccaggctccgagggaggggctggagtgcgtctcttttattatagtagtggtagtacatactccgcagactcgtgaggggcgattcaccatctccagagacaattccaaagacacgcttgttcttacaaatgaacagcctgacgagccgatgacacggcgttgtattacgtgtacgagagaggagtcggggacccacggtaaccttacgacgctagtcggtacgtcggtgggaccgaacggg

SEQ ID NO: 183556 - DNA, 637 bp, Homo sapiens
  misc_feature: GYAE6OF02F439D.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtcccgccaggcctccgaggggaacggggctgggagtgcgtcttcttttatttatagtagtggtagtacatactccgcagaccgtccggtggacggggccgattccacctactcctaccagagacctaattcccaaagaaccacgtcttcgtttctacaaagttcgaaacacgcctagacgacgaccgagtacgaaccgaccgggtccgttagttaacttaccgtgtacggacggaagtacggtaggtccgggggaacccctaacgggttaaaccgtttaccgtaacggtaccgttaaggttcgggtaaccggttcgggtaccgggggacccgtaaagggggtaccccg

SEQ ID NO: 183557 - DNA, 560 bp, Homo sapiens
  misc_feature: GYAE6OF02FGP6W.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcacgtcagtccacacctacatgagctcgggtccnccgaggcctccgagggaagggctggagtgcgtctcttttattatagtagtggtagtacatactccgcagactccgtgacggggccgattccgacctatctaccagacgactaattacccaaagaaccacgtcttagtttaccttacaaattcgaacagccctgagacgacgatcgacgaccggtccgtagttacttactgtcgcgagagagtcggggcccacgaacgttactacgactagtggacgtcgcgggtaccagggacccg

SEQ ID NO: 183558 - DNA, 671 bp, Homo sapiens
  misc_feature: GYAE6OF02HR2J5.13.76.G10.1.454.CMB.1.raw
tcagtcacgtactacacgaccggtgctcgatttagtcactcatacaggggggaggaggagcccagcactgggattccgaggtgtttccattcggtgatcagcactgaacacagaggactcaccatggagttttggctgagctgggtttccttgttgctattttaaaaggtgcccagtgtgaggtgcagctggtggagtctggaggaggcttggatccagccgtggggggtccctggagactctcctgtcgcagcctgtgggttcaccgtcagtcacacctacatgagcgtcgggtccgaccagggctaccgaggggaagggctgggagtggccgtctcgtttttattatagtaggtgtacgtacatactcgcagactcgtggaggggcctattcgaaccatccgtccaaggacgaactaaacgttaccaaagaaactacgtacgttacgtttaccgtttacaaaacgttcggaaacaggtacccctaggaacgaacggacccgaagttacggaacccaccggggtcccgttaagttacgtttaacctggacggacgtaaggacggtagggtacccgggggacccctaacggtaacccgtttaacgtaacccggaccttaaggtaccgggtaccggttaccgggtacggggtacccgaaaccgggtacccgg

SEQ ID NO: 183559 - DNA, 631 bp, Homo sapiens
  misc_feature: GYAE6OF02F0V51.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgaggggaaggggctgggagtgcgtcttcttttatttatagttagtggtagtacatactcgcagactccggtgacggggccgattccgacctatcctacccaggacacctaaattccaaagaaccaccgtctttaggtttccttacaaagttcgaaaccgacgtacccgtagacggacgcccgtaagtacggaaccgaccgggtcccgttagttaacttacgtgtggacgtaaggagtaacggtccgggggaccccaaggtaaacccgtttacgtaaccgtcttagtcgggacggttcggtaccggggggacccaacggggtaccccg

SEQ ID NO: 183560 - DNA, 582 bp, Homo sapiens
  misc_feature: GYAE6OF02FW384.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgacgactctcctgtgcagcctctgggttcatctttgatgattatgccatgcactgggtccggcaagctccgaggggaagggcctggaggtgggtctcgtaggtattaggttggaataggtggtagctagtaggctagtggcggactcgtggtgggaacgggccgtattccacctatcctaccgagacgaaccgaaccgaccaaacgaccttaccctagtactctgacaagtgaaaccagccgtagagacgcgtagacggacgaccggtcttagtattagttgacgtacaaagtactaccctaacccgttacgttaacgttttagggacgtttaggttactaaccggg

SEQ ID NO: 183561 - DNA, 525 bp, Homo sapiens
  misc_feature: GYAE6OF02IO8CF.13.76.G10.1.454.CMB.1.raw
  modified_base (469)..(469): a, c, t, g, unknown or other
  misc_feature (469)..(469): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactacgctcttctggggtccctcatcgcttctctggctccatccttgggaacaaagctgcccttatcatcacggggcccaggcagaagatgaactctgtattattactgttgtttctttatagtggttagtgcctatttctgtctgttgttcgggaggnggccgacccggctcggaccgtcctccggtcacgccgaacggctcgccccagtccgg

SEQ ID NO: 183562 - DNA, 697 bp, Homo sapiens
  misc_feature: GYAE6OF02JI9JV.13.76.G10.1.454.CMB.1.raw
  modified_base (261)..(261): a, c, t, g, unknown or other
  misc_feature (261)..(261): n is a, c, g, or t
  modified_base (307)..(307): a, c, t, g, unknown or other
  misc_feature (307)..(307): n is a, c, g, or t
tcagtcacgtactacacgaccggtgctcgatttagtcactcatacagggcgtgggccgtcaggaagcagcatcggaggtgcctcagccatggcatggatccctctcttcctcggcgtccttgcttactgcacacggatccgtggcctcctatgagctgactcagccaccctcagtgtccgtgtaccccaggacagacagcctagcatccacctgctctacggaaacttaaattcggacaagataaatatacttcctggtanctagcagtatcagccacgtccctagtgacgtgtccatctatcaagntcgcaagccgtacctgacgggcttcccgagacgacgtattccgtactgggacccttcgaaccttcgtaggggaacctcgaacggtccccaacgttcccgtacgtaacctactacgacggttacgggaccccgaggtacccttaagttcgggacgtacggtacgggctacgtaaccctagttttaacgacgggttcctaacggggtccggttacggggtaacgtaaccggtccgtaaaggttacccaccgggtaccggtccccgttaacggttaccggttgggttaccccgtttaacggggtaaacccggtttaccggggaaacccgttaaacggggttccccgtaacccggttcccggttaaaacggttccgaaccccggtaacccccgg

SEQ ID NO: 183563 - DNA, 596 bp, Homo sapiens
  misc_feature: GYAE6OF02H0YZP.13.76.G10.1.454.CMB.1.raw
tcagtcacgtactacacgaccggtgctcgatttagtcactcatacagggggtctgggagaggagcccagcactgggattccgaggtgtttccattcggtgatcagcactgaacacagaggactcaccatggagttttggctgagctgggttttccttgttgctattttaaaaggtgtccagtgtgaggtgcagctggtagagtcgtggggggaggtggtgggtacgggccgtgggggggtccctcgagactctcctgtgcaacctctggattcagtatttgatgagtatggcatacacgtgggtccgccaacctccgagggaacggggctgcaggtgggtctcgtggtaataaacgtggaatggtgccagcaacaacttatgacagactcgtgtaggacgggccgatttccaacctactcctccaaggacgacaggtcgacccgaagtaacctccgtaacagttctacgaacaaatcgaaactagtaccgtacgggacgtcggaagaccgacggtcttgttactttctggtcgcggtaggttacgcgtaagggtcggtacttgggttaccttacgacgtaagtcgggacgttcggg

SEQ ID NO: 183564 - DNA, 550 bp, Homo sapiens
  misc_feature: GYAE6OF02F9FYW.13.76.G10.1.454.CMB.1.raw
  modified_base (430)..(430): a, c, t, g, unknown or other
  misc_feature (430)..(430): n is a, c, g, or t
  modified_base (439)..(439): a, c, t, g, unknown or other
  misc_feature (439)..(439): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctggagtgcgtctcttttattatagtagtgtagtacatactcgcagactcgtgagggcattcaccatctccagagactaattccaaagaacacgcttgtttacctacaaatgaaacncgcctaganacgcgaatcgacgacgccgtagtacttatgtgcgagagacgtcggggaccctaacggaaccgttactacgctagtcgggtaccgttcgaggggacccaaggggtaaccccg

SEQ ID NO: 183565 - DNA, 638 bp, Homo sapiens
  misc_feature: GYAE6OF02FUQ3N.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagtcaccctcagtgtccgtgtccccaggacagacagccagcatcacctgctctggaaataaattggcagataaatatacttcctggtatcagcagaagtcaggcagtcccctgtgctggtcatctatcaagatgaccaagccggccctcgagggactccccgtgacgccggtatttccgtcgtcggcctacccgaaccgttcgtacggggtaaaccttccgaacggccctaccgttcctacggaacccaacttccgaacggtaccgggaccccgagggtcctaagtacggaacgtcggacggtcctacggtaacttacgttacgttgtacgtagggtccgttacgggacgtacgcgacgtcaccgtccggccccgtactaacgttcggttaccgtttccgggtaaacccgttcgggtaacccgtaacgggttcccgtaacccggttaccgtaacggttacccgaccggtaacccccgg

SEQ ID NO: 183566 - DNA, 566 bp, Homo sapiens
  misc_feature: GYAE6OF02GYWNQ.13.76.G10.1.454.CMB.1.raw
  modified_base (401)..(401): a, c, t, g, unknown or other
  misc_feature (401)..(401): n is a, c, g, or t
  modified_base (441)..(441): a, c, t, g, unknown or other
  misc_feature (441)..(441): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccgtcagtcacacctacatgagcgtgggtccgccaggctccgaggggaagggctggagtgcgtctcttttattagtagtagtggtagtacatactccgcagactcggtggacggggtccattccaccatcctcaganacaattccaaagaacacgtcttgtttctacaattagaacngcctgacgacgccgatcgacgacggccgttagtacttacgtgtcggcgaggcgagtcggggacccaacggtaaccgttaactacgcttagtcgggtaccgtcggtcggggaccgaagggtacccg

SEQ ID NO: 183567 - DNA, 764 bp, Homo sapiens
  misc_feature: GYAE6OF02GQJOH.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtcgctggtcatctatacaagatcgaccaagccggaccctacgacgggtacctcccgtaggacgtcgtacttccgtcgtcggtcctaccaacgtcggtacgggtaaccttccgacggtacccctaacgtttccgtaccgtaaccccgtaacgttacccggaaccgggttaaccccggggaaccccgtaaacggggttacccgtttaaaccgggttacggggtaaacgtttaccggggtaaccgggttaccgttaaccgggttaaccttttaaacgtttacccgggttacggttaccggtaaccgggggtccggttaacggggaaccgacgggtacccgtaacggtacccgtaaccgttcccggaccccgttacgtttaccggtaccggtttacccggttacccggggtaaacccggttcggggtaaaccccgttacgggttacccgtaaccccggttaaccggtaacggtacccgacccggtaacccccgg

SEQ ID NO: 183568 - DNA, 565 bp, Homo sapiens
  misc_feature: GYAE6OF02HQF5F.13.76.G10.1.454.CMB.1.raw
  modified_base (294)..(294): a, c, t, g, unknown or other
  misc_feature (294)..(294): n is a, c, g, or t
  modified_base (376)..(376): a, c, t, g, unknown or other
  misc_feature (376)..(376): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttcctggtatcagcagaagtcaggccagtcccctgtgctggtcatctatcaagntgccaagccggccctcgacgggactcccgtgacgcgattctcgtggcctccaactctgggaacctcacgccactctgaccancgacgccgggacccaggactagtaggacgtggacggtcgtagtacttacttacgtcggtacgtacgggtcggtacgggacacgggtcaacgcgtacctcggcccgtgttacgtcggttcccgttacgggaaccgttacgggaaccctaacgggtccaacccggttaccgtaacgtccacggtaaccccg

SEQ ID NO: 183569 - DNA, 533 bp, Homo sapiens
  misc_feature: GYAE6OF02JDC2E.13.76.G10.1.454.CMB.1.raw
  modified_base (445)..(445): a, c, t, g, unknown or other
  misc_feature (445)..(445): n is a, c, g, or t
  modified_base (462)..(462): a, c, t, g, unknown or other
  misc_feature (462)..(462): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccacgtcccctgtcgctggtcatctatcaagatgccaagccggccctcgagggactcccgtgacgcgtattcctcgtcggcctccgaaactcgtagggaacctcgacgcccacgtcctacgacccatccgaacggccgggtaacccagggtcctaagtcggattggaggtctgaacttattacngtcgaggcgtagggacngcagcncgcgcccgntagtcgtcgtacggaacgtcggacctaaggtccaccgtctaagcacgacccgaacg

SEQ ID NO: 183570 - DNA, 566 bp, Homo sapiens
  misc_feature: GYAE6OF02GS2C8.13.76.G10.1.454.CMB.1.raw
  modified_base (370)..(370): a, c, t, g, unknown or other
  misc_feature (370)..(370): n is a, c, g, or t
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
  modified_base (501)..(501): a, c, t, g, unknown or other
  misc_feature (501)..(501): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtccacacctacatgagcgtgggtcccgccaggcctccgaaggggaacggggctgggagtgcgtcttcttttattatagtagtggtagtacatactccganagctccgtggacggggcctattccacctatcctaccagacgactaattaccaacgaacacgtcttgtttactacaaatcgaacagtccngagacgccgatagacgacggcgtagtattacgngtgacgagngagtccgggccaacggtaaccgtactacgctagtcggtaccgtcggaggggaccaacggacccgg

SEQ ID NO: 183571 - DNA, 577 bp, Homo sapiens
  misc_feature: GYAE6OF02FX9L1.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccgaggggaggggctgggagtgcgtctcttttattatagtagtggtagtacatactccgcagactcggtgaggggccattccacatctccagacgacaattccaaagaacacgtcttgtttactacaaattgaactagcctgagacgccgatacggaccacgggtccgtgttaacttacgtgtacggacgagaggtagtccgggggcccaacggtaaccgttacctacggtactaagttcgggaccgtcggtacggggaccctaacggggaacccg

SEQ ID NO: 183572 - DNA, 588 bp, Homo sapiens
  misc_feature: GYAE6OF02JGAP5.13.76.G10.1.454.CMB.1.raw
  modified_base (388)..(388): a, c, t, g, unknown or other
  misc_feature (388)..(388): n is a, c, g, or t
  modified_base (412)..(412): a, c, t, g, unknown or other
  misc_feature (412)..(412): n is a, c, g, or t
  modified_base (439)..(439): a, c, t, g, unknown or other
  misc_feature (439)..(439): n is a, c, g, or t
  modified_base (448)..(448): a, c, t, g, unknown or other
  misc_feature (448)..(448): n is a, c, g, or t
  modified_base (491)..(491): a, c, t, g, unknown or other
  misc_feature (491)..(491): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagctgggtttccttgttgctatttaaaggtgccagtgtgaggtgcagctggtggagtcgtgggaggaggcttgatccgagccgtggggggtccctggagacctctcctgtgcacgcctcgtgggttccaccggtcagtccacacctacatgagcgtcgggtcccgccaggcctccgaaggggtacgggctgggagtgccgttcttcttttaagttagtaggtagtggtatacatactcgacagacctcggnggacgggctatcacatctacaganacataccaagacacgtcttagttcaanaaatgaacncggtcctagagacgcgatcgacgtaccggcgttatacttacgngtacgagagacgtcgtaccggggaacccctaaggtaccgttaacaccgtagtaagtacgggtacctaggggtaccggggtaacaacgggtaaccccg

SEQ ID NO: 183573 - DNA, 655 bp, Homo sapiens
  misc_feature: GYAE6OF02FUQR7.13.76.G10.1.454.CMB.1.raw
  modified_base (460)..(460): a, c, t, g, unknown or other
  misc_feature (460)..(460): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtcgtggaggaggcttgatccagccgtggggggtccctgagactctcctgtgcagcctcgtgggttcaccgtcagtccacacctacatgagcgtcgggtcccgccgacggcctccgaggggaacggggctgggagtgccgttcttactttttatttagtagttagttaggtagtacatacctccgacacgtacgtccggtgggacggggtccgtattccacctactcctaccgaagacgaactaaacgttaccaaagaaccncgtcttcgtttactactaaattcgaactacgtcctagacgacgccgatcggaccgacgggtcctagttacttacgtgtgacgagaggtaacggtccgggggaacccctaacggttaaacccgttaccgtaacggtaccgttaaggtacgggtaacccgttccgggtacgggggaccccgtaacggggtaaccccg

SEQ ID NO: 183574 - DNA, 560 bp, Homo sapiens
  misc_feature: GYAE6OF02H22P6.13.76.G10.1.454.CMB.1.raw
  modified_base (393)..(393): a, c, t, g, unknown or other
  misc_feature (393)..(393): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggggtccctgagactctcctgtgcagcctctggggttcaccgtcagtcacacctacatgagctgggtccgcaggctccgagggaggggctggagtgcgtcttcttttatttatagtagtggtagtacatactcgcagactcggtgacgggcattccacatcctcaganacaattcaagaacacgcttcgtttcttacaaattgaacacgtcctagagacgccgatacgacgacggccgtagttacttacctggtcgagagaggtagtccggggacccacggtaacgttacacgtctacgtcgggtaccgtcggtacgggacccgagggtaacccg

SEQ ID NO: 183575 - DNA, 563 bp, Homo sapiens
  misc_feature: GYAE6OF02GWHN5.13.76.G10.1.454.CMB.1.raw
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
  modified_base (481)..(481): a, c, t, g, unknown or other
  misc_feature (481)..(481): n is a, c, g, or t
  modified_base (525)..(525): a, c, t, g, unknown or other
  misc_feature (525)..(525): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgcaggctccgagggaagggctgggagtgcgtctcttttatttagtagtagtggtagtacatacctccgcagtactcgtggacgggcattcaccatctcgagacgacaacttccgaaagaacncgacttgtttactacaaatcgaaacntcctagagacgccgtaatcgacacggccgttgtaattacnggtcgacgaggatacgtcggggcccaagtaaccgttacaccgtntaagtcgggacgttcggtggggacccaaggggtacccg

SEQ ID NO: 183576 - DNA, 553 bp, Homo sapiens
  misc_feature: GYAE6OF02GRPG5.13.76.G10.1.454.CMB.1.raw
  modified_base (400)..(400): a, c, t, g, unknown or other
  misc_feature (400)..(400): n is a, c, g, or t
  modified_base (410)..(410): a, c, t, g, unknown or other
  misc_feature (410)..(410): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (496)..(496): a, c, t, g, unknown or other
  misc_feature (496)..(496): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggggttccaccgtcagtcacacctacatgagctgggtcccgccaggcctccggaggggaacggggctgggagtgcgtcttcttttattatagtagtggtatacatactccgacagacgtcgtggacggggcctattccacnctctccaganaactaattaccaagaaccacgtctgtttacttacaaatgaacagtcctggagngaccgancgacacgggccgtagtattactggtnggagagagtcgggacccaacgtaacgttacacgctagtcggacgtcggcgggaccgg

SEQ ID NO: 183577 - DNA, 675 bp, Homo sapiens
  misc_feature: GYAE6OF02JWZRB.13.76.G10.1.454.CMB.1.raw
  modified_base (469)..(469): a, c, t, g, unknown or other
  misc_feature (469)..(469): n is a, c, g, or t
  modified_base (478)..(478): a, c, t, g, unknown or other
  misc_feature (478)..(478): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctcgtgggttccaccgtcacgtcaccacctacagtgagcgtgggtcccgccgaggcctaccgaggggaaggggcgtggaggtggtccgtcttcgttttatttataggttaggtggtaagtactatacctcgacacgactcggtgacggggccgtacttaccgacctactcctaccagacacaacttacccgaaagaaccacgtcgttagttttacctanaacggttanaaccagtaccctggaacgtacggacccggtatacggaccgtaccgggtccgttagttaagtttaaccgtggtaacggcgggtaagacggtacggttccgggggaacccctaaccggttacggttaacccgtaaaccggtgttaacggtcgggtaacccggttcgggaccgggggtaaccccggaaccgggtacccgg

SEQ ID NO: 183578 - DNA, 530 bp, Homo sapiens
  misc_feature: GYAE6OF02HJ9O7.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccagtctccagggaaggggctggagtgcgtctcttttattatagtagtggtagtacatactccgcagactcgtgaggggccattcaccatctccagagacaattccaagaacacgcttgttcttacaaatgaacagcctgagagccgatacgacacggccgtgtattacgtgtcgcgagagagtcggggcccacggaacgttacacgctagtcggacgtcgcgggaccagggacccg

SEQ ID NO: 183579 - DNA, 628 bp, Homo sapiens
  misc_feature: GYAE6OF02IK2LF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgactccagccgtggggggtccctgagactctcctgtgcagcctcgtgggttcaccgtcagtcaccacctacatgagcgtcgggtcccgccgagggcctccggagggggaaggggctgggagtgcgtcttcttttatttagtagtagtggtagtactatactccgcagtactccggtaggacggggcctattccaccatcctaccaggagaacctaacttaccaaagaacacgtcttagttttcctacaaattcgaaacagtcctagaagcgacgtatacggaccgaccggccgttagttacttaacgtgtacgacgaaggtgacggtccgggggacccctaaacgggtaacgtttaccgtaccggtattacggtcgggtaccgtcgggtccggggaccgtaaggggtaaccccg

SEQ ID NO: 183580 - DNA, 666 bp, Homo sapiens
  misc_feature: GYAE6OF02H6GAB.13.76.G10.1.454.CMB.1.raw
  modified_base (295)..(295): a, c, t, g, unknown or other
  misc_feature (295)..(295): n is a, c, g, or t
  modified_base (428)..(428): a, c, t, g, unknown or other
  misc_feature (428)..(428): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtccgtcgtccccgaggacagacagccagcatcacctgctctaggaaataatggacagataaatatacttcctaggtatcagacagaagtcgaggccacgtcccctgtgctggtactatntatcaagtactgaccaagccgccgtacgagggctcccgtgacgcgtcttctcgtcgcctaccaacgtcgtacgggtaacctccgacgtacctcgtacctacgaaccctgtacccgacggacccgggaacccgnggtaccgttacgtacgggagttacgggacggtaccgttcggtaactttaacgtttcggttacggttaccgggtagggtccggggtacgggtaccgacgtaccgacggaccgtaaccgtccgtaccccggtacttacggtttccgtacccggttaccggggtaaccggttaccgggaaccgtaccgggtaccctaacccgggtttacccgtaacggttacccggacccggtaaccccgg

SEQ ID NO: 183581 - DNA, 639 bp, Homo sapiens
  misc_feature: GYAE6OF02H5VWJ.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtgggggtccctgagactctcctgtgcagcctcgtgggttccaccgtcagtccaacacctacatgagcgtcgggtccgcccgaggcctccggaaggggaacggggcgtggagtgcgtcttcttttattatagtagtggtagtactatactccgcagacctcgtcggagggccgtacttcactactctccaagacgactaaacttaccaaagaaccacgtcttagttttctaacaaattagaacacgtcctagacgacgccgtatacgaccgaccgggtccgttagttaacttacggtgttacggacgaaggtcggaacggtccggggtaacccccaagggttaacccgttttaaccgaaccgtcgttaaacggtcggggtaaccggttcgggaccgggggaacctaaacccggggg

SEQ ID NO: 183582 - DNA, 661 bp, Homo sapiens
  misc_feature: GYAE6OF02IE4Y0.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcaggccacgtcccctgtcgctggtctatctatacaagatcgcaacgccggcctcgacggtactccccgtagacgtcgtacttcctcgtacggcccttacccgaacgtccgttacgggtaacctaccgacgtaccctacgtaccgtcgaaccctacgtaccgacgggacccgggtacccgaacgggtcgttaacgacgggtagtaggacggtcgtacgtaacttaagttaccgtggtaccggtacgggtaccggtagggaacgacgtaccggacgccgtaaccgtccggtacccgtacgttacggttccggttaccggttaaccggaaccggttacccgggaacccgttaacgggtacccgtaacccggttaccgtaaaccggtaccgaacccgtaaccccggg

SEQ ID NO: 183583 - DNA, 656 bp, Homo sapiens
  misc_feature: GYAE6OF02GJ44S.13.76.G10.1.454.CMB.1.raw
  modified_base (169)..(169): a, c, t, g, unknown or other
  misc_feature (169)..(169): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataatggacagataaatatacttcctggtactcagcagaagtcaggcagtcccctgtgcgtggtcatctatcaagatgaccaagccggcccgttcgaagggactcccgtgacggccgtattcctcgtggcctacctaactcgtacgggaactccgacgccactctacgacctagtaccgacggtacccgggaacccgacgggtaccgtagtcgggtaacgttgggacggtaccgttacggttaaccttaacgtttaccgtagttaccggtaggggtccgggtacggggacgtacggccgaacgaccgtaaccgtccgggaccccgtacgtttaacgttcggttaccggttaacccgggtaacggttaccgggaacccgttaacgggtacccgtaccccggttacgtaacggttcccgtaaccggacccgtaaacccggg

SEQ ID NO: 183584 - DNA, 654 bp, Homo sapiens
  misc_feature: GYAE6OF02J3E3J.13.76.G10.1.454.CMB.1.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtcacgtactacacgaccggtgctcgatttagtcactcatacagggcgtgggccgtcaggaagcagcatcggaggtgcctcagccatggcatggatccctctcttcctcggcgtccttgcttactgcacaggatccgtggcctcctatcgagctgactcagcccaccctcagtcgtccgtcgtccccaggacagacagcccagcctatccaccctgcctctaggaaactaattggacagaataaatntacttcctgtatcagcagaagtcaggccagtcccctgtcgctaggtcatctanacctaagactcgaccgaacgccggtacccctcgacgggtaccncccgtagacgaccgtacttccgtacgttacggttacccaacgttcgttacggggaacttaaccgcgtaccctaactcgttacgaacctacgttaaccgaacgggtacctccgaacgggtactacggtaggactacggtaacggcttacgacgttaacttcggtacgtgaacggtcgtagggacctgaccacggtaccagttccgacccgtagtacgttcggttaacccggttcggaaaccggttcggaacccgttacgggtacccgttaccccggtacgttaaccgacgacccggtacccgaacccgg

SEQ ID NO: 183585 - DNA, 552 bp, Homo sapiens
  misc_feature: GYAE6OF02GNXJT.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataaattggcagataaatatacttcctggtatcagcagaagtcaggccagtcccctgtgctggtcatctatcaagntgccaagccggccctcgagggactcccgtgacgcgacttctctggcctaccgaacttcgtacgggtaactccgacgccctactcctacgaccccataccgacggccgggaaccccagggacctagtggatggacggtctgacttagttacgtgtacgagggtcgtagggacagcacgcacgtcgcccgatagtcgttccttacggaaccgttgggaaccctaaggtcccaccggtacctaacggtccacggtaccccg

SEQ ID NO: 183586 - DNA, 628 bp, Homo sapiens
  misc_feature: GYAE6OF02GVXWU.13.76.G10.1.454.CMB.1.raw
  modified_base (301)..(301): a, c, t, g, unknown or other
  misc_feature (301)..(301): n is a, c, g, or t
  modified_base (471)..(471): a, c, t, g, unknown or other
  misc_feature (471)..(471): n is a, c, g, or t
  modified_base (508)..(508): a, c, t, g, unknown or other
  misc_feature (508)..(508): n is a, c, g, or t
  modified_base (527)..(527): a, c, t, g, unknown or other
  misc_feature (527)..(527): n is a, c, g, or t
  modified_base (545)..(545): a, c, t, g, unknown or other
  misc_feature (545)..(545): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagttttggctgagctgggttttccttgttgctattttaaaggtgccagtgtgaggtgcagctggtgagtctggaggaggcttgatccagccgtgggggggtccctagaggtactcctcctggtcgacaggccttcgtgggttaccaccgtccagtccaactacctacactgacncgtcgggtccgcctaggccgtaccagggggaagggctagggacgtgccgttcgttcgtttttaacttagtagttaggtgttacggtactaagtaccttccggacacgtactccgggtagagggggtccctagttaccacgtactctaccagacggactaactaccgaaanaacctcgacttcgttctacaaattacaacaagcctanaggatcccggatcggaacnccggtacgtagttatacnggttcgngaacgnttagcggggtcccaacggacgttaaccacgctaacggtcgacggtaccgtcggggacaaacgggtcccgg

SEQ ID NO: 183587 - DNA, 629 bp, Homo sapiens
  misc_feature: GYAE6OF02GUIB5.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataatggacagataaatatacttcctggtatcagcagaagtcaggccacgtcccctgtcgcgtggtcatctatacgaagactcgaccaagccggcccctacgagggacctcccgtagacgcgtacttcctcgtcggacctacccgaacgttcgtacgggtaacctccgaacgccctaacttccgtacgaaccctagtccgacgggacccgggaacccagggtacctagtaggtaacgtacggaggtctagtaacttacgttacgtcggtaccgtagggccggttagggaccgtagtaccgacgacctaccgtcgtcccgtattacggttcgttaccgttacgggaaccgtacgggtaacccgtaacggtcccgtaacccgttaccgtaacggtccaccggtaacccccgg

SEQ ID NO: 183588 - DNA, 643 bp, Homo sapiens
  misc_feature: GYAE6OF02I28BO.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctcgggtcccgccaggctccgaggggagggcgtggagtgcgtcttcttttattataggtagtggtagtacatactccgacagactcgtggacggggcctattccactactccgtacagaactaactaacgttacccaaagaaccaccgtctttacgtttaccttaacaaagttagaaccgacgtacctaggaacgacgccgtaatacgacccgacgggtccgttagttaacgtttacgtggacgtacggagtacggtacgggttaccggggaacccctaacggtaacccggttacgtaccgtacgttacggtacgggtaaccgttccgggtacggggtacccggaaggggtaaccccgg

SEQ ID NO: 183589 - DNA, 534 bp, Homo sapiens
  misc_feature: GYAE6OF02GUT1V.13.76.G10.1.454.CMB.1.raw
  modified_base (467)..(467): a, c, t, g, unknown or other
  misc_feature (467)..(467): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttctgtatcagcagaagtcaggccagtcccctgtcgctggtcatctatcaagatgaccaagccggccctacgagggactcccgtgacgcgattctctcggcctccgaacttcgtacgggaacctcgacgcctactctcgaccatcgacggccgggacccaggctagtggagtggacgtctagactattacgtgtacgaggtcgtgggacagcgagcacgtcgcccgtntacgtcgtccgttacggaacgtcgggacctaacggtcctacccgtacctaacgtccgacgtaccccg

SEQ ID NO: 183590 - DNA, 653 bp, Homo sapiens
  misc_feature: GYAE6OF02HEHJW.13.76.G10.1.454.CMB.1.raw
tcagtcacgtactacacgaccggtgctcgatttagtcactcatacagggcgtgggcctcaggaagcagcatcggaggtgcctcagccatggcatggatccctctcttcctcggcgtccttgcttactgcacaggatccgtggcctccgtatgagctgactcagccaccctcacgtgtccgtgtccccaggacagacagccagcatcacctgctctaggaaataattggcagataaatactacttaccgtggtatcagcagaagtcacgcctacgtcccctgtcgcttcggtcatccgtatcaagatcgaccaagccggaccctcgacggtactcccgtgacgcgtacttcctcgttacggccttaccgtaaccgttacccggtacgggtaaaccttcgaacggtccctaaccgtttccgtaccgtaacccctacgttaccggaacggacccggggaacccgtaacgggtaccttaacggttacggtacggtacggtacgggaccgttacgtaaccgtttaacgtttacgtacggttaccgacgggttacgggtcggtaacgcgacgtacgaccacgtcgcccgtactcgtcggttccgtacggaccgtaggaccgtacgtcgtacccgttacgtacgtacgtaccgaaccccg

SEQ ID NO: 183591 - DNA, 713 bp, Homo sapiens
  misc_feature: GYAE6OF02JZ2UJ.13.76.G10.1.454.CMB.1.raw
  modified_base (303)..(303): a, c, t, g, unknown or other
  misc_feature (303)..(303): n is a, c, g, or t
  modified_base (503)..(503): a, c, t, g, unknown or other
  misc_feature (503)..(503): n is a, c, g, or t
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgtctattttaaaggtgcccagtgtgaggtgcagctggtggagtctggaggaggcttgatccagccgtggggggtccctggacgtactctcctgtgcaggcctcgtgggttccaccgtcagtcacacctacatgacgctgggtcccnccgtagggcctccgaggggaacgggctggaggtcgcgttcttcgttttattagtacgtgtggttatactatactccgactagacctccggtggaggggtccctattccaccgatcctaccgaaggtacgaacctaaacttcccgaaagaaacctaccggtcctttacggtttaccttaaccgaaaattcggtaaaacccngtacccgttagggaactaccggtacccgtaagttcggaaacccgtccggggtacccgttaggtttaacctttaccggtacggtcggaccgtaagggtacgcggtttaaccggggggccccctaaaagggtaccgttttaaaccgccggttaacgtaacggttcggggacccttacccgggggtacggggtaccccgaaggggtaaccccg

SEQ ID NO: 183592 - DNA, 591 bp, Homo sapiens
  misc_feature: GYAE6OF02FTX1P.13.76.G10.1.454.CMB.1.raw
  modified_base (148)..(148): a, c, t, g, unknown or other
  misc_feature (148)..(148): n is a, c, g, or t
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
tcagtcacgtactacacgaccggtgctcgatttagtcactcatacagggggggggggctgagcccttctctggaaaccacacagctcctcctgcagcagcccctgactgctgattttgcatcacgggccgctctttccagcaaggggntaagagaggcctggaagaacctgcccagcctgggcctcaggaagcagcatcggaggtgcctnagccatggcatggatcccctntcttcctcggccgttccttgcttactgcacagatccgtggcctcctatgagctgactcagcccacctcagtcgtccgtcgtccccaggaccacgacagccgacgcactcacctgcctcgtaggtaaataagttcggacaagtataaacttataccgttcctaggtacttcaacgtcaagtaacgtcgacggccacggttccctgtcgtcttacgtcctatctaactccaaagtacgtcgtaaccgaacggtccggtccccacgtaacgggtacttcccgtaggacgtaccggtactttcccgtacgttaccggccttaccgaaccgttcggtaccgggtactaccgaccgaccttacccg

SEQ ID NO: 183593 - DNA, 558 bp, Homo sapiens
  misc_feature: GYAE6OF02HFERQ.13.76.G10.1.454.CMB.1.raw
  modified_base (293)..(293): a, c, t, g, unknown or other
  misc_feature (293)..(293): n is a, c, g, or t
  modified_base (403)..(403): a, c, t, g, unknown or other
  misc_feature (403)..(403): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgaggggaggggctggagtgcgttctcttttattatagtagtggtatacatactcgcagactcggtggaggggccgtatcacatctcagagacaattccaanaacacgtcttcgtttctacaaattgaacaggcctagacgagccgatcggaccacggccgtatactttacgtgtgcgtaggagagtcggggccctaacggtaacgttaactacgagttacgtcggaccgttcggtacggggacccaagggtacccg

SEQ ID NO: 183594 - DNA, 563 bp, Homo sapiens
  misc_feature: GYAE6OF02FW3YA.13.76.G10.1.454.CMB.1.raw
  modified_base (294)..(294): a, c, t, g, unknown or other
  misc_feature (294)..(294): n is a, c, g, or t
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggctccgaggggagggctggagtgcgtctcttttattatagtagtggtagtacatactccgcagactccgtggacggggccattccactactctccagagacaattccaaagaacacgcttgtttctanaaattcgaacngccctagacgaggcccaatcgaccacggccgtagtattacgtgtgcgaagcgagtcggggcccaaggtaaccgttaccacgtctagtcgggaaccgttcggtacgggggacccaaggggtaccccg

SEQ ID NO: 183595 - DNA, 655 bp, Homo sapiens
  misc_feature: GYAE6OF02HP6FI.13.76.G10.1.454.CMB.1.raw
  modified_base (305)..(305): a, c, t, g, unknown or other
  misc_feature (305)..(305): n is a, c, g, or t
  modified_base (422)..(422): a, c, t, g, unknown or other
  misc_feature (422)..(422): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtcgtcccccaggacagacagccagcatccacctgctcgtaggaaaataagtggacagaataaatatacttcctggtatcagcagaagtcaggccacgtcccctggtcgctggtcactctatcaagntcgaccaagccggccctcgacgggctcccgtgacgcgtacttctcgtggcctaccaactcgtagggacctacgacgccctactcctacgaccactacggaccggacccgggaacccngggtaccgtagtacgggtagtacgggacggtacgtacgtaaccgtttacgtttaaccgttcggtaccggtacgggtacggggtaacgggaaccgtacgaccggtaaccgccgtaaccgtccggaccccgtgttacgttcggttccggttaacggtaacccggttacgggaacccgttaaccgggtacccgtaacccggttccctaaaccggttcccgaacccgtaacccccgg

SEQ ID NO: 183596 - DNA, 524 bp, Homo sapiens
  misc_feature: GYAE6OF02FKA19.13.76.G10.1.454.CMB.1.raw
  modified_base (338)..(338): a, c, t, g, unknown or other
  misc_feature (338)..(338): n is a, c, g, or t
  modified_base (379)..(379): a, c, t, g, unknown or other
  misc_feature (379)..(379): n is a, c, g, or t
  modified_base (403)..(403): a, c, t, g, unknown or other
  misc_feature (403)..(403): n is a, c, g, or t
  modified_base (472)..(472): a, c, t, g, unknown or other
  misc_feature (472)..(472): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctggaaataattggcagataaatatacttctggtatcagcagaagtcaggccagtcccctgtgctggcatctatcaagatgaccaagccggccctcgacggggactcccgtggacgtcgatttccncgtcggcctaccaacttcgtagggaacctcacgccacttcncgaccatccgaggccgggaacccnggactagtcggagagacggcttgacttattcgtcgtacgacgggcgtgggacagcgacgcactcgcccnttagtcgtcgttcggaacgtcggacaggtcctaccgtacacgtcacgacccg

SEQ ID NO: 183597 - DNA, 554 bp, Homo sapiens
  misc_feature: GYAE6OF02FW6IG.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggcctccgaggggaaggggctggagtgcgtctcttttattatagtagtggtagtacatactccgcagactccggtggacggggccgattcaccatctccagacgactaacttccaaagaacacgtcttgtttactacaaattcgaacacgcctagacgagccatcggacctaccgggccttagtacttactggtagcgagagagtcgggcccaacggtaacgttcagctagtcggacgtcgtgggaccagggacccg

SEQ ID NO: 183598 - DNA, 543 bp, Homo sapiens
  misc_feature: GYAE6OF02FGLF2.13.76.G10.1.454.CMB.1.raw
  modified_base (236)..(236): a, c, t, g, unknown or other
  misc_feature (236)..(236): n is a, c, g, or t
  modified_base (272)..(272): a, c, t, g, unknown or other
  misc_feature (272)..(272): n is a, c, g, or t
  modified_base (451)..(451): a, c, t, g, unknown or other
  misc_feature (451)..(451): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatntacttctggtatcagcagaagtcaggccagtccccngtgctggtcatctatcaagatgccaagccggccctcagggactcccgtgacgcgattctctggctccaactcgtgggactcacgccactctgaccatcgagccgggacccaggctagtggatgaggctgtactattacgtgtcgaggtcggtgggacagccaggcacgtcggacccgtntacgttcggtccttaccgggaaccgttcggggaaccctaacggggtaccctaacccggttacccgtaacggttccgaaccggtaacccccgg

SEQ ID NO: 183599 - DNA, 583 bp, Homo sapiens
  misc_feature: GYAE6OF02F4J6L.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatactcctgtatcagcagaagtcaggccagtcccctgtgctggtcatctatcaagatgaccaagcggccctcgagggactcccgtgacgcgtacttctcgtcggcctacctaacgtccgtacgggaaccttccgacgcccgtaacctcgttacggaaccagttaccgacgggtcccgggaacccgacgggtcctaggtcggacgtaggacgggtctagtaacctttagttacgttcgtacgtaggtccgggtaggacgagacgacgccacgtcgcccgtagtacgtcgttcgtacggtacgtacgggaacctaacggtcctaaccggtcctaacgtccacgaaccccgg

SEQ ID NO: 183600 - DNA, 660 bp, Homo sapiens
  misc_feature: GYAE6OF02IDTUO.13.76.G10.1.454.CMB.1.raw
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
tcagtcacgtactacacgaccggtgctcgattttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagcctggggggtccctgagactctcctgtgcagcctcgtgggttcaccgtcagtcacacctacatgagccgtgggtcccgccgaggcctcggaggggaacggggctgggagtgcgtcttcttttattatagtagtgtagtacactctccgnagactcgaggagggcctattcactntctccgaagacaactaattccgaaagaccacgtcgttacgttttacctaacaaagttcgaaactacggtacccttagaccggtaagacccggtaatacggaaccgaaccggggttccgttacgttaacgtttaaccggtggtaagtccggaaaggtacggtaacgggtaccgggggacccctaaaccgggtaaacgtttaaccgaaccgtactaaggttccgggtaccggttaccgggtacggggacccgtaaggggtaaccccg

SEQ ID NO: 183601 - DNA, 589 bp, Homo sapiens
  misc_feature: GYAE6OF02HIKY5.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagcgtcgggtcccgccgaggctccgaggggaaggggctggagtgcgtcttcttttattatagtagtggtatacatactccgcagactcggtggacggggcctattccacctatcctaccgagacgactaacttaccaaagaaccacgtcttacgtttcctacaaattcgaacacgcctgacgacgcgagtacgaccgacggtccgttagttacttacgtgtcgacgaggtagacggtcggggacccaacggtaaccgttacgtacgtcgtagtcggaccgttcggcgggaccgtacgggtacccg

SEQ ID NO: 183602 - DNA, 554 bp, Homo sapiens
  misc_feature: GYAE6OF02I58SW.13.76.G10.1.454.CMB.1.raw
  modified_base (521)..(521): a, c, t, g, unknown or other
  misc_feature (521)..(521): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctcgggtccgccaggctccgagggaaggggctggagtgcgtcttctttattatagtagtgtagtacatactcgcacgactcgtgacgggccgtattccacactctccagaacgactaattccaagaacacgcttgttcttacaaatgaaactgcctagaacgacgccgaatcgaaccgacggtccgtagttactactgtgacgagagagtcgggcccaacgtaccgttaataccgntaagcgggtactcggacgggaccaagggtaccc

SEQ ID NO: 183603 - DNA, 620 bp, Homo sapiens
  misc_feature: GYAE6OF02G5GVC.13.76.G10.1.454.CMB.1.raw
  modified_base (453)..(453): a, c, t, g, unknown or other
  misc_feature (453)..(453): n is a, c, g, or t
  modified_base (468)..(468): a, c, t, g, unknown or other
  misc_feature (468)..(468): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctggttcaccgtcagtcacacctacatgagctcgggtcccgccaggcctccgaggggaacgggcgtgggagtcggcgttctcttttatttataggttaggtggtagtacatacctccgcacgacctcggtggacggggccattccaccatcctaccagacgactaacttccaaagaaccacgtacttgtttaccctaanaaagttacgaaaccngtcctagcgaagcccgtataccggacaccgggtcccgttagttaactttcgtggtcgacgagtaggacggtccggggaaccctacggtaaaccgttaccaacggtcgttaacgcgggtaccggtccggtacggggacccaacggggtccccg

SEQ ID NO: 183604 - DNA, 591 bp, Homo sapiens
  misc_feature: GYAE6OF02GTF4W.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggcagataaatatacttcctggtatcagcagaagtcaggccagtcccctgtgctggtcatcgtatcaagatcgccaagccggccctcgaagggtacttccccgtggacgcgtatttccgtcgtcggctacccgaaacttcgtacgggtaactccgaacgcctactctacgacctagtcgacggaccgggacccaggcctagtcggactggacggctagtactagttactggtccgtagggcggtagggactacgacgaacgccaccgtcgtacccgtcttacggtcgttaccgtacgggaaccgtacgggtaaccggtaacggttaccgtaaccccgtacggtaacgtccgaccggtaacccccgg

SEQ ID NO: 183605 - DNA, 630 bp, Homo sapiens
  misc_feature: GYAE6OF02HBFDR.13.76.G10.1.454.CMB.1.raw
  modified_base (192)..(192): a, c, t, g, unknown or other
  misc_feature (192)..(192): n is a, c, g, or t
tcagtcacgtactacacgaccggtgctcgatttagtcactcatacaggggctgggcctcaggaagcagcatcggaggtgcctcagccatggcctggaccgctctcctgctgagcctccttgctcactttacagcttctgtggcctcctatgagttgactcagccactctcagtgtcaggtcggccccggganagacggccacaattccctgtgagggaaacaaccttagaagtcagaatgtccactggtaccagcaagaagtcaggccaggcccctgtggtggtcatctagtaagggataactaacccggccctacgtcgggactcccgtgaccgtattctctggcctaccaacgtcggggaacacggccaccctcgaccatcaaacagacgacccaaggaccgggagtcggaggacaggtacttaattagttcgtacgtagggtgtagggaactagaccgaaccgacggtgattgttacgggcggacgggaccaagtccgtacgacccgtacgacggtaccgacggacccgaagggtcctccggtcccccgttacgggtccctacccgtttccgttacccggttcccccggtaccccttacccgttcccttaagggacccgtttaccgg

SEQ ID NO: 183606 - DNA, 664 bp, Homo sapiens
  misc_feature: GYAE6OF02HOE5A.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaggtgccagtgtgaggtgcagctggtggagtctggaggaggcttgatccagccgtggggggtccctgagactctcctgtgcagcctcgtggtcaccgtcagtcacacctacatgagcgtcgggtccgccgacggcctccggagggaacggggctggagtgcgttcttctttattagtagtagtggtagtacagtactccgacagacctcgtgggacgggcctattccaccgtatccgtaccaagaacgactaaacttaccaaacgtaacaccgtacttcgttttacctactaaaagtcgaaacacgtccgtaagacgtacgacccgtagtacggaccgtaccgggtccgttagttaacgtttacgtcggtacggaccggtaggtaacggtagggtaccgggggtaacccctaacgggtaaccggttaaaccgtaaccgtaccgttacggtacgggtaaccggttacggtaacgggtacccggaacgggtaaccccgg

SEQ ID NO: 183607 - DNA, 684 bp, Homo sapiens
  misc_feature: GYAE6OF02HDZHO.13.76.G10.1.454.CMB.1.raw
  modified_base (299)..(299): a, c, t, g, unknown or other
  misc_feature (299)..(299): n is a, c, g, or t
  modified_base (376)..(376): a, c, t, g, unknown or other
  misc_feature (376)..(376): n is a, c, g, or t
  modified_base (443)..(443): a, c, t, g, unknown or other
  misc_feature (443)..(443): n is a, c, g, or t
tcagtcacgtactacacgaccggtgctcgatttagtcactcatacagggggggaggaggagcccagcactgggattccgaggtgtttccattcggtgatcagccactgaacacagaggactcaccatggagttttggctgagctgggttttccttgttgctattttaaaaggtgcccagtgtgaggtgcagctggtggagtctggaggaggcttgatccgagccgtggggggtccctgagactctcctgtgcagcctcgtggtcaccgtcagtcaccacctacatgagcgtcgggtccnccgaggcctccggaggggagggctgggagtcgcgttcttcttttattagtagtacggttggtatacacgtactccgnagtacctcggtggacgggtccgtattccgaccagttcctacagtatactaaacttccgaaagtaacncgtcgtttcgtttaccttaacaaagttcggtaaactacggtcccttaggaacggtacgacccggtaattaaccggaccgtaaaccggggtcccgttagttaaccgtttacggtcgtcggtacggaggtacgtacggggttaccggggaaccccctaagggtaaaccgtttaacctacgggtaaccttaggttaccggggaccgttccggggtacgggggaccccgaaaggggtacccccgg

SEQ ID NO: 183608 - DNA, 577 bp, Homo sapiens
  misc_feature: GYAE6OF02GFEB5.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgaaggggaggggctgggagtgcgtcttcttttatttatagtagtggtagtacatactccgcagactcgtgagggccattccaccatctccagagacaattccaaagaacaccgtcttacgtttctacaaattgaaaccagcctagagacgccgatcggaactaccgggtcgttagttattacgtgtcgacgagagagtcggggcccaacggtaaccggttaactaccgtcgttacgcgggtaccgtcggtacggggacccgtaaggggaccccg

SEQ ID NO: 183609 - DNA, 668 bp, Homo sapiens
  misc_feature: GYAE6OF02GSSS1.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttccaccgtcagtccacacctacatgagcgtcgggtcccgccgaggcctaccgaggggaacggggcgtggagtgcgttcttcttttattatagtagtggtagtactatacctccgcacgtactccggtggacggggcctattccgacctatcctaccgagaacgaactaacttacccaaagtaaccacgtcttagtttccttaacgaaattcgaaactagtccctaggacgtacgcccgtaagtcgaaccgtccgggtccgttagttaactttacgtggtacggaccggtaagacgggtacggtaccgggggacccctaaaccgggttaaccgtttaccgtacccggattaacggttccggggaaccggtttccgggtacggggggaacccctaacgggggacccccg

SEQ ID NO: 183610 - DNA, 544 bp, Homo sapiens
  misc_feature: GYAE6OF02I5PCB.13.76.G10.1.454.CMB.1.raw
  modified_base (330)..(330): a, c, t, g, unknown or other
  misc_feature (330)..(330): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggcagataaatatacttctggtatcagcagagtcgaggccacgtcccctgtgctggtcatctatcaagatgccaagccggccctcgagggactcccgtgagcgtnttcgtcgtcggtcctaccaacgtccgtacgggaacttccgacgccctaactcctacgacctactcgacggaccgggacccaggctagtggatggagtctgactagttactgtcgaggtcggtaggacagcagcacgtccgccgtactcgtcgttccgttacggaacgtacggaccgtaggtcccgtaaccgttaccgtaacgtccgacgacccg

SEQ ID NO: 183611 - DNA, 662 bp, Homo sapiens
  misc_feature: GYAE6OF02GDMFM.13.76.G10.1.454.CMB.1.raw
  modified_base (370)..(370): a, c, t, g, unknown or other
  misc_feature (370)..(370): n is a, c, g, or t
  modified_base (616)..(616): a, c, t, g, unknown or other
  misc_feature (616)..(616): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggcttgatccagccgtgggggtccctgagactctcctgtgcagcctcgtgggtccaccgtcagtcacacctacatgagcgtcgggtcccgccgaggcctccgagggggaaggggcgtggagtgcgtcttcttttatttatagtagtggtagtacatacctccgnacgtacctccggtggacggggtccgatttcccgaccacttcctacccgaaggaacgaaccaaactttcccgaaaagaaccgtaccgtcctttacggttttacctaacaaaagttcaaaaccgtgacccttaggaacgtaacggacccgtaagtcggaaacccgtaccgggtcccgttagttaacttacgtggttcgacgaagacgtggtaccggggaccctaaacggtaaccgttaaccgaccgtntaacggtggtacccggtcggacggggtacccgaacggggtaccccg

SEQ ID NO: 183612 - DNA, 672 bp, Homo sapiens
  misc_feature: GYAE6OF02JVZTV.13.76.G10.1.454.CMB.1.raw
  modified_base (448)..(448): a, c, t, g, unknown or other
  misc_feature (448)..(448): n is a, c, g, or t
tcagtcacgtactacacgaccggtgctcgatttagtcactcatacaggggggaggaggagcccagcactgggattccgaggtgtttccattcggttgatcagcactgaacacagaggactcaccatggagttttggctgagctgggttttccttgttgcttattttaaaggtgtcccagtgtgaggtgcagctggtggagtctgggaggaggcttgatccagccgtggggggtccctgacggtactctccgtgtgaacggcctcaactattcacttttgcttcgtgccttgggtgtaccgtcgggtcccgccgtaggcctacccggaggggaacggggcctaggacggtggtacgttgggccctagttacgtaaggaccaaggacctaagtggcgacgtaacaggccactaccttaccgtgaacttcccggtacaaaacgtcaaggtnttacatacacttacgtgaacggaggtctacgttacccgaacaacgtccgggttacttaccgttacctccgaatacgtacggtagccaacgtccctagtaaaacgtccggaaacggaccaacggaacggttccttaagtactttacggtgtcgacgtaacgtggaacggttcgggtacccaaccggtaacccggacggtttaacgttttacgggacgtttcgggg

SEQ ID NO: 183613 - DNA, 540 bp, Homo sapiens
  misc_feature: GYAE6OF02GDNWF.13.76.G10.1.454.CMB.1.raw
  modified_base (296)..(296): a, c, t, g, unknown or other
  misc_feature (296)..(296): n is a, c, g, or t
  modified_base (318)..(318): a, c, t, g, unknown or other
  misc_feature (318)..(318): n is a, c, g, or t
  modified_base (372)..(372): a, c, t, g, unknown or other
  misc_feature (372)..(372): n is a, c, g, or t
  modified_base (383)..(384): a, c, t, g, unknown or other
  misc_feature (383)..(384): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctggggtcccnccagggctccgagggaagggcngggagtgcgtcttcttttattatagtagtggtatacatactcgcagactcgtgngggcattcacnnctcaganactatccaagaacacgcttgtttctacaattgaacngcctganacgccgancgacacggtccgtgttaatctgtgacgagaggtagcgggacccaacggtaacgttacaccgatacgtcgggacctcggtcggggaccacgggtacccg

SEQ ID NO: 183614 - DNA, 550 bp, Homo sapiens
  misc_feature: GYAE6OF02G42DY.13.76.G10.1.454.CMB.1.raw
  modified_base (387)..(387): a, c, t, g, unknown or other
  misc_feature (387)..(387): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaaggggctgggagtgcgtctctttttattatagttagtggtagtacatactccgcagactcgtgaggggccattcaccntctccagagacaattccaagaacacgctgtttctacaaatgaacagcctgacgagccgatgacaccggcgtgtattactgtgacgagagagtcggggccccaacggtaaccgttacgtacgcttacgcgggtaaccgtcggtcgggggcccaaggggtacccg

SEQ ID NO: 183615 - DNA, 693 bp, Homo sapiens
  misc_feature: GYAE6OF02HX52D.13.76.G10.1.454.CMB.1.raw
  modified_base (584)..(584): a, c, t, g, unknown or other
  misc_feature (584)..(584): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagcttgggttttccttgttgcttatttaaaaggtgcccagtgtgaggtgcagctggtggagtctggaggaggtcttgatccagccgtggggggtccctgagactctcctgtgcagcctcgtcgggttcaccgtcagtcaccacctacatgagcgtcgggtcccgccgacggcctaccggagggggaacggggtcgtgggacggtcgtccgttctttactttttaatttagtaaggttaggttaggtagttaacacttacctccgacacgtactccggtaggacggggcctatccgaccatcctaccgaagaccgaaactaacttacccaaaagaacctaccgtctttacgttttacctaacaaaaagttcgaaacctacggtacccttaagggacgaaccggtccgaaagtacgacccggtaccggtccgttagtttaacgttaccngggtaccgaggtaaggacggtaggtacccgggggaacccctaaaggtaacccgttaaccgacgacgtttacgacgggtacccgtcgggacggggacccaaagggccccg

SEQ ID NO: 183616 - DNA, 673 bp, Homo sapiens
  misc_feature: GYAE6OF02HXXMU.13.76.G10.1.454.CMB.1.raw
  modified_base (367)..(367): a, c, t, g, unknown or other
  misc_feature (367)..(367): n is a, c, g, or t
  modified_base (378)..(378): a, c, t, g, unknown or other
  misc_feature (378)..(378): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttcaccgtcagtcacacctacatgagtcgtcgggtcccgccgaggcctaccgaggggaacggggctgggagtgtcgttcgttcttttattagtagtagtggtagtanactactccganacgactcgtggaggggtccgtattccgaacctatcctaccaaggacgaactaaacttaccaaagaaccacgttccttacggttttccttaactaaattacgaaactcgaaccctggaacgacgaccgaagtacgaaccggacccggtcggttaacgttacgtttacgtaggtcgtacggaagtagtacgggtacccgggggaccctaaacccgggttaaacgttaccgttaacgtaccgttaaggtacgggtaccggttacggtaccgggggacccgtaaacggggtaaccccgg

SEQ ID NO: 183617 - DNA, 547 bp, Homo sapiens
  misc_feature: GYAE6OF02F0EZM.13.76.G10.1.454.CMB.1.raw
  modified_base (388)..(388): a, c, t, g, unknown or other
  misc_feature (388)..(388): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtcccgccaggctccagggaaggggctggagtgcgtcttcttttatttatagtagtggtagtacatactccgcagactccgtggaggggccattcaccntcctccagagacaatccaagacacgctgtttctcaaatgaacagcctgacgagcgatcgacacggccgttagtaattactgtgcgagagagtcggggcccacggtaacgttacgtacgacttacgtcggaccgttcggcggggtaccaacggggacccg

SEQ ID NO: 183618 - DNA, 727 bp, Homo sapiens
  misc_feature: GYAE6OF02IM7T5.13.76.G10.1.454.CMB.1.raw
  modified_base (170)..(170): a, c, t, g, unknown or other
  misc_feature (170)..(170): n is a, c, g, or t
  modified_base (301)..(301): a, c, t, g, unknown or other
  misc_feature (301)..(301): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctnagtgtccgtgtaccccaggacagacagccagcatcgacctgctctagaaataatgacagaataaatctacttctgtatcagacagaagtcaggccacgtcccctgtcgcgtggtacctatctatacgaagngtacggaccaacggccgtaccctacggacgggtactacccgtggacgtcgtacttccgttccgtaggtcctaaccaacgttcggtacggggtaaacctcccgggtaccctacttaccgtacgacccctaacgtaccgaacgggtacccgggaacccgtaaggtaccgttaagtacgggtacgttaggggaaacggttcctaacgggttaaccttttaacgttaccggtacgggttacgaaccggggtcgggttacggggaacctacgggaccgaacgttccctaacgtacccggtccccgagtttacggttcgttaccggtttaccgggtaaccgtacgggggaaaccccttacggggttaacccgaacccggtttaccgttaacccgtaccgggtaacccggacccccgtaacggtaaccccccg

SEQ ID NO: 183619 - DNA, 547 bp, Homo sapiens
  misc_feature: GYAE6OF02HDN2L.13.76.G10.1.454.CMB.1.raw
  modified_base (365)..(365): a, c, t, g, unknown or other
  misc_feature (365)..(365): n is a, c, g, or t
  modified_base (401)..(401): a, c, t, g, unknown or other
  misc_feature (401)..(401): n is a, c, g, or t
  modified_base (436)..(437): a, c, t, g, unknown or other
  misc_feature (436)..(437): n is a, c, g, or t
  modified_base (477)..(477): a, c, t, g, unknown or other
  misc_feature (477)..(477): n is a, c, g, or t
  modified_base (536)..(536): a, c, t, g, unknown or other
  misc_feature (536)..(536): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtcccctgagactctcctgtgcagcctctgggttccaccgtcagtcacacctacatgagctgggtcccgccaggctccgagggaagggctggagtgcgtcttcttttattatagtagtggtagtacatactccgnacgactccgtgacggggccattcaccatctccaganacattaccaagacacgctgtttcttacaatgaacnncctagagacgccgatcgaccacggtccgtagtacttacgngtgcgagacggagtcggggacccaacggtacgttaccgtacgctagtcggacggttcgnggggaacccgg

SEQ ID NO: 183620 - DNA, 599 bp, Homo sapiens
  misc_feature: GYAE6OF02GVIZ5.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccaggcctccgagggagggctggagtgcgtctcttttattatagtagtggtagtacatactccgcagactccgtggagggccattccaccatctccagagacaattccaagaacacgtcttgtttctacaatacgaacagccctggagacgaccgagtcgaccgaccggtccgttagttacttacgtgttacggaccgtaggacggtagtccgggggtaccccaaacggtaacccgttaacgtaccggtcttaaggtcggggtaaccgttccgggttcggggacccgtaagggggtaaccccg

SEQ ID NO: 183621 - DNA, 585 bp, Homo sapiens
  misc_feature: GYAE6OF02JH77X.13.76.G10.1.454.CMB.1.raw
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagctgggtttccttgttgctatttaaaggtgcccagtgtgaggtgcagctggtggagtctggaggaggcttgatccagccgtcggggggtccctggagactcctcctgtgcagcctcgtgggttccaccgtcagtcacacctacatgagcgtgggtccgcaggctccgagggagggcgtggagtgcgtcttcttttattagtagtagtggtagtactatacgtcgcagctcggtggacgggccatcaccntctcaganaacaatccaagacacgtctgttctacaaatnaacngcctagagacgccgatcggaacctacgggtccgttagttaacttacgtcggtacgacgaggtacgacggtaccggggaccccaaagggtaaccgttaccgtcggtaccttaggttcgggaccgtttcggacgggggaccctaaccggggtacccg

SEQ ID NO: 183622 - DNA, 687 bp, Homo sapiens
  misc_feature: GYAE6OF02G42LV.13.76.G10.1.454.CMB.1.raw
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (257)..(257): a, c, t, g, unknown or other
  misc_feature (257)..(257): n is a, c, g, or t
  modified_base (271)..(271): a, c, t, g, unknown or other
  misc_feature (271)..(271): n is a, c, g, or t
tcagtcacgtactacacgaccggtgctcgatttagtcactcatacagggctgggcctcaggaagcagcatcggaggtgcctcagccatggcatggatccctctcttcctcggcgtcctgcttactgcacaggatccgtggcctcctatgagctgactcagccaccctcgagtgtccgtcgtccccaggaccagacagccagtccatcacctgctctagaaataattggcagataaatntactcngtatcagcagatnaggccagtccctgntcgtgtcagtctatcaagatcgacctaagccggacccctacgaagggtactccccgtagacggtaccgatttccgtcgtaggcccttaccaaccttcggtacgggaaaccttccgaggcccctaacgtcctacggaaccctataccgaacggtccggggaacccacgggacctacgtacgggacgtacgggacggccgtagtaaccgttattaccgtaggtttacccgagggtacccgggttacgggaaccgttacggaccggtaacgtacccggaaccgttcccggacccggtccgtttaaacgtcgggtttacccgtttaacccggggtaaaccgttcccgggtaaaccggtaaccgggttacccacccgggttaaaccccgttaggtaaccccgaccggttaaaaccccccgg

SEQ ID NO: 183623 - DNA, 639 bp, Homo sapiens
  misc_feature: GYAE6OF02JXH82.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtcgtccgtcgtcccccaggacacgacacgccagcatccacctgctcgtaggaaataagttggcagaataaatatacttcgtggtatcagacaagaagtcgacggccacgtccctagtgctgtctactactactacaacgatcgaacccgacggccggtaccccgtcggaacggtacctacccgtggacgtactacgttcctcgtcgtacctaccgtaaccggtacgtaccgggtaacctcgaaccgtccctaaccgtacgtaccgtaacctacgtccgaccgggacccggacccgacggtacgtaaggcggaacgtacggacggtacacgtaacttacttaacgtcgtacggacggtaccggtaggacgacgcgacgccacgtccgtccgtattacggtcgtacggttaccgacggacggtaccgacggtacccgaccggtaccgtacgtaccgaccgaacccgg

SEQ ID NO: 183624 - DNA, 769 bp, Homo sapiens
  misc_feature: GYAE6OF02FF34V.13.76.G10.1.454.CMB.1.raw
  modified_base (668)..(668): a, c, t, g, unknown or other
  misc_feature (668)..(668): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcactcacctgctacgtaggaataattggacagtaataaactataccttccaggttactacgagacgaagtaacgtccgaacggtccctacggttccccctggttacgtcgttacggtactaagttacctaataccgaaacggtacgtaccggaaccgaaaccgggtccccggtaccccgtacgggaaccggggttacccttccccggtaggtacccgggtactttaaccgtttccggtacccgttaccgggtaccccttaaaccccggtaaccggtttccggtaacccggggtaaaccccttcccgaaccggtccccgtttaaacccttccggaaccgttaaccccaccggttaacccgggaccggggaaaccccgggtaacccgtacgggtacttaaggtacgggtactacgggtaacgtccgtaagttaccgttactacggtcggtacgacgggtacgtacggacncgactacgctaccgtccggcctaggtcgtacgtacgtaaccggtaacgtaccggaacctacgtacccgtaaccgtacgtaacgcccgtaaccgaaccccgg

SEQ ID NO: 183625 - DNA, 697 bp, Homo sapiens
  misc_feature: GYAE6OF02GQ2XH.13.76.G10.1.454.CMB.1.raw
  modified_base (335)..(335): a, c, t, g, unknown or other
  misc_feature (335)..(335): n is a, c, g, or t
tcagtcacgtactacacgaccggtgctcgatttagtcactcatacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttgggacttatgaccttgtctcctggtaccgacaacacccaggcaaacgcccccaaactcattagttacggggtacaataacgccggacctcgagggtcctttcgngatacgtcttctctgctcaagtctggcaacacggcctcctagacaactctcgtgactccgaaggccgtaaggacgacggtcgtagttactttttaccgtggtttgtttaccagtttaacgtcggtacgtaaggggtaaacgggtacgttaggttaacgttttagttacggttttaccggtttttaaggggaaaccgggtttacgggggtaaacccgttaacggggttaccccttaacccgggtttcccggtttaagggttacccgtaaccgggtcccccggtaaacgggtacccccctaaaccccgtacggtttaccgtacccgttaccttcccgtttacccgtttacccccctaacccccg

SEQ ID NO: 183626 - DNA, 563 bp, Homo sapiens
  misc_feature: GYAE6OF02FW8KR.13.76.G10.1.454.CMB.1.raw
  modified_base (381)..(381): a, c, t, g, unknown or other
  misc_feature (381)..(381): n is a, c, g, or t
  modified_base (402)..(402): a, c, t, g, unknown or other
  misc_feature (402)..(402): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaactaattggcagataaatatacttcctggtatcagcagaagtcaggccagtcccctgtgctggtcatctatcaagatcgaccaagccggccctacgagggtactcccgtagacgcgtacttctcgtcggcctaccaactcgtacgggaactcgacgccactcncgaccatcgagccggaacccnggctagtggatggacgtcagtactagttacgtgtacgaggtacgtgggacacgaccgagcctaaccgtcgaccccgtactacgttcggtaccgtttacgggaaccgttagggacccgtaaggtcccgtaacccgttcgtaacggtccgaccgtaaccccgg

SEQ ID NO: 183627 - DNA, 582 bp, Homo sapiens
  misc_feature: GYAE6OF02GGHDP.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggtccgccaggcctccgaggggaaggggctgggagtgcgtcttcttttattatagtagtggtagtacatactccgcagactcgtgacggggccattccaccatctccagagacaattccaaagaacacgcttgtttctacaaatagaacagcctgaacgacgccgatacgaccgacggtaccgtagttaacttacgtgtacgcgtaagacgacggtccgggggacccctaacggtaaccgttaaccgtacgtacctagtcggtacgtcggtacggggaccgaagggtacccg

SEQ ID NO: 183628 - DNA, 570 bp, Homo sapiens
  misc_feature: GYAE6OF02FURUQ.13.76.G10.1.454.CMB.1.raw
  modified_base (293)..(293): a, c, t, g, unknown or other
  misc_feature (293)..(293): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgttgctattttaaaaggtgcccagtgtgaggtgcagctggtggagtctggaggaggcttgatccagcctggggggtccctgagactctcctgtgcagcctctgggttccaccgtcagtcacacctacatgagctgggtccncaggctccgagggacgggctggagtgcgtcttctttattntagtagtggtagtacatactcgcagactccgtgagggccattcaccatctccagacacaacttccaagtaacacgtcttgttcctacaaattgaaactgcctagagacgccgatcgaccgccgggtaccgtgttaacttaccgtgtaggaccgtaggagtacggtcggggaccccaacgggtaaaccgtttacaccgtactagtcgggaccgttgccgggggacctaggggtacccc

SEQ ID NO: 183629 - DNA, 532 bp, Homo sapiens
  misc_feature: GYAE6OF02HP5O4.13.76.G10.1.454.CMB.1.raw
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctggagtgcgtctcttttattatagtagtggtagtacntactcgnagactccgtgaggggccattcacctatctccagacgaacaattccaaagaaccacgcttgtttctacaaatgaacagcctgagacgccgatgacacggctagtattcgtgtgcgagagagtcggggccaacgacgttacacgctagtcggacgtcgagggccaagggtacccg

SEQ ID NO: 183630 - DNA, 496 bp, Homo sapiens
  misc_feature: GYAE6OF02HMO70.13.76.G10.1.454.CMB.1.raw
  modified_base (439)..(439): a, c, t, g, unknown or other
  misc_feature (439)..(439): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtcccccaggacagacagccagcatcacctgctctaggaaataaattggcagataaaatatacttcctggtatcagcagaagtcaggccagtcccctgtgctggtcatctatcaagatgccaagcggccctcagggatccctgagcgattctctggcctcaactctgggactcacgccactctcaccatccaggcggacccagggctagtggatgagctgactattactgtcaggcgtagggacagcagcactcgcccgngtatcggtcttacggactagggacctacggtccacgttcctaacggtcacgaccccg

SEQ ID NO: 183631 - DNA, 582 bp, Homo sapiens
  misc_feature: GYAE6OF02FV4H2.13.76.G10.1.454.CMB.1.raw
  modified_base (297)..(297): a, c, t, g, unknown or other
  misc_feature (297)..(297): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
  modified_base (542)..(542): a, c, t, g, unknown or other
  misc_feature (542)..(542): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtggttcaccggtcagtcacacctacatgagcgtcgggtccncgaggctccgaggggacgggctgggagtgcgttcttcttttaattagtagtagtggtatacatactcgcagactcggtggagggccattccactntcctcagacgactaattccaagacncgtcttagtttacctagtaaatcgaaaccngtaccgtgaacacggccgatcggacgacggtccgttatagttaccgtggtacgacgaggagacggttcggggccctaaaggtaccgttacacgtnttacgtcggaccgttcggacggggacccaaggggtacccg

SEQ ID NO: 183632 - DNA, 575 bp, Homo sapiens
  misc_feature: GYAE6OF02G5ALS.13.76.G10.1.454.CMB.1.raw
  modified_base (234)..(234): a, c, t, g, unknown or other
  misc_feature (234)..(234): n is a, c, g, or t
  modified_base (288)..(288): a, c, t, g, unknown or other
  misc_feature (288)..(288): n is a, c, g, or t
  modified_base (335)..(335): a, c, t, g, unknown or other
  misc_feature (335)..(335): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataatggcagataaatntacttcctgtatcagcagagtcaggccagtccctgtgctggtcatctatcaagntcgccaagccggccctacgacgggactcccgtgacgcgtattctcgnggcctaccaactcgtagggaacctcacgcccactctcgacctagtcacggccggaccaggctagtggaatggagctgtacttacttacgtgtacgaggtccgtagggtacacgtcgacgaccgacgtcgaccccgacttacgttcggtacccggtttacggaaaccgttaccggggaacccgtaacgggttccccgtaaccggtttacccctaaacggttcccgaacccggtaacccccg

SEQ ID NO: 183633 - DNA, 630 bp, Homo sapiens
  misc_feature: GYAE6OF02HY4QO.13.76.G10.1.454.CMB.1.raw
  modified_base (488)..(488): a, c, t, g, unknown or other
  misc_feature (488)..(488): n is a, c, g, or t
  modified_base (539)..(539): a, c, t, g, unknown or other
  misc_feature (539)..(539): n is a, c, g, or t
tcagtcacgtactacacgaccggtgctcgatttagtcactcatacagggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagcgtggtggagtcgtgggaggaggcttgatccagccgtgggggtcctgagactctctgtgcagcctcgtggttccaccgtcagtcacacctacatgagcgtcgggtcccgccgaggcctaccggagggggaacggggcgtgggagtgcgtcttcttttattatagtagtggtagtactatactcgacacgtactccggtaggacggggacctacgttaccacctactccgtacccgaaggacgaactaacttaccgaaagaactaccgtctttgttttacctaacaaatcgaaacncgtcaggaagacgtaccgagtacgacgacggttccgttagtaactttacgngtagacgtaggtaggacgggtccgggaacctaaccggtaaacgtttacgaccgttactaggtaccgggtacggtccggtaggggaacccgg

SEQ ID NO: 183634 - DNA, 618 bp, Homo sapiens
  misc_feature: GYAE6OF02G2MJR.13.76.G10.1.454.CMB.1.raw
  modified_base (289)..(289): a, c, t, g, unknown or other
  misc_feature (289)..(289): n is a, c, g, or t
  modified_base (435)..(435): a, c, t, g, unknown or other
  misc_feature (435)..(435): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtctgggaggaggcttgatccagccgtggggggtccctgagactctcctgtgcagcctcgtgggtccaccgtcagtcacacctacatgancgtggtcccgcaggctccgaggggacgggcgtggagtgcgtcttcttttattatagtagtggtagtacatactcgacagtctcgtggacggggccattcaccatcctcagacgacaacttccaaagaaccacgtctgtttacctanaaatagaacacgcctagacggagtccgagttacaaccggtaccggccgttaagttacttaccgtgtacggacgagtacggaggtaccgggggaaccctaacccggttaacggttaaccacccggtattacgggtacggtaacccgttcggtaccggggggtacccgaaacggggtaaccccgg

SEQ ID NO: 183635 - DNA, 540 bp, Homo sapiens
  misc_feature: GYAE6OF02GOVEH.13.76.G10.1.454.CMB.1.raw
  modified_base (469)..(469): a, c, t, g, unknown or other
  misc_feature (469)..(469): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggaaataattggcagataaatatacttcctggtatcagcagaagtcaggccagtcccctgtgctggtcatctatcaagatcgaccaagcggcccctgacgggactcccgtagacgcgaactttctctggcctcccgaaacttccgtagggaactcgacgccctactctcgaccatcgacggccggaccaggctagtggatgagctagtactattactgtacgacggcgtagggactagacacgcacgtcgcccgtntacgtcgtcgttaccgggaactcggggaacctaacggtccacggttaccctaagtccacggcccaacccgg

SEQ ID NO: 183636 - DNA, 551 bp, Homo sapiens
  misc_feature: GYAE6OF02FJOO9.13.76.G10.1.454.CMB.1.raw
  modified_base (184)..(184): a, c, t, g, unknown or other
  misc_feature (184)..(184): n is a, c, g, or t
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (227)..(227): a, c, t, g, unknown or other
  misc_feature (227)..(227): n is a, c, g, or t
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcggtgtttcgtcgtaggctattaaagtgccagtgtgagtgcagntgtgagtcnggagngctgatcagccgtggggtccctgagctcnctgtgcagcctcgtggtcaccgtcatcacacctacatgatcgtcgggtccnccgaggcctaccgagggagggctggagtgcgtnttacttttatntagtgtgtagtacatctcgcaggctcgtgacgggctatcaacnttcgccagactcaacttcaagaactctcgttnttccttaanaatacgaacgcgtacgtagacgtacgacgtntacgaccgtacgtcgtacgttacttacgngtacgngagagtacggtacggaccgtacgtaacgtacgtacgtacgtacgtacggtacggtcggtacggaccggaccggtaccgg

SEQ ID NO: 183637 - DNA, 605 bp, Homo sapiens
  misc_feature: GYAE6OF02FWBM5.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataatatacttctgtatcagcagaagtcagccacgtcccctgtcgctggtcatctatacaagntcgaccaacgccggccctcgacgggactcccgtgacgtcgtattcctcgtcggcctaccgaacgttcgtacgggtaactccgacgtcccctacgtccgtacgacctaacgtccgacggacccggacccgacgtctagtcggagtggaggtcgtacgtacttacgttaacgtcgtacggacgggtcggagggaccgtagacgacgaccgtaccgtcgacccgtgtacggttcggttaccggttaaccgggaaccgttacgggaaccgtaaccggtccgtaacccggttacgtaccgtacgtcccggaacccg

SEQ ID NO: 183638 - DNA, 608 bp, Homo sapiens
  misc_feature: GYAE6OF02IMSH6.13.76.G10.1.454.CMB.1.raw
  modified_base (518)..(518): a, c, t, g, unknown or other
  misc_feature (518)..(518): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatccacctgctctaggaaataaattggacagataaatatacttctaggtatcagcagaagtcagccagtccctgtagctggtcatctatcgaagatcgaccaaggccggaccctcgaagggaccttccccgtagacgcgtatttcctcgtcggacctaccctaaacgtcgtacgggtaacctccgagaccctacttccgtacgacctactacgacggtccgggtacccaggtaccctagtcggtatggacggtctaacgtacgttactaacgtcgacgttaggcgtacgggaccagtcgacgtccgacgtcgacccncgttactcggttaccgttaaccggacgttaccgggtacaacggttacccgtaccggttaacccgtaacggtacccgaaccgtaaccccgg

SEQ ID NO: 183639 - DNA, 692 bp, Homo sapiens
  misc_feature: GYAE6OF02J2MEX.13.76.G10.1.454.CMB.1.raw
  modified_base (297)..(297): a, c, t, g, unknown or other
  misc_feature (297)..(297): n is a, c, g, or t
  modified_base (519)..(519): a, c, t, g, unknown or other
  misc_feature (519)..(519): n is a, c, g, or t
tcagtcacgtactacacgaccggtgctcgatttagtcactcatacaggggggaggagggagcccagcactgggattccgaggtgtttccattcggtgatcagcactgaacacagaggactcaccatggagttttggctgagctgggtttccttgttgctattttaaaaggtgcccagtgtgaggtgcagctggtggagtcgtggaggaggcttgatccgagccgtgggggtccctgagactctcctgtgcagcctctggttcaccgtcagtcacacctacatgagcgtcgggtcccnccgaggcctccgaaggggtaacggggccttaggggacggtcggccgttccttacgttttttaacttagttaggttaaggttgggttaacgtaccgtattaccgttccgacgtacgtaccgttccggtaggtacgggggtccgtactttccaacccgtactccgtacccgaagtaccgactaaacgtttaccccaaaggaaccaccggtccttgtttacctanaaacttcgaaactcgaccctaggacgacgaccgatagaccgtaccggtccgttagttaagttaccgtggtagaccgtaagacggtacgtccgggggaacccctaaaggtaaccgttaccgtaccgagttaacgtcgggaccttacgggccggggtacccgaacgggtacccgg

SEQ ID NO: 183640 - DNA, 714 bp, Homo sapiens
  misc_feature: GYAE6OF02JMNRY.13.76.G10.1.454.CMB.1.raw
  modified_base (305)..(305): a, c, t, g, unknown or other
  misc_feature (305)..(305): n is a, c, g, or t
  modified_base (380)..(380): a, c, t, g, unknown or other
  misc_feature (380)..(380): n is a, c, g, or t
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgctattttaaaaggtgtcccagtgtgaggtgcagctggtggagtctggaggaggcttgatccagccgtgggggtccctgagactctcctgtcgcagcctcgtgggttccaccgttcagtccacgaccctagactgagcgtgggtcccnccgaggccgtccaggggaacgggctaggaggtgcgttcgtctttttattataggtagtggtatacatacgtccgntaggactccggtggacgggtccggtacttcgacctactccttaccgagaacgacctaacgtttaccccaaaaggaacctaccggttacgtttactttttacccgttaacaaaacgttacggtaaaccaaccggttccgtacgtaaacgacggtaccccgtaattcgggaaacccgaaccggggtccgttagggttaaacctttagtcgttacgggaccgtaggagtacggggtccgggtacccccggtaaagtaaccggtttaaccggaaccgtacgttaacggtcggggttaaccctgggtaaccgggggtacccgtaaaccggggaccccgg

SEQ ID NO: 183641 - DNA, 949 bp, Homo sapiens
  misc_feature: GYAE6OF02J1CB1.13.76.G10.1.454.CMB.1.raw
  modified_base (295)..(295): a, c, t, g, unknown or other
  misc_feature (295)..(295): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagttttggctgagctgggtttccttgttgctattttaaaggtgcccagtgtgaggtgcagctggtggagtctggaggaggcttgatccagccgtgggggtccctgagactctcctgtgcagcctcgtggtccaccgtcagtcacacctacatgacgcgtcgggtcccnccgaggcctaccggaggggtaacggggccgttagggtaggtcggtccgtttcgttaccttttttaagtttaacgtaagggtttaggttagggttaacgtaacctacgttaaccgttccccgacgtaaccggtaccggttacccggtagggtaccgggggtcccgtaacttttaccccgaaccccgtaactttcccgttacccgaagggtaaacgtaaaccccgttaaagttttaacccccggaaaaacggttaaaaccccgtaaccggtttacccgttttacggttttttaacccctttaaacgtaaaaaacggtttacccggaaaaaaccccgttcgggtaccccccgttttaaaaggggaaacccgggtaaacccgggttacccgggaaacgtttaccgggaaaccccggggttacccgggtttaaacccggggttaccgtttttaaacgttaaccgggttgggttaacggacccgggtaaaggaacccgggtagggttaccccggggggaacccccctttaaaacgggttaacccggtttaaacccgtacccgggtttaaccgttaacggggttaacccggggtacccccggggttttaggggaacccccgggggggttaaccccgtaaacccgggggtaaaccccccggg

SEQ ID NO: 183642 - DNA, 605 bp, Homo sapiens
  misc_feature: GYAE6OF02I505S.13.76.G10.1.454.CMB.1.raw
  modified_base (204)..(204): a, c, t, g, unknown or other
  misc_feature (204)..(204): n is a, c, g, or t
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
  modified_base (403)..(403): a, c, t, g, unknown or other
  misc_feature (403)..(403): n is a, c, g, or t
  modified_base (413)..(413): a, c, t, g, unknown or other
  misc_feature (413)..(413): n is a, c, g, or t
  modified_base (453)..(453): a, c, t, g, unknown or other
  misc_feature (453)..(453): n is a, c, g, or t
tcagtcacgtactacacgaccggtgctcgatttagtcactcatacaggggggagagggagcccagcactgggattccgaggtgtttccattcggtgatcagcactgaacacagaggactcaccatggagttttggctgagctgggtttccttgtgctattttaaaaggtgcccagtgtgagtgcagctggtggagtctggaggnggcttgatccagccgtgggggtccctgagactctcctgtgcagcctcgtgggttcaccggtcagtccacacctacatgagcgtcgggtccgccaggctccgaggggaagggctggagtgccggtcttctttttattataggtagtggtagtacatactccggnagtacgtcgtggaacggggcctagttcaccgnttcnccagtacganaacttccaagaacacgtctgtttactacgaaattcgaacncgtcctagacgacgcccaagtcgaaccgtcgggtacccgttagttaacgtacgtgtacgtacgagacggtacggttcggggaacccaacggtaacgtttaacgaccgttactaggttaccggacgttcggtacggggaccgaacggacccgg

SEQ ID NO: 183643 - DNA, 595 bp, Homo sapiens
  misc_feature: GYAE6OF02H23G7.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagntgccaagccggcccctcgacgggactcccgtggacgcgtattctcgtggctaccaactcgtacgggaactcgacgtacccactcgtacgacccagtccgacggccgggacccgaggtcctagtacggacgtaggacggtcgttacgtacttaacgtttacgtggtaccgaggggtccggttagggacgtacgccgacgcctacgtccgcccgtacgtacgttcggttccgttacgggaacgtaccgggaaccgtaacgggttcccgaacccgttaccgtaaccggtcgaccgtaacccccgg

SEQ ID NO: 183644 - DNA, 196 bp, Homo sapiens
  misc_feature: GYAE6OF02H3IVF.13.76.G10.1.454.CMB.1.raw
  modified_base (194)..(196): a, c, t, g, unknown or other
  misc_feature (194)..(196): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttgggctgcctggtcaaggactacttcctagtacgtgactgagcgggctggcaaggcgcatagnnn

SEQ ID NO: 183645 - DNA, 660 bp, Homo sapiens
  misc_feature: GYAE6OF02GMZOE.13.76.G10.1.454.CMB.1.raw
  modified_base (473)..(473): a, c, t, g, unknown or other
  misc_feature (473)..(473): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgatccagccgtggggggtccctgacgactctcctgtgcagcctcgtgggttcaccgtcagtcacacctacatgagctgggtccgccaggctccgaggggagggctggagtgcgtcttcttttattagtagtagtggtatactataccgtcgacagtacgtccgtggacggggcctattccacctactcctaccgagaacgactaacttaccgaaagaccacgtcttgtttacctacaaagttcgaacacgtcctagganaccggaccgtaatacggaccgaccgggtccttagttaaacttcgttggtcgacggtaaggtacggtacggtacccgggggaacccctaaaccgggttaaaccggtttaacccgttacggaccgttaacgggtcgggtaacccggttcgggtacccggggggacccggtaaacgggggtaacccccgg

SEQ ID NO: 183646 - DNA, 579 bp, Homo sapiens
  misc_feature: GYAE6OF02F65MK.13.76.G10.1.454.CMB.1.raw
  modified_base (383)..(383): a, c, t, g, unknown or other
  misc_feature (383)..(383): n is a, c, g, or t
  modified_base (406)..(406): a, c, t, g, unknown or other
  misc_feature (406)..(406): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctcgggccgccaggctccgagggaagggctggagtgccgtctcttttattatagtagtggtagtacatctcgcatactcgtgagggccattcgacatcnccagagacaattccaaagaaccncgtcttagtttcctacgaaatcgaacngcctgaancgccgatacgacgaccggccgttagttacgttacgttgacgcggaagaggtagtccggggtacccaacggtaaccgttaacctaccggtacttacggtacgggtaccgtcggtaccggggaccgaacgggtaccccgg

SEQ ID NO: 183647 - DNA, 815 bp, Homo sapiens
  misc_feature: GYAE6OF02J2KKF.13.76.G10.1.454.CMB.1.raw
tcagtcacgtactacacgaccggtgctcgattagtcactcatacagggggaagcctgggaacacttagccttcatgagtgtcccacatggcctggatgatgcttctcctcggactccgttgccttatcggatcaggacgtggacttcgcagctgtgtcgacccaggtcgcctagttccggtctaccgagttcgtcctaccgtgggacggactacgtcgactaccgtcaacgtttggtacggacctttggacgttaacgtccgggctttccgaagttccgttagtaacgggttacgtttaaccccgtaccccgtacggtaccgttcggtaacccgtaacgtaaccgtaacccgtacggttacccgacgggtaccgttacccggaccgtaccgtaaccggtaccttaccggtaacctttaccgaaacccgtaaacgtaacccgtaaaccgtaccgtaccgggttaaccctaccggtttacccggtaccgggggttaccctaccggtacgttaaccgtccgttacctccggttacgtccgttaccctacgttaccgtacggtaactacgtaccgtacgtaccgttactcgacgtaccggtaccggtaccgtcggacgtacgacgtacgtcgtaactcgtacgttacgttacgtaacgttcgttacgttacgttaacgttcgttacggttagtaccgtacgttaacgttcgtacgtcgttacggtcggttacgacgggtaccgtcgttacccggcgttacggccttaccggcgttaccgtacgtccggtaccgccgttcggtacccttaggtaccccgg

SEQ ID NO: 183648 - DNA, 533 bp, Homo sapiens
  misc_feature: GYAE6OF02GPJMU.13.76.G10.1.454.CMB.1.raw
  modified_base (443)..(443): a, c, t, g, unknown or other
  misc_feature (443)..(443): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtccgccaggcctccgagggaagggctggagtgggtaggtttcagttaggagcaattctcagtgatgggacaacgagaatacgccgcgtctaggtaaaggcagacttacacctatctacaagagatgacgtaccagaagcacttcgcctttcngcagatagagtacgctagaacgtacgagacacagaccataccgtattacgtcgtagactagacgtagtagttgactagtcccgtaaccgg

SEQ ID NO: 183649 - DNA, 540 bp, Homo sapiens
  misc_feature: GYAE6OF02HGZMZ.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccagggcctccgaggggaaggggctgggagtgcgtctcttttattatagtagtggtagtacatactcgcagactcggtgaggggccattcaccatctccagagacaattccaaagaacacgcttgtttctacaaattgaacacgctgagacgccgagtgacacggcgtagtattacgtgtgcgagagagtggggacccacggaacgttactacgctagtcggacgtcggcgggtaccaacgggacccg

SEQ ID NO: 183650 - DNA, 722 bp, Homo sapiens
  misc_feature: GYAE6OF02I689X.13.76.G10.1.454.CMB.1.raw
  modified_base (237)..(237): a, c, t, g, unknown or other
  misc_feature (237)..(237): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagcccaccctcagtcgtccgtcgtccccaggaccagacaggccagcatcacctgctcgagaactaatggcagataatntacttctgtatcagcagacgtcacggccacgtccccgtgtacgcgttcggtctaactctatacgaagactacgaccgaacgccggtaccctacggacggtactcccgtgacgtacgtcgttctcgtcggtactaccgtaacgtcggtacggtacgtacgacgcctactccgtacgtacctactaccggacggaccgggtacccgaagggtccctaacgggttcggaacgttacggaaccggtacgttacgtaacgtttaccgtttaacggtacggttaaccgaccgggttacgggttaacgggacccggtaacggtaccggtaacgacccgtaaccgtcccgggtcccgtaacggtttaaccggtcccgtttaaacgggttacccgggtaaaccgggttaccgggtaaccccggttaacggtccccgggtttaaacccggttacccggttaaacccggtaccggttaccccggtaaacccccggg

SEQ ID NO: 183651 - DNA, 588 bp, Homo sapiens
  misc_feature: GYAE6OF02FWF0L.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagccggccctcgacgggactccccgtgacgcgtattctcgtcggcctcctaactcgtagggaacctcacgccactctcgaccatcgacggccgggacccgaggcctagtggagtggacggctggactttagttacgttaggtacgagggtcggtcgggacgacgacacggccgtacgtccggacccgtacgtacgttcggttaccggtttaccgggaaccgttacggggaacccgtaacgggttcccgtaacccggttacccttaaacggtacccgaccggtaacccccgg

SEQ ID NO: 183652 - DNA, 726 bp, Homo sapiens
  misc_feature: GYAE6OF02IQ3B3.13.76.G10.1.454.CMB.1.raw
  modified_base (290)..(290): a, c, t, g, unknown or other
  misc_feature (290)..(290): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagtcacgtactacacgaccggtgctcgatttagtcactcatacaggggagaggagcccagcactgggattccgaggtgtttccattcggtgatcagcactgaacacagaggactcaccatggagtttggctgagctgggttttccttgttgctatttaaaggtgcccagtgtgaggtgcagctggtggagtctggaggaggcttgatccagcctggggggtccctgagactctcctgtgcacgcctctgggtcaccgtcagtccacacctacatgagctggggtcccnccgaggcctccgagggaacgggggctgggagtggccgttcttcttttattatagtagtggtatacatactcgcagtactccggtgacggggtcattcacctntctccagacgacaacttcaagaacngcttgtttacctanaaagttcgaactacgcccgtagacggtacgccggtatacggaaccgtaccggggtacccgtttaggtttaaaccgtttaaccggtcggtacgggtacccggtaagggtaccgggtaaagggtcccggggggggtaaaccccccgaaaccggggtttaaaccccggttttaaacccggttaacccggggttaacccgttttaacgggtttacccggggggtaaaccccgggtttacccgggggtacggggggggttaacccccccggtaaaacggggggggttaaaccccccccgg

SEQ ID NO: 183653 - DNA, 717 bp, Homo sapiens
  misc_feature: GYAE6OF02GJU15.13.76.G10.1.454.CMB.1.raw
tcagtcacgtactacacgaccggtgctcgatttagtcactcatacagggggcctgggcctcaggaagcagcatcggaggtgcctcagccatggcatggatccctctcttcctcggcgtccttgcttacttcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagccggccctcgacgggactccctgacgcgtattcctctcggctccaactcgtacggggaacctcgacgccctaacttcctacgtacccaacttccgaacggtcccggggaaacccctaggggaccttaaggtacggggaacgttacgggaacgggtcccgttaacggtaacctttaacgttttaaccgttacggttacggaaccggggtcggggtttacgggggaacccaacgggtaccgaacgggtaccctaaccggtccggtccccggttaccgttacgtttaccggtttacccgggtttaaccggggtaaaccgttaccggggggtaaaccccgtaacgggttaccccgtaacccgggtttaaccccgttaacgggtttaacccgacccggtaacccccgtaaaacccccgggg

SEQ ID NO: 183654 - DNA, 654 bp, Homo sapiens
  misc_feature: GYAE6OF02IAT4W.13.76.G10.1.454.CMB.1.raw
  modified_base (297)..(297): a, c, t, g, unknown or other
  misc_feature (297)..(297): n is a, c, g, or t
  modified_base (431)..(431): a, c, t, g, unknown or other
  misc_feature (431)..(431): n is a, c, g, or t
  modified_base (528)..(528): a, c, t, g, unknown or other
  misc_feature (528)..(528): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtggggggtccctgagactctcctgtgcagcctctgggttcaccgtcacgtcacacctacatgagcgtgggtccncgaggctccgaaggggaacgggcgtggagtgcgttcttctttttatttagtagttaggtggtagtactatactcgcagacctcgtaggacggggctattccacctattcctacagacaactaacttaccgaaanaactacgcttagtttcttaacaaatacgtaacacgtccctaggacgacgaccggataccggacgaaccccggggtacgttacggttaactttacggnggttacggtacggagacgggaagttcccggggggaccccaaaccgggttaacgttaacccgtaacggtccttaacggtcgggtaccgggttaccggtacgggggacccgtaacggggtaaccccgg

SEQ ID NO: 183655 - DNA, 557 bp, Homo sapiens
  misc_feature: GYAE6OF02IYVON.13.76.G10.1.454.CMB.1.raw
  modified_base (281)..(281): a, c, t, g, unknown or other
  misc_feature (281)..(281): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (441)..(441): a, c, t, g, unknown or other
  misc_feature (441)..(441): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttcctgttgctatttaaaaggtgcccagtgtgaggtgcagctggtggagtctgggaggaggcttgatccagccgtggggggtccctgagactctcctgtgcagcctcgtgggttcaccgtcagtccacacctanagtgagcgtgggtccgccaggcctccgaggggaggggctgggagtcgcgttcttcttttattatagtagtggtagtacatacgtcgcagactcggtggacgggctatcacntcncaganactatccaagaacncgcttgttcacaatgaacngcctgagngcgatcgactcggcgttagtacttacgtgtacgcgaaggtcgaggttccggggaccctaacggtaaccgttacgacgcttaggacggtacgtcggtacggggaccaacggggcccg

SEQ ID NO: 183656 - DNA, 626 bp, Homo sapiens
  misc_feature: GYAE6OF02IEFQU.13.76.G10.1.454.CMB.1.raw
  modified_base (172)..(172): a, c, t, g, unknown or other
  misc_feature (172)..(172): n is a, c, g, or t
  modified_base (328)..(328): a, c, t, g, unknown or other
  misc_feature (328)..(328): n is a, c, g, or t
  modified_base (391)..(391): a, c, t, g, unknown or other
  misc_feature (391)..(391): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctnagtgtccgtgtcccaggacagacagccagcatcacctgctctaggaaataagtggcagaataaatatacttcctaggtatcagcagaagcaggccacgtccctgtgcctggtcatctatacaagatcgaccaagccggcctcgaacgggctcccgnggacgtcgtacttctcgtcggcctaccgtaactcgtacgggactcgacgccactcacgaccancgacggaccggacccaggctagacggtatcgacggactcggtaattacttacgttacgtacggtacgggacgggttacgggaacgaccgtcggaaaccgtccggtacgtccgggacccgtactttacggttacggtttaccggtaacgggttaacccgggtacgggtaaccccggttaacggggttaccctaacccggtttaacccgtaacggtcccgaaccggtaacccccggg

SEQ ID NO: 183657 - DNA, 789 bp, Homo sapiens
  misc_feature: GYAE6OF02IJ1DB.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagtttggctgagcgttgggttttccttgttgtcttaagttttaaaaggtcgcccagtgtgaggtgcagcgtggtggagtcgtgggaggaggtcttgactccgacggccggtcggggggtccctggacgtaccttcctcccgtgtcgccgacgtcccttcgttcggggttaccacccggtctacgttaccaaccaccctaactagtggacggtccggttccggggtccccgccgaacgggtccgtaccgggaaggggggaacggggtctcggccgtagggttcgggtccgttcgtaggttaaactaaacggtgggtaacgtgggtcgaccgaaggacctaaaccgtaaactttagtcgacgtacgtaccgttcgtagggtacggaacggggtccctaatttcccgaacctaatcccgaacgaggaacgtaacgtacgggtcgaacccggaaacgtaacccgttacccgtaatacgttcgaacgtaaactaaagtaccgaaacgtcggttccggtacgggtaacggtaccggaaccgggtaaccgtacccggtttaccgtttagtttacgttttcgcgggttacggcggttaacgggttgtaccggtaggtaccgggttacgttaccgggttaacgttaccggacttacggtcgggtaccggg

SEQ ID NO: 183658 - DNA, 637 bp, Homo sapiens
  misc_feature: GYAE6OF02G7B5V.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccgaggcctccgaggggaacggggctgggagtgcgtcttcttttatttatagtagtggtatacatacctcgcagtcgtccgtggacggggcctattccaccatcctaccgagacgactaaacttaccgaaagaaccacgtacttggttttaccttaacaaaagttcgaaactacggtaccctaggaacgacggacccgtagtaccggaccgaccgggtccgtagtttacttacgtgtagcgaggagtacgggtccggggacccctaacgggtaacgttacccgaacggtccttaagggtcggtaccgttcgggtcgggggaccctaacgggaccccgg

SEQ ID NO: 183659 - DNA, 725 bp, Homo sapiens
  misc_feature: GYAE6OF02HA0EU.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcaagataaatatacttcctaggtatcagcagaagtcaggccagtcccctgtgcgtcggtcatctatacaagtatcgacaagccgccctacgaggtactcccgtgacgtcgtattccgtacttcggcctaccaacgttccgtacgggaacctcgaacgcctacgtcctacgaaccacgtaccgaacggacccgggtaacccgaagggtccttaacggtacgggaagttcgggaacgggtaccttagggtaaccttaacgttttaaccgttcggtaacggtacggggtacggttacggggtaacctacgggaaccgtacggtaccgtaaccggtacccgggtaccccgtaccggtttacgtttccgggtttaacccgggttaacccggggttaaacccgggttaccgggggtaaacccgttaaaccggggttaccccggttaacccccggttaaccggttaaaacccgggttacccggtaacccgggaaaacccccccggg

SEQ ID NO: 183660 - DNA, 968 bp, Homo sapiens
  misc_feature: GYAE6OF02IKPID.13.76.G10.1.454.CMB.1.raw
tcagtcacgtactacacgaccggtgctcgatttagtcactcatactaggggggtagggaggagcccacgcactgggattcccgaggtgtttccattcggtgatcagcgactgaacacagaggactcaccatggagtttggctgagctgggttttccttgtgctatttaaagtgtaccagtcgtgaggtgactagctggtggagtcgtggaggaggcttgaactccgagggtcctggggggtccctggacgtacgttcgtccgtgtcgcgtagtcccttcgttacggggtctaaccgttgacgttacgacctaccgtacgtagttcgacggtcgtccgggtacccgaccggaagggccttcccgggaagggggtacggggtcgtacgggtacgtaacggtaaccgttcttacgtttttagtttaagtaacggttaaggttcggttaagtaccgtaagttaccgtccggtagaacggtaccttccggttacggaacggggtaccttaacggtttaccaaacccgttaaagttcccgttaaacccgtaaacgggtaaaccggtaaaccgttaaaaaccggttttaccccgaaaaagggtaaacccgtaaaccggttacggtttaaccgtttttaacccggttaaaccgtaaaaaacggttaaaccgggtaaaacgtaaccgggtaccccgtttaagggtaaaccgggtaacccgttaacccgggtaaactttaacggggaaacccgaaccccggggttaacccggttaacggttttaaacgtttacccggtacggttccgggttaaccgggtaagggtaaccggttaccggggttacccggggggtaacccctaaacccgggtttaaacgttttaacccgggttaacgtacccggttttaaggttaccgggggtaacccggtttacccggggaaccgggggtaaccccggttaaagggttaccccccgggg

SEQ ID NO: 183661 - DNA, 616 bp, Homo sapiens
  misc_feature: GYAE6OF02F3BRH.13.76.G10.1.454.CMB.1.raw
  modified_base (303)..(303): a, c, t, g, unknown or other
  misc_feature (303)..(303): n is a, c, g, or t
  modified_base (311)..(311): a, c, t, g, unknown or other
  misc_feature (311)..(311): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccacctcagtcgtccgtgtccccaggacagacagccagcatccacctgcctctaggaaaactaaagttggacaagaactaaatactacttcctaggtatcagcaagagtcaggccacgtccctgtcgcgtggtcatctancaagtacngaccaagccgaccctgacgggtactcccgtaggagtccgtattccgtcgtcgtcctacctaacgtcgtacgggaaacctccgaacgccctaccgtacgtaccgacctatccgacggacccgggtacccacggtactacgtaggagtcggacggtacctagtaccttattaccgttgtacggacgggtacgtcgggaacacgtaccgacgctacgtcccgtccgtacttacggtcgttaccgttacgggaaccgttcggtaacccgacggttccaacccggttacgtacgtaccgtacaaccccgg

SEQ ID NO: 183662 - DNA, 535 bp, Homo sapiens
  misc_feature: GYAE6OF02FZH5N.13.76.G10.1.454.CMB.1.raw
  modified_base (358)..(358): a, c, t, g, unknown or other
  misc_feature (358)..(358): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgagggaaggggctgggagtgcgtctcttttattatagtagtggtatacatactccgnagactcgtgaggggccattcaccatctccagagacaattccaaagaacacgcttgttctacaaatgaacagcctgagagccgatgacacggccgtgtattactgtgcgagagagtcggggcccaacggtaacgttactacgctagtggaccgtcggtacggggaccaagggtacccg

SEQ ID NO: 183663 - DNA, 617 bp, Homo sapiens
  misc_feature: GYAE6OF02GKBOP.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtgggttcaccgtcagtcaccacctacatgagcgtgggtcccgccgaggcctccgagggaaggggctggagtgcgtcttcttttatttatagtagtggtagtacatactccgcagactcggtggacggggccgtattccgacctactcctccgagacgaactaacttaccaaagaaccacgtcttgttttacctacaaagttgaactacgcctaggagacgaccgagtacgacgaccgggtccgttagttattaccgtggtcgacggtagacgaggtccgggggacccctaacggtaaccgttaacctacggtcgttacgtcgggtaccgttcggtacggggacccgtaacggggacccg

SEQ ID NO: 183664 - DNA, 654 bp, Homo sapiens
  misc_feature: GYAE6OF02F655D.13.76.G10.1.454.CMB.1.raw
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
tcagtcacgtactacacgaccggtgctcgatttagtcactcatacaggggcgtgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccgagccgtggggggtccctgagactctcctgtgcagcctcgtcggttcaccgtcagtcacacctacactgacgcgtcgggtccgccgtaggcctaccgaggggaacggggctgggacgtgtcgttcttcttttattatgtagtggtagtacactactccgactagactcgtggacggggtctacttcacctatcctcaganactaattccaaagaaccacgtctgtttcctanaaatgaacacgccgtagaacgtacgaccgtaagcgaacgtaccgggtaccgttagttaacgttacgttaggtacggaccggtaaggtaacgggtacggtacggggggtacccccctaaacggggttaaaccctttaacccgttaacccggtacgtttaacggtacgggtaccccggtttcgggaacccgggggtaaaccccgg

SEQ ID NO: 183665 - DNA, 566 bp, Homo sapiens
  misc_feature: GYAE6OF02F2NVS.13.76.G10.1.454.CMB.1.raw
  modified_base (404)..(404): a, c, t, g, unknown or other
  misc_feature (404)..(404): n is a, c, g, or t
  modified_base (437)..(437): a, c, t, g, unknown or other
  misc_feature (437)..(437): n is a, c, g, or t
tcagtcacgtactacacgaccggtgctcgatttagtcactcatacagggggggagaggagcccagcactgggattccgaggtgtttccattcggtgatcagcactgaacacagaggactcaccatggatttttggctgagctgggttttccttgttgctattttaaaaggtgtccagtgtgaagtgcagctggtggagtctgggggaggcttggtacagcctggcaggtccctgagactctcctgtgcagcctctggattcacctttgattgatttatgccatgcactgggtccggcaagctccgagggagggcctgggagtgggtctcgaggttattaggttggaataggtggtagcagtaggctagtgcggtactcgtggtgaacgggcctatcaccatccncagagacaacgccaacgaactccctgtactacngacaatgaacacgctagagagctagacgacgacggaccttagtattacgttagtgaacgtaaaacgtactaccccttaaccccgttagttacgtttttagggtagttacgggtttacgtacggtacggg

SEQ ID NO: 183666 - DNA, 756 bp, Homo sapiens
  misc_feature: GYAE6OF02INZ22.13.76.G10.1.454.CMB.1.raw
  modified_base (263)..(263): a, c, t, g, unknown or other
  misc_feature (263)..(263): n is a, c, g, or t
  modified_base (550)..(550): a, c, t, g, unknown or other
  misc_feature (550)..(550): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgactcagccgtgggggtccctgagactctcctgtgcagtcctcgtggttcnccgtcacgtcacacctacagtcgagcgtcgggtcccgccgaggccgtaccggagggggaacgggggtcgtggggacgtcggccgttctttctttttaatttacgtaaggttaggttaggttagtaacctagttaaccgtcccgacaacggtaccgttaccgggtgggtaaccgggggccgttaactttaccgaccctattcccgtaccgaagtacgtaaacctaaacttacccgaaaacgtaacctaccggtcttacggttttaccttaaccgaaaagtcgaaaacncgtaccctaggaaccgaggtcccgtaagtccggaaccgtaccgggtcgtttaaggtacttttaacggtcggtaacggaccgtaagggtagtaacggggttacccggggaccccctaaagggttaacccggtttaacctaacgggtacctttaagggtcggggtacccggttacgggtcgggggaacccgtaacgggtaacccccgg

SEQ ID NO: 183667 - DNA, 645 bp, Homo sapiens
  misc_feature: GYAE6OF02F5AFO.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgaccaagccggtccctgacgggtactcccgtagacgcgtattcctcgtcggacctacccaacgttcgtacggggtaacctcgaacgtcccgacttcctacgacccaagtccgacgggtccgggaaccccgtagggacctaggtcggtaatcgggacggtccgtgtaacctttagttacgtcgtaccggaggggtccggttagggaaccacggacgacggacctaccggtaccgcccgtacttacggttccggttaccggtttaccggggtaaccggtaccggggtaacccgtaacgggttcccgtaaccccggttaaccgtttaacggtacccgtacccggtaacccccgg

SEQ ID NO: 183668 - DNA, 607 bp, Homo sapiens
  misc_feature: GYAE6OF02H3GKO.13.76.G10.1.454.CMB.1.raw
  modified_base (271)..(271): a, c, t, g, unknown or other
  misc_feature (271)..(271): n is a, c, g, or t
  modified_base (412)..(412): a, c, t, g, unknown or other
  misc_feature (412)..(412): n is a, c, g, or t
  modified_base (430)..(430): a, c, t, g, unknown or other
  misc_feature (430)..(430): n is a, c, g, or t
  modified_base (529)..(529): a, c, t, g, unknown or other
  misc_feature (529)..(529): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtcctgagactctctgtgcagtcctcgtcggttcaccgtcngtcacacctacatgagcgtcgggcccgccgaggccgtaccgaggggaacggggctgggagtgtcgtctttcttttaattagttagtagttgtacgtacactacctcgctagctcgtggacgggctacttcactctcacganacgaactaactaccaaanacacgtctttcgttttacttaactaaattacgaaaccgtacgtaccgtagacgacgaccgtaagtcgaaccgccggtcgtaggttacttacgtgtacgngaggagacggttccgggaaccctaacggtaaccgttacacggtacttaacggtcggtacgtccgggagggtaacccgg

SEQ ID NO: 183669 - DNA, 633 bp, Homo sapiens
  misc_feature: GYAE6OF02HYOPK.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtcgggggtccctgacgtacctctcctgtgcacgcctctgggttcaccgtcagtccacacctacatgagcgtcgggtcccgccgagggcctccgaggggaacggggctgggagtgcgttcttctttttatttagtagtagtggttagtactacttacgtccgcacgtacctccggtggacggggtcccgtacttccaccctattcctccgaagacgaacaacttaccaaagaaccacgtcttagttttaccttactaaaagtcgaaacagtccgtagagaccgccgacgtagaaccggacggaccgttagtaacgtttaccgtgtcgacgaggagacggtccgggacccaaacggttaaccgtacctaccggacttacggtacgggacgttcggccggggtaaacccgg

SEQ ID NO: 183670 - DNA, 627 bp, Homo sapiens
  misc_feature: GYAE6OF02IMUV9.13.76.G10.1.454.CMB.1.raw
  modified_base (441)..(441): a, c, t, g, unknown or other
  misc_feature (441)..(441): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtagctatttaaaggtgccagtgtgagtgcagctggtggagtctggaggaggcttgatccagccgtggggggtccctgagtactctcctgtgcagcctctggttcaccgtcagtcacacctacatgagcgtgggtccccgcgaggcctccggaaggggaacggggctgggagtgcgttcttcttttattatagtgtgagtacatactcgcagactcgtgacgggctatcacatctacagacgaactacttaccaaagaacctcgccttgtttacttaacaaattgaaacncgtaccgtgacggtacgcccgtatacggaacccgacgggtaccgttagttacgtttacgtcggtacgtacgaagggcgtaacgggtacccggggaacccctaaacgggtaacttttaacccgtacggtaaccgttagtaccggggtaccgtaccgggtcggggggaaccctaaccgggggaccccg

SEQ ID NO: 183671 - DNA, 683 bp, Homo sapiens
  misc_feature: GYAE6OF02GT0G1.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagtttggctgagctgggttttccttgttgctatttaaaggtgcccagtgtgaggtgcagcgtggtggagtctggaggaggcttggatccagccgtggggggtccctgagacctctcctgtcgcacgcctcgtgggttccaccgtcagtccactacctacatgacgcgtcgggtcccgccgaggcctccggaggggaagggtcgtggagtcgcgttcttattttattagtagtagtggtactacataccgtcgctagacctcgtaggacgggctactccacctatctcgaagacactaataccgaaagacactcttacgtttacataaatcgaaacacggtccagacggacaccgtatacggaaccgtaccgggtccgttaattaccgtttaacgttcggacggtaacggaacggacgtaacgggtccccggggggtaacccccaaaacgggttaaacccgttttacccgaaccggggtacccttaaggggttaccggggtaaccgggtcccgggttaaccgggggggaacccctaaacccgggggtaacccccgg

SEQ ID NO: 183672 - DNA, 632 bp, Homo sapiens
  misc_feature: GYAE6OF02H3Z5N.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataaattggacagtaataaatataccttcctggtatcagcaagaagtcaggccacgtcccctgtcgcgtggtccattctatacaagactgaccgaagccggccctcgagggactccgtgagtcgtacttctcgtggtacctaccgtaactcgtacgggaactccgacgtcctaacgtcctacgacctactccgaacggcccgggtacccgaagggtccttaaggtacgggagttaggaccgggtactacgggtaacctttaacggtttaccgtggtaccggagggtccggtacgggtaaccagacgacgtaccaccggtccgcccgtacttcggtcgttccggttacgggtaaccgtcgggtaaaccgtacggttacctacccggttacctaacggtaccgacgtaaccccgg

SEQ ID NO: 183673 - DNA, 706 bp, Homo sapiens
  misc_feature: GYAE6OF02I4DP4.13.76.G10.1.454.CMB.1.raw
  modified_base (269)..(269): a, c, t, g, unknown or other
  misc_feature (269)..(269): n is a, c, g, or t
  modified_base (307)..(307): a, c, t, g, unknown or other
  misc_feature (307)..(307): n is a, c, g, or t
  modified_base (653)..(653): a, c, t, g, unknown or other
  misc_feature (653)..(653): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttaatttaaaaggtgcccagtgtgaggtgcagcgtggtggagtcgtgggagggaggtcgttgactccgacgtccggtcggggggtccctgagtacctcctcctgtcgcncgtcctcgttcggtccaccgtcagtccaacctacctanatgacgcgtcggtccgccgacgccgaccggaggggacgggcgtgggagtcgtccttacgttttattttattagttagttagttggtaagtactatccgtccgacacgtccgtacggtcgggaccgggtccgtactaccgactactcctccgaaagtacgaaacttaaccgttaacccgaaagtaccctacggttcctttagtttaccgtaaacaaagttaccgaaactcggtacctagggaccgtaaggtcccgaagtccgtaaccgccggttcttaacgttattccgtggtaacggagtaacggacggttccggaccggtaaccccggtaattacgtacccgtanacggttacggtacgggtacccggttcgggaacggggaccgtaacggggacccg

SEQ ID NO: 183674 - DNA, 745 bp, Homo sapiens
  misc_feature: GYAE6OF02IVU18.13.76.G10.1.454.CMB.1.raw
  modified_base (285)..(285): a, c, t, g, unknown or other
  misc_feature (285)..(285): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtcgtggaggaggcttgatccagccgtggggggtccctgagtactctcctgtgcagcctcgtgggtcaccgtcacgtcacacctanatgagcgtcgggtcccgccgaggcctcggaggggaacgggctgggagtcgcgttcttcttttagttagtagtagtggtagtactagtacctccgctacgacgttccggtagggacgggcctacttccaaccctattcccgtacccaaggtaacgtaacctaacgtttaacccaaaggtaaacctcggtacctttggttttacctaacgtaaagttcgaaactaccgacgttaggaacgaccggcgtaagtaccggaaccgtaccggggtcccgttaagtttaccgtttaacggtcggtacggtacgaacggtaggtaaccgggttcccgggggaaccccctaaaccgggttaaacccgttttaaccggtaacccggttacgtttaacgggttcggggtaaccccggtttaccggggtaacccggggggtaaccccggtaaaccggggtaaccccccgggg

SEQ ID NO: 183675 - DNA, 679 bp, Homo sapiens
  misc_feature: GYAE6OF02GGOOO.13.76.G10.1.454.CMB.1.raw
  modified_base (321)..(321): a, c, t, g, unknown or other
  misc_feature (321)..(321): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatccacctgcctctaggaaaattaaagttggacaagtaataaaattatacttccgtaggttatcagtacaacgaagtcgacggaccacggttcccctggtcgtcgttggtcatactanacaagactcgaccaacggcccggacccctacgacgggtacctacccgtgacgtcgtacttccgtcgtcggtcctacccgtaacttcgttacgtacgaacctcgtaccgaccctactcctacgacctacgtaccgacggaccggggtacccacgggtacctaggtacgggtacttagggacgtaccttaggtaacctttacgtttacgtcgtaccggtaggggtccgggttaagggaccgtacggacgacggacctacggtccgacccgttacgtacgttacggttcccggttaaccggaacgggttaccggaacctacgggttaccctacccggtttacgtaccgtcccgaaccccgg

SEQ ID NO: 183676 - DNA, 755 bp, Homo sapiens
  misc_feature: GYAE6OF02JKW2E.13.76.G10.1.454.CMB.1.raw
tcagtcacgtactacacgaccggtgctcgatttagtcactcatacaggggggaggagggagcccagcactgggattccgaggtgtttccattcggtgatcagcactgaacacagaggactcaccatggagtttggctgagctgggttttccttgttgctattttaaaggtgccagtgtgaggtgcagctggtggagtcgtgggaggaggtcttgatccgagccgtggggggtccctgacgacctctcctgtgcacgccttcgtgggttcaccgtcagtccactacctacatgacgcgtcgggtccgccgaggcctccgaggggaacggctgggacgtgcgtcttacgttttattagtagtagtggttacgtacattacctccggctacgtaccgtccggtaggacggggtaccctagttacccgaccctagttcccgtaccgaagaacgtaacctaaacgtttacccgaaaagacccgtaccgtactttggttttacctaaccgaaaagttacgtaaaccctacggtaccctaggaacgaccgggtaccgtaaatccggaaacccgtaccggggtcccgttaaggtttactttacccggtagggtccggtaacgtaacgggtaacggtacggggttacccgggggtaaccccaaagggttaaacccggttttaccgaaccggttcccgtaaagggtttccggggtaacccgtccgggttaaccggggggaccccggtaaaaccggggtaccccgg

SEQ ID NO: 183677 - DNA, 678 bp, Homo sapiens
  misc_feature: GYAE6OF02H6DAQ.13.76.G10.1.454.CMB.1.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggaccagacagccagcatcacctgctcagaaataatggcagataaatatactcctgtatcagtcaagagtcacggccacgtccctgtcgctggtcatctancagntcgaccagccggccctgacgggactcccgtgacgcgtacttcctcgtcggacctacaaccttcggtacgggaacctcgaacgtcctacctacgtacgaacccttagccgaacgggtacccgggaacccgaagggtccttaaaggcgggtaacgttacgggaccgttaacggttcggaaacctttagttaaaccgtcgggttaaccggacggtccgggttaagggaacctacgggaccgtaccggaccgtacgtaccggtccccgttagtttacgttccggtttaccggttaacccggtaacccggttacggggaaaccccgttaacggttaccccggttaaccggtttaacccgtaacggttaccccgaacccggtaacccccgg

SEQ ID NO: 183678 - DNA, 840 bp, Homo sapiens
  misc_feature: GYAE6OF02JRY3C.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagcgtcgggtccgccaggcctccggaggggaacggggcgtgggagtggcgttcttacgttttatttattagtagtggtagtacatacgtccgacgagtaccgttccggtggacggggtacccgtaagttccaacctactccctacccgaaggtaaccgaacctaaacgtttaaccccgaaaggaaaccctaaccggtactttaacggtttttaccttaaccgtaaaattaccggtaaaaccctacggtaccccgttagggaaacggtacggtaaccccggtaagtaaccgggtaaccccggtaacccggggttaccccgggtttaaagtttaaccgttttaacccggggttacggtttacggggtaacccgggtaagggtaaagggtaacccgggggtttccggggggaaaccccccgttaaaaccggggttaaaaccccggttttaacccggaacccgggttaacctttaacccggggttacggggttaaaccccgggtttcccgggtaaccgggggggtaacccccggtaaaacccggggggttaaccccccggg

SEQ ID NO: 183679 - DNA, 714 bp, Homo sapiens
  misc_feature: GYAE6OF02HNIB4.13.76.G10.1.454.CMB.1.raw
  modified_base (191)..(191): a, c, t, g, unknown or other
  misc_feature (191)..(191): n is a, c, g, or t
  modified_base (213)..(213): a, c, t, g, unknown or other
  misc_feature (213)..(213): n is a, c, g, or t
  modified_base (281)..(281): a, c, t, g, unknown or other
  misc_feature (281)..(281): n is a, c, g, or t
  modified_base (509)..(509): a, c, t, g, unknown or other
  misc_feature (509)..(509): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagtttggctgagctgggttttccttgttgcttattttaaaggtgtcccagtgtgtaggtgcagntggtggagtcgtgggaggaggnttggatccagtccgtggggggtcccctggacgacgtcgtcctggtcgcagcctcgtgggtcacccgtnacgtcaccacctacagtgactcggtcgggtcccgccgtacgggccctacgggaacgggggtaaacggggtccggttagggacgggtcggtaccggttccgtttacttttttaaggtttacgttaggttacggttagggttaacgttactaacgttaaccgtccgacgacggtaccgttccggtacgggacgggggtctaacttccgacctaacgtccctacgacgtanaaccgtaacttaccaaacggtaacaccgtcgttaccgtttacttacaaacttagaaccagtacctagagacgccgatacgacgtaccgtcgtacttagttaccgtgtccgtaggagtacggacggtccggggaacctaaccggtaacgttaaccgtaccgagttacggtacggacgttaccgggcggtaccgaacgggtacccgg

SEQ ID NO: 183680 - DNA, 877 bp, Homo sapiens
  misc_feature: GYAE6OF02F48CB.13.76.G10.1.454.CMB.1.raw
  modified_base (237)..(237): a, c, t, g, unknown or other
  misc_feature (237)..(237): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatntacttctggtatcagcagagtcaggccacgtccctgtgctggtcatctatcgaagactgaccgaagccggccctcgacgggtactcccgtagacgtaccgtacgtttcctacgttcgggacccttaccgtaaccgttccggttacggggtaaacccttaccgaacgggtcccctaaccgtttacccgtaccgggtaaccccttaaacgttaccccggaaacgggtaacccccggggggaacccccggtaaaccgggggtcccgtttaaacggggtttacgggttaaaacccggttacggggtaaaccggggtacccgtttaaacggggtaaacccttttaaacgttttaacccggtttaaccggggtttaacccggaaacccgggggggtttaccgggttaaccggggggttaacccgtaaacgggtaacccggttaaacccggaacccggtaccggtttaacccccgggaccccgttaccgttaaccgggtttaccgggtttacccggttttaaacccgggggaaacccggttttacccggggggaaaccccggttaaacccgggggtttaccccgtaaaccccccgggtttacccggtaaaaccggttaccccgggaaccccggtaaaccccccgggg

SEQ ID NO: 183681 - DNA, 636 bp, Homo sapiens
  misc_feature: GYAE6OF02JRM2K.13.76.G10.1.454.CMB.1.raw
  modified_base (239)..(239): a, c, t, g, unknown or other
  misc_feature (239)..(239): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagcccacctcagtgtccgtgtccccaggaccaggaccagccagcatcacctgctctaggaaataattggcagtataaatntaaccgttcctaggtatcgagacagtaacgtcaggcctaagtcccctgtgtcctggtacaactcttactcgaaagtcgtcgacccgaagtcccggacccgtcgagggtacctcccgtgaacgtcgtacttcacgtcggcctacaacgttcgtggaacctcgtacgcctactcgtacgctagcctaggaccgggaccgtacggtacccgtagtagggtacgtacgggtacgtcgttacggtactttacggttaaccgtggtacggtaccgggtagggtcggaacgacggcacggccaacgccgtacccgtgtaaccgttcggttacgtacccggagttaaccgggacccttaacgggtacccggaccgttaaccgacgtccggtacgtaacccccggg

SEQ ID NO: 183682 - DNA, 763 bp, Homo sapiens
  misc_feature: GYAE6OF02GWVZL.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccacgtcccctgtcgctggtcatctatcaagatcgaccaaggccggccctacgacgggtactccccgtgacgcggtaactttccgtcgtcggtacccttacccgtaaaccgttccgtacggggtaaccttaccgaaccggtccctaaccgttcccgtaccggaaacccctaacgtacccggaaccgggacccggggaacccccgtaggggtacccttaaagggtcgggtaacgtcgggacgggtaccttacgggtaacctttaacgtttaaccgtacgggttaccggtaacggggtaccggggttacggggtaaccaacgggtaccgtaacggacctacccggttccggacccccgttacgttaacggttccgggtttaacccggtttaccggggtaaacccgggttaccgggggtaaaccccgtaaaccggggtttacccgtaaacccccgggtttacccgttaaaccggttaccccggaaccggtaaacccccccggg

SEQ ID NO: 183683 - DNA, 675 bp, Homo sapiens
  misc_feature: GYAE6OF02JYA4T.13.76.G10.1.454.CMB.1.raw
  modified_base (543)..(543): a, c, t, g, unknown or other
  misc_feature (543)..(543): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggtcttgatccagccgtgggggtccctgacgacctcgtccgtgtgcacgcctcgtgggttccaccgtcagtccacacctacatgagtcgtcggtccgccgaggccgtccggagggagggcgtggagtgcgtcttctttattagttagtagtggtaagtactatcgtccacgacgtacgtccggtggacgggtccgtacgttcaaccgtactccgtaccgaagtacgtaactaacttaccgaaagtaacctaccgtacttcgtttaccgtaacaaacgtagaaactcgtcgtagacgacgtacgagtcgaccgtacgggtcttagtacttaacgnggtacgtacgaacggtaggtaccggtaccggggtaaccccctaaagggttaacccgtttaaaccgtccgtaaccgttacggttaccgggtaccgttacccgggaccggggtacccgaaccgggtaaccccgg

SEQ ID NO: 183684 - DNA, 650 bp, Homo sapiens
  misc_feature: GYAE6OF02HNXD7.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaaactaattggacagataaatatacttcctggtatcagcagaagtcaggccacgtcccctgtgcgtggtcatacttatacgaagatcgaccaaggccggaccctcgacgggtactcccgtaggacgtcgtactttcctacgtcggcctaccaacgttcgtacgggtacctacgaccgtccacgtctacgacctatccgacggaccgggacccaggtacccttaggacggtaagttcggaacggtcctacggtaaactttagttaaccgtggtacgaacgggtcggtacgggaacctacgcgtaagccgtaacgcggtacccgtacttaacggttccggttaccgttaccgggaaaccggttaccgggaacccgttaaccgggttacccgaaccccggttacggttaaccggtccgaacccggtaacccccgg

SEQ ID NO: 183685 - DNA, 697 bp, Homo sapiens
  misc_feature: GYAE6OF02JLS7D.13.76.G10.1.454.CMB.1.raw
  modified_base (168)..(168): a, c, t, g, unknown or other
  misc_feature (168)..(168): n is a, c, g, or t
  modified_base (213)..(213): a, c, t, g, unknown or other
  misc_feature (213)..(213): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtgcctcctatgagctgactcagccaccctnagtgtccgtgtccccaggaccagacagccaacgatcacttgctcnggaaaataatggcagaataaatataccttccgtgtatcgaagcaagaagtcaggccagtcccctagtcgactggtcctataccgttatacctaaagacttcgaccctaaggccggaccccttgaacgggacttcccgtagagccgttaagttctacgtggcctaccgaccttcgtacggtacctcgacgtccctactcctaacgacctagtaccgagtacccgggacctacgggacttacgtacgggatacggaccgcgttaacgacttaacgttacttaggtcgaaggttccggtaaggggacctacggtaccgaaggtacccgtacgtacccggtaccgtaccgtttaagtccgggtttaacccgttttaacccgggaaaccgggttaccgggtaaacccggtaaacgggttaccccggttaacccgttaaccggttaacccgttacccgggaaaccggttaccccccgtaaaaccccgggg

SEQ ID NO: 183686 - DNA, 607 bp, Homo sapiens
  misc_feature: GYAE6OF02IMZCS.13.76.G10.1.454.CMB.1.raw
  modified_base (254)..(254): a, c, t, g, unknown or other
  misc_feature (254)..(254): n is a, c, g, or t
  modified_base (283)..(283): a, c, t, g, unknown or other
  misc_feature (283)..(283): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagaataatactacttcctggtatcancagaagtcgaggccagtcccctgtacgtntacggtcatactactacaagtactcgaccgaacgccggtacccctagacgggtactcccgtagaacggtcctattccgtacgtcgtcctacctaacgttcgacgggtaacctcgaccgtacctacctcgtaaccgtacctagtaccgacgggacccgggacccgtacgggtacttagtcggtacgtacggtacggtccttacggtactacgttacgtcgtacgacggtcggtacggcaggcacgcacgtcaccgtacgtagtcgtacgtacggacgtacgggacctcggttacccgaccgttaccgtagcgacccgtaacccgg

SEQ ID NO: 183687 - DNA, 825 bp, Homo sapiens
  misc_feature: GYAE6OF02J3IRT.13.76.G10.1.454.CMB.1.raw
  modified_base (201)..(201): a, c, t, g, unknown or other
  misc_feature (201)..(201): n is a, c, g, or t
  modified_base (629)..(629): a, c, t, g, unknown or other
  misc_feature (629)..(629): n is a, c, g, or t
  modified_base (644)..(644): a, c, t, g, unknown or other
  misc_feature (644)..(644): n is a, c, g, or t
  modified_base (657)..(657): a, c, t, g, unknown or other
  misc_feature (657)..(657): n is a, c, g, or t
  modified_base (733)..(733): a, c, t, g, unknown or other
  misc_feature (733)..(733): n is a, c, g, or t
tcagtcacgtactacacgaccggtgctcgatttagtcactcatacgagggggggagaggagcccagcactgggattccgaggtgtttccattcggtgatcagcactgaacacgagagactcaccagtggtagtttggctggagtcgttgggttttccttgttagtcttaagttttaggaaggttcgtcgtaggttgtaggnggtgcgaggtcggttgggtgggtcgggttcggggttggggggtccttcgggccggtcgggtcccgggttcggggtccctaggctccgttctcgtgcgctaccgtccttcggtagttactttacgttacggtttaggtaggttgttcgggtacggttcggggttccgaccgacgtaacggtaccgtacggtaagggaaggtaaccgggtggtggtacgggtacggtaaccggaaacctaaaggtaaaggtaaacggtaagtaacggtaaagggtaacgttaaaggaagtaactttacggtaggttcggtacgtacgttcggtacgggtaacgggtaccggtaacttacgtaacccgttaccgaccgttaccgaacgtaacgaaccgtaaccgaacctaacgtaaccgtaacctggttactacgttaacncgtaacgaacgtacncccggttaaaccncgggtaccgttaacgggcggaaacgttcgggtaaccgtaagttacggttcgtagttaccgtttaagtacgtacggngacgtaacggagttggtaccggtcggttataggtttagttacgggagtacggacgggccggttacgggaccgggtaccgtccgttaccccgg

SEQ ID NO: 183688 - DNA, 686 bp, Homo sapiens
  misc_feature: GYAE6OF02GJERT.13.76.G10.1.454.CMB.1.raw
  modified_base (339)..(339): a, c, t, g, unknown or other
  misc_feature (339)..(339): n is a, c, g, or t
tcagtcacgtactacacgaccggtgctcgatttagtcactcatacagggagaggagcccgagcactgggattccgaggtgtttccattcggtgatcagcactgaacacagaggactcaccatggagtttggctgagctgggttttccttgttgtcttattttaaaaggtgtcccagtgtgaggtgcagctggtggagtcgtgggaggaggcttgactccagccgtgggggtccctgagtacctcctccgtgtgcacgtcctcgtggttccaccgtcagtccacctacctacatgagcgtacgggtcccgccgacggccgtacggaggggaacgggtcgngggagtcgcgttctttacttttattagtaggttagtaggtagttactagtacctacgctacggtactcggtggacggggtcctaacgtcacctatccctacagaacgtaactaacttaccaaacgaaccgacgtcgttacgtttacctaactaaagttacgaacctacgtaccgtaggacggtaaccgacccgtagtaccgaaccggtaccggtccggtttacgttaacttacgtcggtacgacgagtacggtaaccggtcgggtaacccgtaaccggtaaccgttaaccgtacgtacgttacgtacggttaccggtcggtaccggggtaccgaccgggtaacccgg

SEQ ID NO: 183689 - DNA, 548 bp, Homo sapiens
  misc_feature: GYAE6OF02IVVI6.13.76.G10.1.454.CMB.1.raw
  modified_base (255)..(255): a, c, t, g, unknown or other
  misc_feature (255)..(255): n is a, c, g, or t
  modified_base (386)..(386): a, c, t, g, unknown or other
  misc_feature (386)..(386): n is a, c, g, or t
  modified_base (434)..(434): a, c, t, g, unknown or other
  misc_feature (434)..(434): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctgggggtccctgagactctcctgtgcagcctntgggttcaccgtcagtcacacctacatgagctgggtccgccaggctccgaggggagggctgggagtgcgtctcttttattatagtagtggtagtacattactcgcagactccgtgaggggccattcgaccntctccagagacaattcccaaagaacacgctagtttactcaaatgaacngcctggagagtccgatgaccacggccttgtattacgtgtacgacgagacggagttcggggaccctaaggaacgttcgttacgacgtagtacggacggttccgtacgggtaccgg

SEQ ID NO: 183690 - DNA, 575 bp, Homo sapiens
  misc_feature: GYAE6OF02IIFH5.13.76.G10.1.454.CMB.1.raw
  modified_base (324)..(324): a, c, t, g, unknown or other
  misc_feature (324)..(324): n is a, c, g, or t
  modified_base (378)..(378): a, c, t, g, unknown or other
  misc_feature (378)..(378): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataatggacagataatatacttctagtatcagcagaagtcaggcctacgtccctgtgctggtctatctatacaagatcgaccgaagccggccctcgagggactcccgngacgcgtattcgtcgtcggccttaccactcgtacggtaacctcacgcctactcncgaccagtccgacggccggaaccaggaccgttagcggtatcggacggtcttacgtacttaacgtacgtgtaccgtaggtccggtagggacagccgtaacgccgtaccgtccgccgtactaggttccgtacgttaccggacggtccggaaccgtacggtccgtacgtaccgttaacgaccgtaccgaccctaacccgg

SEQ ID NO: 183691 - DNA, 712 bp, Homo sapiens
  misc_feature: GYAE6OF02HMM2M.13.76.G10.1.454.CMB.1.raw
  modified_base (542)..(542): a, c, t, g, unknown or other
  misc_feature (542)..(542): n is a, c, g, or t
  modified_base (663)..(663): a, c, t, g, unknown or other
  misc_feature (663)..(663): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagcttgggttttccttgttgcttattttaaaaggtgcccagtgtgaggtgcagctggtggagtcgtgggaggaggtcttgactccgtaggttcggtcggggggtcccctggagacctcgtcctgtcgcagcctcgttcgggtccaccgtctagtccaaccacctacatggacgtcggtcgggtcccgccgacggtccgtaccggaagggggagggcgtggacgtcgcgttctttcttttagtttagtaacgttaggttggtaacgtactacgtacctcgacgtacggtacctcggtaggacggggacctacttaccacctagtcctacgaaggtaactaactaaccttaccgaaaacgtaaccgtacgttcctttagtttaccctaaagaacgttacgaaacncgtaccgtaggaacgcgtacgtacgtacgacccgtaccgggtcgttaagtttacttacgtcggacggtgtaagacgggtccggtaccggggccctaacggttaaccgttcgtaacccggtnttacggtacggggtcccttacggggtccgggaccgtaaccgggtacccg

SEQ ID NO: 183692 - DNA, 559 bp, Homo sapiens
  misc_feature: GYAE6OF02F8M7X.13.76.G10.1.454.CMB.1.raw
  modified_base (294)..(294): a, c, t, g, unknown or other
  misc_feature (294)..(294): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (476)..(476): a, c, t, g, unknown or other
  misc_feature (476)..(476): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccnccaggcctccgagggaggggctggagtgcgtctcttttattatagtagtggtatacatactccgcagactcgtggacggggcctattccaccntctccagacgacaattccaaagaacacgtcttgtttctanaaattcgaacngtcctgagagccgatcgacgacggtccgtgtattacgnggtgcgagagacgtcggggacccaacggtaaccgttactacgactagtcggtaccgtcggtacggggtaccaacgggtacccg

SEQ ID NO: 183693 - DNA, 591 bp, Homo sapiens
  misc_feature: GYAE6OF02JYK45.13.76.G10.1.454.CMB.1.raw
  modified_base (131)..(131): a, c, t, g, unknown or other
  misc_feature (131)..(131): n is a, c, g, or t
  modified_base (171)..(171): a, c, t, g, unknown or other
  misc_feature (171)..(171): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacnggatccgtggcctcctatgagctgactcagcccaaccctnagtgtcccgtgtcccccaggaccagaccagtcccagcatccacctgcctacgtaggaaaacttaagttcggacagaattaaatactacttacctggtatcagcaagagtacagccagtcccctgtgcgtggtcatctatccaagactgaccgaagccggaccctcacgggtactcccgtgacgcgtattcactcgcgtactactcgtcggaactcgaacgtccctacgtcctacgaccaacgtacgaccggacccggacccgagtaccgtatacgggacttacggcggtctaggacttaagttaccgtcggtacgagggtcgtagggacgtagaccgtagcctaacggcgcccgtgtacgttcgtcggttacggagtccggtacgacgtccaccgtcacggtctcccggacctaacccgg

SEQ ID NO: 183694 - DNA, 582 bp, Homo sapiens
  misc_feature: GYAE6OF02F2XH6.13.76.G10.1.454.CMB.1.raw
  modified_base (470)..(470): a, c, t, g, unknown or other
  misc_feature (470)..(470): n is a, c, g, or t
  modified_base (484)..(484): a, c, t, g, unknown or other
  misc_feature (484)..(484): n is a, c, g, or t
  modified_base (505)..(505): a, c, t, g, unknown or other
  misc_feature (505)..(505): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtcgtgggaggaggcttgatccaggccgtggggggtccctgagactctcctgtcaagcctcgtgggttcagtcttcagtgtatagttggatgagcgtcgggtccgccagacgtaccgaggggaaggggctgggaggtggggtcggaccaacaataaacacgaggaacggaagtcgaacccatactagtagcggactcgtaggtacggaacgggtccgacttccgaccatctaccgagacaacaacgaccaaagtacctcaactatatttanactaacgtggaccnctagagacgagacgacacggntatgtattacgagtgacgagaggtntaggagngtagagtacgtgggttccggggacccgggtacgtcggtctaccgg

SEQ ID NO: 183695 - DNA, 624 bp, Homo sapiens
  misc_feature: GYAE6OF02GCA66.13.76.G10.1.454.CMB.1.raw
  modified_base (169)..(169): a, c, t, g, unknown or other
  misc_feature (169)..(169): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggcagataaatatacttctgtatcagcagaagtcgaggccacgtcccctgtcgctggtcatctatacaagatgaccaacggccggccctcgacgggactcccgtggacgtcgtacttccgtcgtcggtcctacctaacgtcgtacggggaaacctccgacgtacccaccttaccgtaccgaacctacgtccgacgggtacccgggaacccgtacggacgttacgtacggtacgtaggacggtactacgtaacttacttacgttacggtacgacgggtacggtgggaaccagtaccgacgtcgtaccgtcgcccgtacgtcgttacgtcgttaccggtaacgtccgggtaaccgtaacggtccgtaccgttaccgtaacgtaccgacggacccgtaacccgg

SEQ ID NO: 183696 - DNA, 684 bp, Homo sapiens
  misc_feature: GYAE6OF02JZ3YT.13.76.G10.1.454.CMB.1.raw
tcagtcacgtactacacgaccggtgctcgatttagtcactcatacagggggggaggaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagctctcctgtgcagcctcgtgggttccaccgtcacgtcacaccgtacatgagcgtcgggtcccgccagggcctaccggaggggacgggcgtgggagtcggccgttcttcttttaattagtagttaggttggtaacgtacattaccgtccgacacgtacgtcggtcggaacggggtccgtaatccgacctatcctacgagaacgactaacgttaccaaagaacctacgtcttacgtttactacgaaattacgaactacgtccgtacgacgaccgtacgtagtacgaaccggaccggttaccggttcgttaacgtttccgtcggtacgaccgggtaggtacggtacggtccggggaaccccgttaacggtaaccgtttaaccgtaccgtacgtaacggttacgggtacccggttacgggtaccgggggaacccgtacgggggtaaccccg

SEQ ID NO: 183697 - DNA, 698 bp, Homo sapiens
  misc_feature: GYAE6OF02GBGWF.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataatatacttcctgtatcagcagagtcagccacgtcccctgtgcgtggtcatctatacaagatcgaccaagccggcctcgacggactcccgtgacgcgtacttcgtcgtcggtcctaccgtaaccgttcgtacgggaacctccgacgccctaacttcctacgaaccctactaccggacgggacccggggaacccctaagggtacccttaaggtagggttaacgtcggggaacggtaccgttacgtaaccgtttacggtttaaccgttcgggtaccggtacgggggtccgggtacggggaaccgtacggtaccgacggaccgttacccggtcccgggaccccgtacgtttacggttcgggttaacccggttaccgggtaaacccggttacggggtaaacccgttaaccggggttcccgtaaaccccggttaaccgttaaccggttacccggaaccccggtaacccccgg

SEQ ID NO: 183698 - DNA, 692 bp, Homo sapiens
  misc_feature: GYAE6OF02JG955.13.76.G10.1.454.CMB.1.raw
  modified_base (587)..(587): a, c, t, g, unknown or other
  misc_feature (587)..(587): n is a, c, g, or t
  modified_base (644)..(644): a, c, t, g, unknown or other
  misc_feature (644)..(644): n is a, c, g, or t
  modified_base (677)..(677): a, c, t, g, unknown or other
  misc_feature (677)..(677): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagttttggctgagctgggttttccttgttgcttattttaaaaggtgccctagtgtgaggtgcagctggtggagtctggaggaggcttgatccagccgtgggggtccctgagtactcctcctgtcgcagcctcgtgggttccaccgtcagtccacacctacatgagcgtgggtcccgccagggcctaccgaggggaacggggctaggacggtcgcggttcttcgtttttaatttacgtaaggtacgttagggtaagttactagttaacctccgctaacgtacgttcccggtaggacgggggtcccaacgtttcccaaccgtacttcccgtaccgaaaggtacggtaaacctaacgtttacccaaaaggtaaccctacgtacttcgttttaccgtaacaaagttcgaaacctcgtccagaccgagacccgaagtccgaacgaccggtccgtattaacttcgnggtaggcgtaaggtagacggtccggggaaccccaaaggttaacccgttactaccggnttaacggcgggaccgtttaggacccgggggtanaacccgggtaccccg

SEQ ID NO: 183699 - DNA, 587 bp, Homo sapiens
  misc_feature: GYAE6OF02GI0D4.13.76.G10.1.454.CMB.1.raw
  modified_base (467)..(467): a, c, t, g, unknown or other
  misc_feature (467)..(467): n is a, c, g, or t
  modified_base (475)..(475): a, c, t, g, unknown or other
  misc_feature (475)..(475): n is a, c, g, or t
  modified_base (498)..(498): a, c, t, g, unknown or other
  misc_feature (498)..(498): n is a, c, g, or t
  modified_base (565)..(565): a, c, t, g, unknown or other
  misc_feature (565)..(565): n is a, c, g, or t
tcagtcacgtactacacgaccggtgctcgatttagtcactcatacaggggctggggcctcaggaagcagccatcggaggtgcctcagccatggcatggatccctctcttcctcggcgtccttgcttactgcacaggatccggtggcctcctatgagctgactcagccaccctcagtcgtccgtgtccccaggacagacagccagcatcgactgctctaggaaataattggcaagataaatatacttccgtaggtatcagcagaagtcaggccacgtccctgtgcgtgtcatctatcaagatcgaccgaacggccgaccccgtgaacgggtctcccgtagaacgtcttacttctcgtcggtccctaaccgtacgttcgtacgggtaacctcgaacgccctactcctagaccctgacgacggaccggtacccgaggtcctaggcggtatggacgggcctaggtaacttntttaccgngtaccggtggacgggtgaggacncgaacgtcaccgtcggccctatacgtcggtccttaaggacgttcgaacgtacggttccaacccggtntacggtaccacgtaacccccgg

SEQ ID NO: 183700 - DNA, 812 bp, Homo sapiens
  misc_feature: GYAE6OF02IUM6T.13.76.G10.1.454.CMB.1.raw
  modified_base (710)..(710): a, c, t, g, unknown or other
  misc_feature (710)..(710): n is a, c, g, or t
tcagtcacgtactacacgaccggtgctcgatttagtcactcatacaggggagaggagcccagcactgggattccgaggtgtttccattcggtgatcagcactgaacacagaggactcaccatggtagttttggctgagcttgggttttccttgttgcttaagttttaaaaggtgccagtgtgaggtgcagcgtggtggagtcgtggaggaggtcttgactccgacggtccggtcggggggtccctggacgtacctctccgtgtcgacgcgcctcgttcgggtcctaccgtcgacgtcccaacctacctaacagtcggacggtccggtccggggtccccgaccggtacgggtcccgtaccgggaaggggggaacgggggtccgtaggggtacggttcggtaccgtttccttttaacgttttttaagttttaaggttaacgggtttagggttaaggttacggttaactaacgttaccgtcccggacgtacgtaacccgttcgggtacgggaacggggtcccgtaacgtaccgacccgtactccgtaccgaagtaacgtaacctaaaccgttaacccgaaaacggtaaccctacgtttccgtttaacgtttttaaccaacgtaaaaaccgttcggaaaacctcggtaaccctagggtaaacgccggtaccgagtaccggaaccgtaccgggttctaggttacctttaacgggngtacgagagtacggtcgggtacccggtaacctaacggtaacggtttaccacggtccgtaggtccgggtaccgttccgggaccgggaccgaacgggtaccccg

SEQ ID NO: 183701 - DNA, 572 bp, Homo sapiens
  misc_feature: GYAE6OF02IGCMU.13.76.G10.1.454.CMB.1.raw
  modified_base (254)..(254): a, c, t, g, unknown or other
  misc_feature (254)..(254): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggaccagacagccagcatcacctgctctagaaataatggcagataaatatacttctgtatcagcanagtcagccagtcccctgtcgctggtctatctatcaagatcgaccgaagccgcctcgacggtactccgngacgcgattcncgtcggcctaccaactcgtcggacctcgacgccacctctacgacctactaccgacgccggacccgacggtcgtaagtcgagtacggacggtctacgtactaacgttacgtcggtacggacggtcggttacggcgtaacgacgcgtaccaccgtcggacccgtacgttacgtcgttaccgttcggaaccgttacggaaccgtacggtccgtaacccgtccgtaacgcctaccgtaccccg

SEQ ID NO: 183702 - DNA, 727 bp, Homo sapiens
  misc_feature: GYAE6OF02HS0PG.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagccaccctcagtgtccgtgtccccaggacagacacgccagcatcacctgctctaggaaataatggacagataaatatacttctgtatcagcagagtcacggccacgtcccctgtcgctggtcatactatacaagtatacgacctaagccggcccctacgacgggtactcccgtagacgtcgtattccgtacgtcggaccttaccgtaactccggtacgggaaccttcgaacgtaccccacgtccgtacgaacccttagacccgacggggtacccggggaaccccgtaggggtaccttaacggtacgggaacgttagggtaccgggtacccttacgggttaacctttaaccgtttacgttacggttacccggtaggggtcccgggttaagggggaaccgaccggtcgaaccggacccgtaacccggtccgtaccccgttacgttaacgttccgggttaaccccggtttaccgggaaaccgggttacccgggtaaccggttaaaccgggtcccttaaaccccgggttaccccgtaaacgggttacccggacccggttaaaccccccggg

SEQ ID NO: 183703 - DNA, 756 bp, Homo sapiens
  misc_feature: GYAE6OF02GW42W.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcgttgggttttccttgttgcttaattttaaaggtgcccagtgtgaggtgcagcgtggtggagtcgtgggaggaggcttgactccgacgtccggttcggggggtcccctggacgtaccttcctccgtggtcgccgacgcccttcggttcggggttaccctaccggtccaggttaccaacctaaccctaacgtatggacgtccgtacgggtcccgccgaggcccgtaccggagggggtaacgggcgtgggaggttcgtccggtttctttacgtttttagtttaagttaggttaacggttaggtaagttaactaacgttacctccgacgacgttaccgttccggtagggccggggtacccgttattacccgaacctcgtccctaccgaggtaacgaacttactaaccgaaacgaaccgtaccgtacgtttcgtttacttacctaaagttacgtaaaccgacgacctgaacgccgaccggtatacgaccgtaccggtcgttacgtaccgttagtcggtacgcggaacgagggtacggtacccgggaacccgtaacggttaccgtttaacggtacgtacgttaggtaccgggtacggtcgggtacccgggtaaccgg

SEQ ID NO: 183704 - DNA, 618 bp, Homo sapiens
  misc_feature: GYAE6OF02JGLR9.13.76.G10.1.454.CMB.1.raw
  modified_base (272)..(272): a, c, t, g, unknown or other
  misc_feature (272)..(272): n is a, c, g, or t
  modified_base (345)..(345): a, c, t, g, unknown or other
  misc_feature (345)..(345): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttagaaggtgtccagtgtgaggtgcagctgacggagtctggaggagacgttggtccaggccgggggggtccctgacgactctcctgtcaagcctcgtggtcagtccttnagtgtatacgttggatgagcgtcgggtccgcagacctcgagggagggctgggagtgggtgaccaacataaacncgaaggacggaagcgaccaatacgtagcgacggatctaggtgaacgggcctaagttcccaacactccgtaccaagaacacgaaaccgaccaagtaaccactaactaattagtttacaacgtaaacttcgggaacccgtactaggaacggtacgaacggaacggaacgacggtactagtagttacttacgtgtgaacgtagaacgagtaggagagtcggcgtaaggtacgggttacggggacccggggtaacccttgggtaccctacggtaccg

SEQ ID NO: 183705 - DNA, 562 bp, Homo sapiens
  misc_feature: GYAE6OF02G14WV.13.76.G10.1.454.CMB.1.raw
  modified_base (433)..(433): a, c, t, g, unknown or other
  misc_feature (433)..(433): n is a, c, g, or t
  modified_base (474)..(474): a, c, t, g, unknown or other
  misc_feature (474)..(474): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttccaccgtcagtcacacctacatgagctgggtcccgccgaggctccgaggggaaggggctggagtgcgtctcttttatttatagtagtggtagtacatactcgcagactccgtgagggccattccacatctccagagacaattccaagaacacgctgtttctacaaatgaaacngcctagagacgccgatcgacacgggccgttagtacttacgngtagcgagagagtcggggacccctaaggtaaaccgttccaacgcttacgtacgggtacgtccggtgggggtacccaagggtaccccgg

SEQ ID NO: 183706 - DNA, 595 bp, Homo sapiens
  misc_feature: GYAE6OF02HZKVA.13.76.G10.1.454.CMB.1.raw
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatcagccgtggggggtccctgagactctcctgtgcagcctctgggttcaccgtcagtcacacctacatgagcgtgggtcccgccaggcctccgaggggaagggctgggagtggtcgtcttcttttattagttagtagttggtagtacatactccgcagactccgtggagggccgattccacctactcnccagagacaattccaagacacgctntttctanaatgaacacgcctgagagaccgtagtcgaacgaccgggccgttaggttattaccgtaggtcgtacgaaggaggtaacggttcgggggaccctaaccggttaaaccggttactaaccggtacttacggtagggtaccggttacggtacggggaacccgg

SEQ ID NO: 183707 - DNA, 607 bp, Homo sapiens
  misc_feature: GYAE6OF02IDA1P.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcaggaaataattggcagataatatacttctggtatcagcagaagtcaggccacgtcccctgtcgcgtggtcatctactcaagtctcgaccgaagccggaccctcgacgggactcccgtgagtcgtacttcgtctcggtacctacccaactcgtacgggtaacctacgacgtccacgtctacgaccactcgacgccgggaccgacggtctacgtggagtaggacggctacgtacttacgttacgtcggttacggcggtacgggtcggacgtacggaccgacggaccgtacccgtcgacccgtacgttacgtcggttccgttaacgggtaaccggtaccgggtaacccgtacgggtaccctacccgttacccgtaacgttaccggaccgtaaccccgg

SEQ ID NO: 183708 - DNA, 580 bp, Homo sapiens
  misc_feature: GYAE6OF02HS0V7.13.76.G10.1.454.CMB.1.raw
  modified_base (293)..(293): a, c, t, g, unknown or other
  misc_feature (293)..(293): n is a, c, g, or t
  modified_base (358)..(358): a, c, t, g, unknown or other
  misc_feature (358)..(358): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggtcaccgtcagtcacacctacatgagctgggtccnccagctccgaggggaagggctggagtgcgtctcttttattatagtagtggtagtacatactccgnagactcgtggacgggcctattcacctatcctccagacgactaattcccaaagtaacacgtacttgtttcctagaaattgaacagcctgaagacgcgtatacggaccaccgggtccgtagttacttacgtcgtagaccgagagacgtcggggcccctaacggacgttaacctacgtctaagttcggtaccgttcggtacggggtccagggtaaaaaaaccccg

SEQ ID NO: 183709 - DNA, 692 bp, Homo sapiens
  misc_feature: GYAE6OF02H8HRN.13.76.G10.1.454.CMB.1.raw
  modified_base (232)..(232): a, c, t, g, unknown or other
  misc_feature (232)..(232): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctctatgagctgactcagccacctcagtcgtcgtcgtcccaggacagacagccagtcatcacctgctcgtaggaaaataagttcggcaanaataaatataacttccgtaggtatacagactaggaaagtcgaacggcctacgtacccctggtcaccgtggtacctatctaattacaaagtcgttcacccggaaggttcccggacccctaggaaccgggtaactcccgtagggaaactccgtaatttccgtcgtggccctacctaacttcggtaacgggaacccttcaacgtccctacgtaccgtacgaaccctagtaccgtacggaccggggaaccccaagggtaccgttaaggtccgggtaaaggttccgggtaacgtaccgttaacgtaaccgtttaacgttacgttacggttacgacgggtacgggttacggacgttacgacggcgtaacgcgttccggaccgttagtacggtcgttaccgtacggtacggtacggtaaccgttacggcccttaaccggttacgtaaccgtacgacccgtaacccgg

SEQ ID NO: 183710 - DNA, 779 bp, Homo sapiens
  misc_feature: GYAE6OF02JMUBT.13.76.G10.1.454.CMB.1.raw
  modified_base (325)..(325): a, c, t, g, unknown or other
  misc_feature (325)..(325): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagtttggctgagctgggttttccttgttgctattttaaaggtgccagtgtgaggtgcagctggtggagtctggaggaggcttggatccgagccgtggggggtccctggagactctcctgtgcagcctcgtggtcaccgtcagtcacacctacatgagcgtcgggtcccgccgacggcctaccgaggggaagggtccgnggacggtggtccggttcttacgtttttaagttagtaggttacggttagggttataaccgtattaccgttcccgacgtaacgtaccgttacccggtagggacgggggtacccgtacgttttcccgaaccctaacttcccgtaccgaacggaacgtaactaaacgtttaccgaaaacgaacctaccgtcgtttacgttttacctaacgtaaaacgttacggaaaccctagggtaccctaaggggtagaaccggtccgtaaatcgggaaacccgtccggggttacccgtttagtttaaccgtttaacgttgggaccgtcgttaaacgggtacggtaacggggttcccggggaaaccccctaacgggtttaaaaccggttccccgtaacggtacctttaagggccggggttaaccggttaccgggtccggggggaaccctaaccgggggtaaccccgg

SEQ ID NO: 183711 - DNA, 611 bp, Homo sapiens
  misc_feature: GYAE6OF02G2NVZ.13.76.G10.1.454.CMB.1.raw
  modified_base (290)..(290): a, c, t, g, unknown or other
  misc_feature (290)..(290): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagcgtggtttctgtagctatttaaagtgccagtgtgaggtgcagctggtggagtctggaggaggcttgatccagcctcggggggtccctgacgactctcctgtgcagcctcgtggttccaccgtcagtccacacctacatgagctgggtcccncaggcctccggagggaggggctgggagtgcgtcttcttttagtttataggttacgtggtagtactataccgtccgcagtactcggtggaagggcctagttccaccgtatcgactagagactaacttacaaacgacacgtacttcgtttacctacgtaaattagaacctacgtaccgttagacgtaccgactacgaaccgtaccggtcccgttagtacgtttactggtcgtacgagagtacgtcgggacccaacggtaaccgttacgtaccgtagtacgtacgggtacgtcggtacggggaccgtacgggacccgtaaccgg

SEQ ID NO: 183712 - DNA, 511 bp, Homo sapiens
  misc_feature: GYAE6OF02F1SD2.13.76.G10.1.454.CMB.1.raw
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttagaaggtgtccagtgtgaggtgcaactggtggagtctgggggaggcttggtccagcctggggggtccctgagactctcctgtcaagcctctgggttcagcttcagtgtatattggatgagctgggtccgcagacctccgagggaagggctggagtgggtgccaacataaacacagacggaatgacccatactatgcgactcgtgtgaagggccattccacatctccagagacaacgccaagacctcactatattgcaaatgaccnctgagagacgagacacggntatgtattcngtncgagagntgagagtgactagaggttggggcccggaacctggtcaccgg

SEQ ID NO: 183713 - DNA, 695 bp, Homo sapiens
  misc_feature: GYAE6OF02H5Q9W.13.76.G10.1.454.CMB.1.raw
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (395)..(395): a, c, t, g, unknown or other
  misc_feature (395)..(395): n is a, c, g, or t
tcagtcacgtactacacgaccggtgctcgatttagtcactcatacaggggacccaaaaaccacacccctccttgggagaatcccctagatcacagctcctcaccatggactggacctggagcatccttttcttggtggcagcagcaacaggtgcccactctcaggttcagctggtgcagtctggagctgaggtgaagaagccgtggggcctcgagtgaaggtctcctgcaggtcttctggttacttcttacccatacggtatccaccgtgggtgccgacacggccctggacagggtcttgagtgagtgggagttgggtcagcgacgtcgacgacgtaggacacgacagagtangacacgagtaacgtcgaggcagatccaacnctacaccacganacactacaccgaacgtaaaccacgaacgtaccctaagacggtacgggtaacggtacggtaaggaccgtaccgtaggaacgtacgtcgaacggtaccggaaccgtaccgggttacgtttttaacgtaccggtttggacggtaaccggaagggtacgtttacgggtaaccgttaacggaacggtttaaaccggtaccggaaaacccggttaaaaccggttttccgggttaaccccgggtaaccccggggttacccgggggaacccggtaaccggggttacccccgttacggggttaccccgg

SEQ ID NO: 183714 - DNA, 652 bp, Homo sapiens
  misc_feature: GYAE6OF02GZV7T.13.76.G10.1.454.CMB.1.raw
  modified_base (304)..(304): a, c, t, g, unknown or other
  misc_feature (304)..(304): n is a, c, g, or t
  modified_base (559)..(559): a, c, t, g, unknown or other
  misc_feature (559)..(559): n is a, c, g, or t
  modified_base (620)..(620): a, c, t, g, unknown or other
  misc_feature (620)..(620): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtcgtggaggaggcttgatccagccgtgggggtccctgagactctcctgtgcagcctcgtaggttcaccgtcagtcacacctacatcgagcgtcgggtcccnccgaggcctccgaaggggaacgggctggacgtgcgttcttacttttattagtagtagtcggtagtacatacgtcgacacgtactccggtggacggggcctagttccaacacttcgtacccaagtacgaaactaacttaccgaaaacgaaccaccgtctttacgttttacttaacgaaaattcgaaaaccgtcgcccgttaagacgggaacacccggtattacggaccgtaccgggtccgttagttaacttaacgnggtacggacgaaggtaagacgggttccggggaacccctaaggtaaaccgtttcaaccggtnttaaggtacggccgtttagggcgggaacccgg

SEQ ID NO: 183715 - DNA, 610 bp, Homo sapiens
  misc_feature: GYAE6OF02H0MC2.13.76.G10.1.454.CMB.1.raw
  modified_base (170)..(170): a, c, t, g, unknown or other
  misc_feature (170)..(170): n is a, c, g, or t
  modified_base (231)..(231): a, c, t, g, unknown or other
  misc_feature (231)..(231): n is a, c, g, or t
  modified_base (501)..(501): a, c, t, g, unknown or other
  misc_feature (501)..(501): n is a, c, g, or t
  modified_base (506)..(506): a, c, t, g, unknown or other
  misc_feature (506)..(506): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagcccaccctnagtcgtccgtcgtccccaggacagacagccagcatcacctgctcgtaggaaattaatgganagtaataaatatacttccgtagtatcagcagaacgtcgacggcctacgtcccctggtcgcgttggtctagttctaatacaagctacgaccaacggcccggtccctacgacgggtcctacccgtgacgtcttattccgtcgttcgtacctaccgaactcgtacggaactcgacgcctactcgacaccagtcgacggcccggaccgagtctaggtcggactcggagtacctagtaacttagtacgttgacggaggtcgggtagacgacgcgngaccncgtccgcctacgttacgtcggttacggtaccggtaaccgtaccgggaaccctaacggtccgtaaccggttaacctaacggtaccgacccgtaccccgaacccgg

SEQ ID NO: 183716 - DNA, 791 bp, Homo sapiens
  misc_feature: GYAE6OF02F9LK6.13.76.G10.1.454.CMB.1.raw
  modified_base (303)..(303): a, c, t, g, unknown or other
  misc_feature (303)..(303): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgatccagccgtgggggtccctgagactctcctgtgcagcctcgttcgggttccaccgtcagtccaccacctacatgagcgtcgggtccnccaggcctccggaagggacggggcgtgggagtcggcgttctttacttttagtttaatagtagtggttagtaactattacctccgacgacgtaccgtccggtaggacgggggtaccgtacttaccgaaccctacttacctaccgaagaacgtaacctaaacgttaaccccgaaaagtaacccgacggttaccgtttacggtttttaccctaaacgttaaaaacgttacgggtaaaaccctacggtaccccgttaagggaaccgtaaccggtcccggtaaagttaaccggtacccggtaaccggggttcccgtttaacggtttaaactttaaccgttcgggtacggtacccgggagggtaacggtaaccgggttaccgggggtaaccccctaaacgggttaaacccgttttaaaccggacccggttacgttaagggttacgggtacccggttcggtaaccggggggtaacccaacgggggtaacccccgg

SEQ ID NO: 183717 - DNA, 676 bp, Homo sapiens
  misc_feature: GYAE6OF02IDXEI.13.76.G10.1.454.CMB.1.raw
  modified_base (207)..(207): a, c, t, g, unknown or other
  misc_feature (207)..(207): n is a, c, g, or t
  modified_base (399)..(399): a, c, t, g, unknown or other
  misc_feature (399)..(399): n is a, c, g, or t
tcagtcacgtactacacgaccggtgctcgatttagtcactcatacaggggctgggcctcaggaagcagcatcggaggtgcctcagccatggcatggactccctctcttcctcggccgttccttgcttactgcacaggactccgtggccctctatgagctgactcagcccaccctcagtcgtccgtcgtccccgaggacacgacgacncgacgctacaccctcgtcgacttcgtaagtaaacttaagtcgctaagtaataaatactaccttcgtgtactacgagacgaacgtacgacgccgtaccgtaccgttccgtgtcgtctacggtctacgttactacaacgtaacggtcgtaccgaaccggacggtccccgtaccgtacgggaacgtccctacggngtaaccggactttctcgtcgtactaccgtactacgtacggtacgacctcgaccctcctaacgtcgaaccgaccgtacacggtacccggaaccgacggtacgtacgttaggcgtacggttacgacgttcgtaacgttacttcgtacggtcgtacgggtcgacggtagacccgtagaacgacgtaccctacgtaccgtcgttacgtacggtcgttaacccggaggtaacccggtacgtaccgtagaccgtaccgttacgtaccgaccgacccgtaaccg

SEQ ID NO: 183718 - DNA, 574 bp, Homo sapiens
  misc_feature: GYAE6OF02HBQAU.13.76.G10.1.454.CMB.1.raw
  modified_base (365)..(365): a, c, t, g, unknown or other
  misc_feature (365)..(365): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagtctggtaccaacacgaccccaggccaggctccgcgcacgctcatctacacacaacactcgctctcgtcgggtccctcatcgcttctctcggctcactcctggaacaacnctcgtcccttatcacgtccgacggggcccaggcagaagatagactcttagtatttacttactgttcgtttactttattagtgggttagttcgtcttagtttctgtcttgtgggtttcggagggtcggccgtacccggtcgtccggtacccggttccgtccggtcgacggtacccggaacggtcccgtacccgtcccgtacgttccccgg

SEQ ID NO: 183719 - DNA, 591 bp, Homo sapiens
  misc_feature: GYAE6OF02I9ILX.13.76.G10.1.454.CMB.1.raw
  modified_base (297)..(297): a, c, t, g, unknown or other
  misc_feature (297)..(297): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
  modified_base (488)..(488): a, c, t, g, unknown or other
  misc_feature (488)..(488): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttccaccgtcagtcacaccctacatgagcgtgggtcccnccgaggcctccgagggggaacggggcgtgggagtggcgttcttcttttatttataggtagttggtatacatactccgcagactcgtgaggggcattcaccatctccagacacaatacccaagaacacgcttacgtttctacaatgaacngcctgancgccgatgaccgagcccgttgtattactggtacgngaagaggtacgtcgggggaccctaacggttaaaccgttaccgtaaccggtacgttacgtcgggtaaccgttcggtaccggggtacccgaaggggtaaccccgg

SEQ ID NO: 183720 - DNA, 837 bp, Homo sapiens
  misc_feature: GYAE6OF02J3RBR.13.76.G10.1.454.CMB.1.raw
  modified_base (700)..(700): a, c, t, g, unknown or other
  misc_feature (700)..(700): n is a, c, g, or t
tcagtcacgtactacacgaccggtgctcgatttagtcactcatacaggggggagaggagcccagcactgggattccgaggtgtttccattcggtgatcagcactgaacacagaggactcaccatggtagttttggctgagtcgttggttttccttgttgtacttaagtttaaaaggtcgccgtagtgtgaggtgcgtagcgtggtggagtcgtagggaggtacggtcttgacgtccgtacggtcccgggttcgggggtaccctaggtacgtacctccgttcgtcggtacgtccgtccgtccgttccggttaccggtaccctaccgtacgtacctaccgtactaccgtaacctaggtccgtacggtccgggtccgggtaccccgtaacggtcgtaccgggtacgggaagggggtaacgggtcggtaaggtcgttcggttacggtttcctttaagttttacgtaaggttacggtacggttacggtaacgtacctaacgttaccgccgtacggtaccggtcccggtacggtacgggtcccgtacgtacttacccgactacctacccgacggtaaacactaaccgtaaaccgtaactaacgttaccgtacgtttcgttaactaacccgtaagtaacggaccaacgttcgggtaaccaggtaccaaccggtcggtaacctacccggtacgtccgttaaccggttnttaaccgggtatcgggacgttaaccgggacttacggggacccgtaccgggtaacccctaagttaccggtacttaacggtaaccgttcggtacccgggtaccggtacggtacccccgggtaacggtacccgttcccgg

SEQ ID NO: 183721 - DNA, 687 bp, Homo sapiens
  misc_feature: GYAE6OF02FW04R.13.76.G10.1.454.CMB.1.raw
  modified_base (298)..(298): a, c, t, g, unknown or other
  misc_feature (298)..(298): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtcccgtgtccccaggacagacagccagcatccacctgctctaggaaataatggcagataaatatacttctgtatcagcagaagtcaggccacgtccctgtcgcgtggtctatctatcgaagntgaccaagccgccctacgacgggactcccgtagacgtcgtacttctcgtacggtcctaccgtaacgttcgtaacgggtaacctccgaacgtccctacgttaccgtacgaccgtactaccgacgggacccgggtaaccccgaggtacctacggtaggtaacgtcggacggtaccgtacgtaacctttagttaaccgttcggtaccggtaggggtccgttacggggaacaccggtaaccgacggtccgtaacccgggttccgaccccggttattaccggtttccgggttaaccggttaccgggtaaccggttaccggggtaaaccgttaaccgggttccctaaaccccgggttaaccgttaaccggtacccggaacccggtaaacccccgg

SEQ ID NO: 183722 - DNA, 756 bp, Homo sapiens
  misc_feature: GYAE6OF02I97CY.13.76.G10.1.454.CMB.1.raw
  modified_base (261)..(261): a, c, t, g, unknown or other
  misc_feature (261)..(261): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggcttgatccagccgtgggggtccctggacgactctcctgtgcagcctntgggttcaccgtcacgtcacacctacatgagcgtcgggtccgccgaggcctaccggagggggaacggggcgtagggacgtggtcggttcttcgtttttatttagtaggtaggttaggtaacgtacgtaactactccggcacgtaccgttccgtcgggaagggggtcccgtactttccgaacctacttccgtaccctaggaactaacctaaactttacccgaaaacgaaccctaccggttccttagtttttaccttaactaaacgttacgaaaccgtaccgtaccctagggaacgtaccggtaccgtaacgtacgggaaacccgtaccgggttaaccgttgtttaactttaaccggttgttacgggaccggtaagggtaacggtaacgggttaccggggaacccctaaacgggttaacccggttttaaccggttaccgtaaccgttaacgggttacgggttaacccgggtaccggggttacgggggaaacccccgg

SEQ ID NO: 183723 - DNA, 666 bp, Homo sapiens
  misc_feature: GYAE6OF02HAGGU.13.76.G10.1.454.CMB.1.raw
  modified_base (129)..(129): a, c, t, g, unknown or other
  misc_feature (129)..(129): n is a, c, g, or t
  modified_base (216)..(216): a, c, t, g, unknown or other
  misc_feature (216)..(216): n is a, c, g, or t
  modified_base (333)..(333): a, c, t, g, unknown or other
  misc_feature (333)..(333): n is a, c, g, or t
  modified_base (393)..(393): a, c, t, g, unknown or other
  misc_feature (393)..(393): n is a, c, g, or t
tcagtcacgtactacacgaccggtgctcgatttagtcactcatacgagggggggggctgagcccttctctggaaaccacacagctcctcctgcagcagcccctgactgctgatttgcatcgacgggccncttcttccagcaaggggataagagaggcctaggaacgaacctcgcccgagccgtgggcctagacggaagcaggcagtcgggaggtcncctcgagccagtggcagtcggctccctcgttcgttcccgcggtcctccttcgtaccttacgtcgaccacgtacggtaccgtccggtcgtcctacccgtagtcgacgtcgtcgtaccncgacgtacccctacctcgtacgtccgttccgtccgtacccgacggactacgacacgaccncgctacgtccactcgactacgtaaacggtaaacgtaagtcgtaactaagtaacttaaaacgttcttacgttacgtacgttacacgtagaacgtaacgtacgtacgaccgtacccgtaccgttacccgtgtcgtcgtacgtactactagtaccagacgtcgtaccgacctaccggcccgtcgtaccggagtccgtaccgcgtacggtacttcgttccgtccgtacacccgtaccgttaccgtcggtaccgttaccaccggtcctaacccgtccg

SEQ ID NO: 183724 - DNA, 620 bp, Homo sapiens
  misc_feature: GYAE6OF02I4V7J.13.76.G10.1.454.CMB.1.raw
  modified_base (197)..(197): a, c, t, g, unknown or other
  misc_feature (197)..(197): n is a, c, g, or t
  modified_base (208)..(208): a, c, t, g, unknown or other
  misc_feature (208)..(208): n is a, c, g, or t
  modified_base (250)..(250): a, c, t, g, unknown or other
  misc_feature (250)..(250): n is a, c, g, or t
  modified_base (484)..(484): a, c, t, g, unknown or other
  misc_feature (484)..(484): n is a, c, g, or t
  modified_base (534)..(534): a, c, t, g, unknown or other
  misc_feature (534)..(534): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaggtgccctagtgtgaggtgcagctggtggngtcgtggaggnggcttgatccagccgtgggggtccctgagctctcctgtgacngcctgtcggttacaccgtcagtcacacctacatgagcgtcggccaccgagctccgaggggaggccgtggagtcggctcttgttttaagttatagttaggtggtacgtatactacctcgacaacgtcctccggtaggacgggtccgtaattccaaccgtctacctccgaagtacccgaactaacttacccaaaggaacctcggttcttaacgttttcaaacaaagttcgaaaccncgtccgtagacgacgtacgatacgaccgtaccggctttagtacctttagngcgtacgaagtcgtaggcccgggaaccctaagggttacttacccgagttcaaggttcggaccgtgggaccgtacggaccgtacccg

SEQ ID NO: 183725 - DNA, 791 bp, Homo sapiens
  misc_feature: GYAE6OF02H3NHV.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcacgcccaccctcagtcgtccgtcgtccccagacagacagccagcatccacctgcctacgtaggaaaattaagttcggactaagtaacttaaataacgttaccttccgtaggttactacaaggtaccgaaggtaacgtccgaacgggtccctaacccggttccccgttggtcggtaccgttgggttacctaacttaccttaacgtaaccgaaaggtacttaccggaacccgtaacggcccggtaccccgttacggaacgggtccctacccggagtacggtccgttacgtttcctccggtcggtacccttaccgaaccgttcgtaaccgggtaacctcccggtacccgtacccgtaaccgtaccgtaccgtaacccgtaaccgtaccggaacccggggtacccgggtaaacccggtaccggttaccgttacgggtaacgggtcgttaagggccgtaccgttaagttaccgttaacgttacgttccgggacggtacgggacggttacgggacgaacgggtaccgacggaccgtaccgtaccgacccgtagttaccggttgttaccccgggtaaggtaccggtaccggtaaccgtcgtacccggtaaccgttaccgacgtaccgacccgtaacccg

SEQ ID NO: 183726 - DNA, 614 bp, Homo sapiens
  misc_feature: GYAE6OF02ICG1O.13.76.G10.1.454.CMB.1.raw
  modified_base (495)..(495): a, c, t, g, unknown or other
  misc_feature (495)..(495): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagcgtgggttttccttgttgctaattttaaaaggtgcccagtgtgaggtgcagcgtggtggagtcgtggagggaggtcttgatccgacgccggtcggggggtccctggagtactctccgtgtgccagtcctcgttcggttcaccgtcacgtacaccacctacatgacgcgtcggtcccgcgcgccgtcgaggggaacgggcgtggagtgcgtcttctttattatagtagtgtagtactactactcgcacgacgtcgtggcgggtactattccactctcacagactaacaactacaaagaactcgtcttacgtttactaacaaaagtcgaacctagcctaaggcgaacgccgtaaancgtaccgaccggtacgttagttaacctcgtggacgacgtagtaacggccggtaccgggaccctaaacggttacgtaccacgtcgtagtcgggacttcgggacggacccggagtacccgg

SEQ ID NO: 183727 - DNA, 574 bp, Homo sapiens
  misc_feature: GYAE6OF02FNG5L.13.76.G10.1.454.CMB.1.raw
  modified_base (294)..(294): a, c, t, g, unknown or other
  misc_feature (294)..(294): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcacacctacatgagctgggtccnccaggctccgagggaagggctggagtgcgtcttctttattatagtagtggtagtacatactccgcagactccgtagaggggccattccgaccatcctccagagacaataccaaagaacacgtctgtttacttactaaatgaaacagaccttagacgagccgatcgacgacggtccgtagtaacttacgtgtacgacgtagacggagttcggggaccctaacggtaaccgttaacgtaccgacttaacgtggaaccgttcggtaccgggactaaaccgggg

SEQ ID NO: 183728 - DNA, 739 bp, Homo sapiens
  misc_feature: GYAE6OF02GG5HA.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggacagataaatatacttcctggtatcagcagaagtcaggccacgtcccctgtcgctggtcagtctatcaagatcgaccaagccggcccctacgacggggtactccccgtagacgcgtaattccgtcgtcggtcctaccgaacgtcgtacgggaacctccgacgtacccaccttacctacgaccctagtaccgacggacccggggaaccccgtacgggtaccttaacgtacgggaacgttcgggaacgggtccgttagtaacccgtttaaagtttacccgttacggttacggaacggggtccgggttacggggaacccgtagggaccgtaaaccggtaccgtaacccgttaccgggacccccgtacgtttaaccgttccggtttacccggtttaaccccgggggtaaacggtttacccgggggtaaaccccgtaaaccggggtttacccctaaaacccccgggtttaccccggttaaacccgggttacccggaaccccggttaaacccccccggg

SEQ ID NO: 183729 - DNA, 685 bp, Homo sapiens
  misc_feature: GYAE6OF02GLBZM.13.76.G10.1.454.CMB.1.raw
  modified_base (504)..(504): a, c, t, g, unknown or other
  misc_feature (504)..(504): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtgggttttccttgttgcttattttaaaaggtgcccagtgtgaggtgcagctggtggagtctggaggaggcttgatccagccgtggggggtccctgacgactctcctgtgcagcctcgtgggttccaccgtcacgtcacacctacatgagcgtcgggtcccgcacggctccggaggggaagggcgtggagtcgcgttcttacttttattagtagtagttggtagtacatacctccgacagtaccgtcggtacggacggggtacccgtacttccaaccctacgtcctaccgagaacgtaaccctaacgttaacccaaaggtaaaccctcgtactttcggtttacctaacgtaaattacgaaacncgtaccgtagtacggacgccgtaagtaccgacgtaccggtccgtttagttacttaccgtaggtcgacggtaagcgggtacggtccggggtaaccccgaaccggttaacggtttaacccgtaacgttaccgtaggtaccgggtacgttccgggtacggggaccccgaacggggtaacccccg

SEQ ID NO: 183730 - DNA, 1052 bp, Homo sapiens
  misc_feature: GYAE6OF02GXV5C.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtggggggtccctgagactctcctgtgcagcctcgtgggttccaccgtcagtcacacctacatgagcgtcgggtcccgaccgacggtccgtaccggaagggggaaacgggggccgtaggggacggttcggtaccggtttccgttttacctttttttaaagtttaagttaagggtttaacggtttaggggttaaacgttaaccgtaaacgttaaccccgttcccggtaccaaacgggtaccccgttaccgggttacggggaacggggggggtacccccgtaaacgttttaccccgaaaccccgtaacgtttacccccgttacccgaaacgggtaacgtaaaacccgttaaaacgttttaaaccccgaaaaaacgggtaaaaccctaacccggtaacccgttttacggttttttaacccttttaacccggtaaaaaacgtttaaccgggtaaaaaccccggttaaaccggtacccggttaacgggtaaacggggaacccgggttaaccccggttaaagggttaaccgggaaaccccggtaaaccccggggggttaacccggtttaacgggttttaaaccgttttaacccgggtttacgggttaacccgggtacgggtaaacgggggttaacgggttaacccggggttaacccggggggtaaacccccccggttaaaacccggggtttaaaaaccccggtttttaaccccggttaaaccccggggttaaccgtttaacggggttaacccggggttaaccgggtttacccccggggtttaacccggggggggaaaccccccgggttaaacccggggggtaaaacccccccggg

SEQ ID NO: 183731 - DNA, 773 bp, Homo sapiens
  misc_feature: GYAE6OF02I0EUK.13.76.G10.1.454.CMB.1.raw
  modified_base (213)..(213): a, c, t, g, unknown or other
  misc_feature (213)..(213): n is a, c, g, or t
  modified_base (501)..(501): a, c, t, g, unknown or other
  misc_feature (501)..(501): n is a, c, g, or t
tcagtcacgtactacacgaccggtgctcgatttagtcactcatacaggggctgggcctcaggaagcagcatcggaggtgcctcagccatggcatggactccctctcttcctcggcgtccttgcttactgcacaggactccgtcggcctctatgagctgactcacgcccacctcagtcgtccgtcgtccccgaggacacgaccagccagctacnccgtacctgcctacgtaaggtaaaattaagttcgggacaagtaattaaaacgtacttaccgttccgtaggtaactacgaacgtacgaaggtaacgtacgcgtaccgtcgtccccgtgtcgcgtcggtactactacttacgtacaaacgtcgtacgacctaacgggccggtacccgtcgaacgggtacctccggaggtaacgtcggttacgtttcctcggtcggtaccttaacctacggttctacggtacgtaaccaccgtaccgaccttaccgtacgtacgtaaaccngttaaccgaccggggacccgggttaaccgacggtacgttaacgggtacggttaacgtacgggtaccgtacgtaacgtttaaccgtttagtttaacccggtcgtacccggggttaacggggtcccgggttaaggacgaccgggtcaaccgggacggttccgtaccggacccgttacgttaggttacccggtttaacggtccgggtaaacggtacgggaaccccggttacgtaaccccgggttaccgtttacccgtacggtcccggaaaccccg

SEQ ID NO: 183732 - DNA, 614 bp, Homo sapiens
  misc_feature: GYAE6OF02GBH6C.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtgggttcaccgtcagtcacacctacatgagcgtcgggtccgccaggcctccgaggggaagggctgggagtgcgtcttcttttattatagtagtggtagtacatactccgcacgtacgtcgtggacgggcattccaccatctcagacgactaactccaaagacacgtcttgtttactactaaagtcgaactacgcctagacgacgccgtaagtcgaccgaccgggtccgttagtaactttacgtgtggacgtaggagtacggtccggggaccctaacgggtaaccgtttaaccgacggtacgttacggtaccgggtaccggttacgggtacgggggtacccgaacggggtaacccccg

SEQ ID NO: 183733 - DNA, 610 bp, Homo sapiens
  misc_feature: GYAE6OF02IH3ZN.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagccgtggggggtccctgagactctcctgtgcagcctcgtggttccaccgtcagtcacacctacatgagcgtcgggtcccgccaggcctccggaggggaggggcgtggagtgcgtcttcttttatttatagtagttggtagtacatactccgcagactccgtggaggggccattccaccatcctaccagacgaactaacttaccaaagaccaacgtcttgtttcttacaaattcgaaactagcctgagacgccgatacgacgaccggtccgttagttacttacgtgtgacgagacggaggtccggggacccctaacggtaaaccggttaccgtacgtaccgttaggtcgggtaccgttaccggtaccgggggacccgaacggggtaaccccg

SEQ ID NO: 183734 - DNA, 663 bp, Homo sapiens
  misc_feature: GYAE6OF02IYXQH.13.76.G10.1.454.CMB.1.raw
  modified_base (339)..(339): a, c, t, g, unknown or other
  misc_feature (339)..(339): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagtcgtcgggtcccgccgaggcctaccggaggggacgggcgtgggagtcgcgttcttnttttatttatagttagtaggtagtactatactccgacagacctcggtaggacggggtcctagttccacctactcctaccgagacgaactaacttaccgaaagtaaccacgtctttgtttaacctacaaagttgaaccacgtcctagacgacgaccgtagtaccgaacgaccgggtccgttagttaactttaccgtaggtacgacgaaggtacggtacggtccggggtaacccctaacggttaaacccgtttaccgaaccgttacgttaacgggtccggtaacccgggtacggtaccggggggtaacccaagggggtaacccccg

SEQ ID NO: 183735 - DNA, 680 bp, Homo sapiens
  misc_feature: GYAE6OF02G4I47.13.76.G10.1.454.CMB.1.raw
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacacgccagcacgtcacctgctcgtaggaaactaattggcagaactaatactacttctaggtatcgagcagagtcaggcctacgtcccctagtcgcgtggtcacgtctactacgaagtacgtcgtaccaaggacccgtcccgtacggaacggtaccgttacccgtaggtacgaccgttactttccgtcgtacgtacctaccgtaaccgttccggtagggtacccttcgacgtacccgtacgttaccgtacgaacctacgtccgaacgggccgggtaacccgtacgggtactacggtacggtaggtcggtacgggtaccgttacgtaacgttacgtttaccggtcgttaccggtacgggtacggttacgggaccgtacggaccgtacgaccgtaccgtcgacccgttgtacggttcgtaccggttaccgggaacggttccggaaccgtacggtcctaccggttaccgtacgtaccgtaccccggtaaccg

SEQ ID NO: 183736 - DNA, 542 bp, Homo sapiens
  misc_feature: GYAE6OF02GUK7J.13.76.G10.1.454.CMB.1.raw
  modified_base (291)..(291): a, c, t, g, unknown or other
  misc_feature (291)..(291): n is a, c, g, or t
  modified_base (479)..(479): a, c, t, g, unknown or other
  misc_feature (479)..(479): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtcccccaggacagacagccagcatcacctgctctaggaaataattggcagataaatatacttctgtatcagcagatcaggccagtccctgtgctggtcatctatcgaagntcgaccaagccggccctagagggactcccgtgacgtcgtacttcctcgtggcctaccaactcgtacggaccttcgaacgccctactcctacgacctactacgacggccgggaccaggtcctagtggataggagtctagtacttattacgtgtacgagggtcgtagggacagcgagcacgtcgcccgtntagtcggttaccttacggaacgtcgggactaacggtctaaccgtactacggtacacgaacccg

SEQ ID NO: 183737 - DNA, 542 bp, Homo sapiens
  misc_feature: GYAE6OF02FIFED.13.76.G10.1.454.CMB.1.raw
  modified_base (237)..(237): a, c, t, g, unknown or other
  misc_feature (237)..(237): n is a, c, g, or t
  modified_base (291)..(291): a, c, t, g, unknown or other
  misc_feature (291)..(291): n is a, c, g, or t
  modified_base (466)..(466): a, c, t, g, unknown or other
  misc_feature (466)..(466): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctcagtgtcccgtgtcccccaggaccagacagccagcatccacctgctctggaaataatggcagataaatntacttcctggtatcagcagaagtcaggcacgtcccctgtcgctggtcagtctancaagatcgccaagcgccctcgagggactccgtgacgcgtattctcgtgctccactctgggacctcagccactcgtagaccatcgagccggaccaggctacgtggactgacggtctgaacttattaccgtcgtacagggtaccgtgggaacgacgtcgactcgacgtcgacccgtntactcggttcgtacggtaaccgtcgggaacctaacgggtaccaccgttaccgtacggtaccacggccctaacccgg

SEQ ID NO: 183738 - DNA, 713 bp, Homo sapiens
  misc_feature: GYAE6OF02JIVMD.13.76.G10.1.454.CMB.1.raw
  modified_base (286)..(286): a, c, t, g, unknown or other
  misc_feature (286)..(286): n is a, c, g, or t
  modified_base (305)..(305): a, c, t, g, unknown or other
  misc_feature (305)..(305): n is a, c, g, or t
  modified_base (388)..(388): a, c, t, g, unknown or other
  misc_feature (388)..(388): n is a, c, g, or t
tcagtcacgtactacacgaccggtgctcgatttagtcactcatacagggggggagaggagcccagcactgggattccgaggtgtttcccattcggtgatcagcactgaacacagaggactcaccatggagtttggctgagctgggttttccttgttgctattttaaaggtgcccagtgtgaggtgcagctggtggagtcgtggaggaggcttgatccagccgtgggggtccctgagactcctcctgtgcacgcctcgtcgggttccaccgtcagtccacacctacntaggagtcgtcgggtcccnccgacggcctccgaggggaaggggctgggagtcggcgttctttacttttattacgttagtagtggtagtactacgtactccgnatcgtccgtggacggggcctactccacctcgtcctcgagtaacaactaattacccgaaataaccgtacgtcctttacgtttaccttactaaaacgtaacgttaaaccgacgtaccgttaggaaccggtacggaccgtacggtacggtaacccggtaaccggtcgggtttaccgttactttaaccggttcggtcggtaacggagtacggtacgggtacccgggtaacccggtaacccggttaaccggttaacccgtaaccgttcgttaacggtccggggttaccggtaccgggtacgggggtaacccgaaccgggggtaacccccg

SEQ ID NO: 183739 - DNA, 605 bp, Homo sapiens
  misc_feature: GYAE6OF02GISQW.13.76.G10.1.454.CMB.1.raw
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctcgtgggttcaccgtcagtcacacctacatgagctgggtccgccaggcctccgagggaacgggctgggagtgcgtctcttttattatagtagtgtagtacatactcgcagctccgtgacggggccattcgactatctaccagacgaacaacttaccaagtaaacacgtcttagtttaccgttacaaatcgaaacacgaccctagacgaggccgtatacgaccgacggtcccgtagttaacttacgtgtacgngtaacgngaacggtcgggggaccccaaacggtaaccgttaccgtaaccggaccttagtacggggtaccgtacggtacgggggacccgaaggggtaaccccg

SEQ ID NO: 183740 - DNA, 642 bp, Homo sapiens
  misc_feature: GYAE6OF02IEY9Z.13.76.G10.1.454.CMB.1.raw
  modified_base (102)..(102): a, c, t, g, unknown or other
  misc_feature (102)..(102): n is a, c, g, or t
  modified_base (130)..(130): a, c, t, g, unknown or other
  misc_feature (130)..(130): n is a, c, g, or t
  modified_base (168)..(168): a, c, t, g, unknown or other
  misc_feature (168)..(168): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (308)..(308): a, c, t, g, unknown or other
  misc_feature (308)..(308): n is a, c, g, or t
tcagtcacgtactacacgaccggtgctcgatttagtcactcatacagggctgggcctcaggaagcagcatcggaggtgcctcagccatggcatggatccctntcttcctcgcgtccttgcttactgcacnggatccgtggcctcctatgagctgactcagccaccctnacgtgtcccgtcgtccccaggacagacagccaggcatccacctgctctaggaaataagttggcaagataaatatacgtcctgtatcagcagagtcagccagtcccngtgctcgtnatctatcagatcgcagccgccgagnggctaccgtggacgcgtacttctcgtcgtctaccgtaactcgttacgggaacctcgtacgccctacgtctacgaccctactcgaaccggccggtaaccgacggtactacgtacgggtactacggtacggtacgtaacggttacttacgtttaaccgtcgttaacggtacgggtaccggtttacgggaccgtaacggtcggtaaccgaccgtaccgtccggtacccgtacgttacggtccgttaccggttaacggtaaccggtaccggtaaacccggtacggttaacccggtaccgttaaccggtaacggtttacccggaacccggtaaccccgg

SEQ ID NO: 183741 - DNA, 658 bp, Homo sapiens
  misc_feature: GYAE6OF02H7G68.13.76.G10.1.454.CMB.1.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (387)..(387): a, c, t, g, unknown or other
  misc_feature (387)..(387): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctgggaggnggnttgatccagccgtcggggggtcctgagactctcctgtgcagcctcgtgggttcaccggtcacgtccactacctacatgagtcgtcgggtcccgccgtaggcctacggaggggaggggtcgtgggacggtcgcgttctttacttttattagtagttaggtggtaagtacacttacnccggacagccgtccggtggacggggtcctactccgacctatcctactaggacgtaactaacttaccgaaagaaccgtacgtcttacggtttacttaacgtaaagtacgaaccgtgaccggtagacggacgtacccggtatacggccgaacggtccgttagtattacgtcggtcgtacggagtagggtacggtccggggtaaccctaacgggttaactaccgtacggtacgtacggttaccgggccggttacgggtacggggtaaccccggg

SEQ ID NO: 183742 - DNA, 693 bp, Homo sapiens
  misc_feature: GYAE6OF02FFP1D.13.76.G10.1.454.CMB.1.raw
  modified_base (242)..(242): a, c, t, g, unknown or other
  misc_feature (242)..(242): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtcgtccgtgtcccccaggacagacagccagcactcacctgcctcgtaggaaattaagttggcagataaatnttactcctggtatccagctaagaagtcacggccacgtacccctggtacgcttcggtaccattcctagtacaaggtctcgaccaacgccgggacccccttagaacggggtacttccccgtaggacgtcggtactttccgtcgtacgggtccctacccgtaaacgttcgtacgggtaaccttcgaacgccctaacgtccgtacgtacccagttccgacgtcccgggaaccctagggtaccttaggttacggagtacggtagggccttagtaaccgttaacgtttacgtacggtaccggagggtaccggttacgggaaccgttacgacgtaacgggccctaaccggttcccggccccgtagtaccgttcggttaccgttaccgggaaccgttccgggtaaccgtacgggttacccgaacccgtttacccgaacggttacccgacgaacccccgg

SEQ ID NO: 183743 - DNA, 673 bp, Homo sapiens
  misc_feature: GYAE6OF02H5EIB.13.76.G10.1.454.CMB.1.raw
  modified_base (509)..(509): a, c, t, g, unknown or other
  misc_feature (509)..(509): n is a, c, g, or t
  modified_base (519)..(519): a, c, t, g, unknown or other
  misc_feature (519)..(519): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcttgggtttttccttgttgcttaattttaaaaggtgccagtgtgaggtgcagcgtggtggagttcgtgggaggaggtcttggatccaggtccgttggggggtccctgacgtactcttccgtgtcgcagtccttcgttcgggttccaccgtcacgtcactacctacagtgagtcgtcggccgaccgaggcctacggaggggtaacgggcgtagggagtcggtcgtttcgtttactttttaagtttagtaggttagttaggttacgtactacgttacgtccgactaacgtaccgtcggtaggaccggggtctacgttccacctactccgtacaggaactactaacttcaaagaactcgtacttgtttacctaanaatacgaacngtacctgacgacgcgatcggacgtccgtcgtattacgttagcgtagcgaggtacgtacggacggggtaacccaaggttaaccgttaccgtacgtacgttacggttaccgggtaccggtttcgggacgggtaaccccgggtagggtaacccccgg

SEQ ID NO: 183744 - DNA, 649 bp, Homo sapiens
  misc_feature: GYAE6OF02GHYPJ.13.76.G10.1.454.CMB.1.raw
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
  modified_base (440)..(440): a, c, t, g, unknown or other
  misc_feature (440)..(440): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggtcaccgtcagtcacacctacatgagctcgggtccnccgaggcctccgagggaaggggctgggagtgcgtcttnttttattatagtagtgtagtacatactccgnagactcgtgacgggcattcacctatctacagacgacattccaaagaacctcgcttggtttacctacaaatgaaccngtacctaggacgtacggccgtagtacggacccgtacggggtcccgttagttaacttacgttggtacgggacgtacggaagggtaccgggttaccgggggcccctaaacgggttaaacccgtttaccgaaccggttacgttaacgggttccggggtaaccggttaccgggttaccgggggggaaccccgtaaacgggggtaacccccggg

SEQ ID NO: 183745 - DNA, 807 bp, Homo sapiens
  misc_feature: GYAE6OF02H5KN4.13.76.G10.1.454.CMB.1.raw
  modified_base (246)..(246): a, c, t, g, unknown or other
  misc_feature (246)..(246): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttgggctgagctggattttcctcgctgctaattttaaaaggtgtccagtgtgaggtgcaagtggtggagtcgtgggggggcttggtaagccgtgggggtccctcagactctcctgngacaacctcgtaggattctattttcactcgacgtccgtggttgagcgtgggtccgtccgaggccgtcccggggaagggccgtagggtaggttggggttcggaccggttaagttaaaaggtacggaaacgtaccgaagttcggggtacgtaaccgaacgaacgtacctaacgtaggttaccgtttaccccggtaaggaaacggtcaaacggtactttacgaacttaagtccttaacgaaagtacgtaacgtagtaaaccttaaacgaaaaaagttaaacgtaggtaaatttaactaaacgttccgtaacggtaaacctaaaagtaaccgtaaaacctaaaccggttaaacgaaaacgggtcgaaacgggtaaccgaaccgtaacgggggtaccttagggttaaacgtttaccgttaacggttaaccctaaacggaacggtaggtacccgggtccgaaacgttacgtaacggaaaccgttaaaacggccgggtaaccgtccgggaacgttaaccggttaccggaaaccggttaccggggtaccgggggtaacccggtaaccgg

SEQ ID NO: 183746 - DNA, 602 bp, Homo sapiens
  misc_feature: GYAE6OF02F00UU.13.76.G10.1.454.CMB.1.raw
  modified_base (300)..(300): a, c, t, g, unknown or other
  misc_feature (300)..(300): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctggagactctcctgtgcagcctctgggttccaccgtcagtccacacctacatgagcttcgggtcccnccagggcctccggaggggaaggggctggagtgcgtcttcttttaattatagtagtggtatacattaccgtcgtcagacctcggtggacgggggcctagttccaacctatcccgtcaagacgaactaaacttaccaaacggaaccacgtcttcgtttacctacaaaatgaaactagccttagagaccgaccgaatacggacgcggtccgtagttatactgcgtacgagagcgtacgggaaccctaacggtaacgtaacctacgacgtagtcggaccgttcggacgggaccgaagggtaccccg

SEQ ID NO: 183747 - DNA, 580 bp, Homo sapiens
  misc_feature: GYAE6OF02GVZAE.13.76.G10.1.454.CMB.1.raw
  modified_base (297)..(297): a, c, t, g, unknown or other
  misc_feature (297)..(297): n is a, c, g, or t
  modified_base (376)..(376): a, c, t, g, unknown or other
  misc_feature (376)..(376): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgtccagtgtgaggtgcagctggtagagtctgggggaggtgtggtacggccgtggggggtccctcagactctcctgtgccaacctctggattcagatttgatgagtatggcatacacgtcgggtccnccaaccctccgaggggaacggggctgccgaggtcgggtctcgtggtaataaacgtggaattggcgccagcactaacttntgacagtactctgtaggacggccgtattcaccatcctaccagtagacagtcgccgaagaaccttccgactatctagacaaatcgaactgtctcggagcgaggacacggtccttgttactttcaggtcgacgtaggttagcgtaggtcggtcgttacgggttaacttcgaacctaggtcggtaccggtcggtacggggaacccgg

SEQ ID NO: 183748 - DNA, 829 bp, Homo sapiens
  misc_feature: GYAE6OF02IOVUF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgtgcttatttaaaaggtgcccagtgtgaggtgcagctggtggagtctggaggaggcgttgatccagccgtcggggggtccctgacgactctcctgtcgcacgcctcgtggggttccaccgtcacgtcaccacctacagtgagtcgtacgggtcccgccacgggtcctccggaagggggtaacgggggctggggacggtggtaccggtttcctttactttttaattttaagtaaggtaaggttgggtaagttaaccaacttaacccgtcccgacgaacgtacccgttccgggttaagggacgggggtaccctaactttacccaaccgtaaccttcccggtaacccaaaggaaccggtaaaaccctaaaaacgttaacccccgaaaaacggtaaacccgtaaccggtacccgttttacgttttacccgtttaaaacgaaaagtttaaccggaaaaacgttaccggtaccccttaaggggacggtaaccgaacccgggtaaattcggaaccccgtaacggggtcccgttagtttaacctttacggtcggtaacggcggtaagaacgggtacggtacccgggggaaccccttaaacggaacccggttttaccaaccgggttctaacggttacgggaaccccgggttcggtaaccgggggacccgtaacggggaacccccgg

SEQ ID NO: 183749 - DNA, 556 bp, Homo sapiens
  misc_feature: GYAE6OF02G1AAR.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccnccaggctccgagggaagggctggagtgcgtctcttttatttatagtagtggtagtacatactccgcagactcgtgaggggccattcaccatcctccagacgacaattccaaagaaccacgtcttgtttactacaaatcgaacagccctagagacgccgatcgacgacggccgtgtacttactgtgcgagagagtcggggacccacggtaaccgttctaccgtcgtagtcgggaccgtcggtacggggacccaagggtaccccg

SEQ ID NO: 183750 - DNA, 779 bp, Homo sapiens
  misc_feature: GYAE6OF02HN1OQ.13.76.G10.1.454.CMB.1.raw
  modified_base (169)..(169): a, c, t, g, unknown or other
  misc_feature (169)..(169): n is a, c, g, or t
  modified_base (308)..(308): a, c, t, g, unknown or other
  misc_feature (308)..(308): n is a, c, g, or t
  modified_base (314)..(314): a, c, t, g, unknown or other
  misc_feature (314)..(314): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctcctatgagctgactcagccaccctnagtcgtccgtcgtccccaggacagacagcagcatcacctgcctcgtaggaaaactaagttcggacaagaataaatattaccttctaggtatacgagtacaagacgtcgacgccacgtccctagtcgctggtcactctanacagtntcgacaacggccgcctacgaggaccttcccgaggacgtacgtacttccgtacgtccgacctaaccgtaaccgttccgggtaaccgggtaaccctcggaacccgtaccccttaaccgttaccgttaccgaaacccgttacgtaccgaaccggggacccgggtaccgaaacgggtccgttaacggcgggtaacgttacggggacgtacggttacgttaacgttaacgttaccggttacgggttccgaacgggttcgggtaccggggaacacggtaccggtaaccggtacctaccgggtacccgtacccgttacgtttaaccggttccgggttaaccggttaacccgggtaaacgggttaaccgggtaaaccccggtttaaccgggttaacccccggtttaaccgggttaaaccccgtttaacccggggtaccctaacccccggggtaaccccggtaaaccccccggg

SEQ ID NO: 183751 - DNA, 628 bp, Homo sapiens
  misc_feature: GYAE6OF02I6BU7.13.76.G10.1.454.CMB.1.raw
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (572)..(572): a, c, t, g, unknown or other
  misc_feature (572)..(572): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgacgacctctccgtgtgcagcctcgtcgggttcaccgtcagtccactacctanatgagcgtcgggtccnccgaggcgtccgaggggaacgggcgtggagtgcgttcttcttttatagtacgttagtaggtagtaactataccgtccgactacgtaccgttccggtgggacggggtccgaactttccgaaccgtatccctacaaaggacaaaccgtaattacccgaaaaagtaccgtaacgtccttaggttttaaccttaacgaaagttaggaaaccttagaccgttagacgtacgaccgtagtacacgtacggccgttatacgttcgagtcgacgngtaagcggtcggacccaagttacgtaatcgactagtacggacgtggacggtacccg

SEQ ID NO: 183752 - DNA, 603 bp, Homo sapiens
  misc_feature: GYAE6OF02FHBWW.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtcccctggagactctcctgtgcagcctctgggttccaccgtcagtccacacctacatggagctcggggtcccgccaggctccgagggaacggggctgggagtgcgttcgttctttttatttagtagttagtggtatacatactccgcacgctccgtggacggggcctattccaccactctccgagacgactaacttccaagaaccacgcttacgtttctacaaatacgaacacgtcctagacgagaccgtatcgacgaccggtccgtgttacttacgtgtcgccgaggacggtacggtcggggaccctaacggtaaccgtttaccgtaccgtacgttacgtacgggtaccggttacggtcggggtaaccccgg

SEQ ID NO: 183753 - DNA, 552 bp, Homo sapiens
  misc_feature: GYAE6OF02FIWQ4.13.76.G10.1.454.CMB.1.raw
  modified_base (295)..(295): a, c, t, g, unknown or other
  misc_feature (295)..(295): n is a, c, g, or t
  modified_base (427)..(427): a, c, t, g, unknown or other
  misc_feature (427)..(427): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatccagcctggggggtccctgagactctcctgtgcagcctctggggttcaccgtcagtcacacctacatgagctgggtccnccaggctccgagggaagggctggagtgcgtctcttttatttatagtagtggtagtacatactccgcagctcgtgaggggccattcaccatctccagagacaattcaagaacacgctgttctcaaattgaacngcctgacgagccgatcgaacaccgggcgtagtaattactcgtgcgagagagtggggccccaacggtaaccgttactaccgacttaacgtcgggacgttccggtcgggggaccctaaggggacccg

SEQ ID NO: 183754 - DNA, 603 bp, Homo sapiens
  misc_feature: GYAE6OF02FI2D3.13.76.G10.1.454.CMB.1.raw
  modified_base (256)..(256): a, c, t, g, unknown or other
  misc_feature (256)..(256): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcnggattccacctttgatgatttatgccatgcacgtcggggtcccggacaagcctccgaaggggaacgggcctgggaggtgggtctcgaggttattaggtggaataggtggtagcataggctatgcgtactctgtaggaacgggccgtatcaccatccaccagacgacaacgaccaacgaacctcccgtagtactcgtacgacctaaatcgaaacgcgtacctaggagacgcgtaggaaggaccgacggtcctttagttattgttagtagaactaaacggtaccttaccccgtaaaccccgttagttacgtttttacgggaggtttacggttacgtaccggtaacgggg

SEQ ID NO: 183755 - DNA, 841 bp, Homo sapiens
  misc_feature: GYAE6OF02JGRZC.13.76.G10.1.454.CMB.1.raw
  modified_base (170)..(170): a, c, t, g, unknown or other
  misc_feature (170)..(170): n is a, c, g, or t
tcagtcacgtactacacgaccggtgctcgatttagtcactcatacaggggctgggcctcaggaaacagcatcggaggtgcctcagccatggcatggatccctctcttcctcggcgtccttgcttactgcacaggatccgtggcctcctatgagctgactcagccaccctnagtgtccgtgtccccaggacagacagccagcatcacctgctactaggaaattaatggacagaataatatacttctgtatcagcagagtcagccacgtcccctgtcgcttaggtcactctatacaagtatcgaccgaaggcccggccctacggacggggtaccttccccgtaggacggtaccgtaacgtttcctaccggttccggtacccgttaccctaaaccgttaccggtaaccgggggtaaacccttacccgtaaccgggtacccttaacccgttacccgtaccggtaaaccccgtacgttaccccggaaccggggtaacccccggggtaaaccccgtaccgggtaccgtttaaccggtacgggtaacggttacgggaacgggttccgttaaaccggttaaaccgtttaaacgttttaaccggttacgggtttaaccgggaacgggggttaccgggtaacggggtaaccgaaccgggtacccgtaacggtacccgtaacccggtacccgggtaccccgttagtttaaccggttccggtttaaccccgggttaaccggggtaaaccggtttaaccggggaaaccccggtttaaccgggttaccccgttaacccggttaacccggttaaacccggttaacccggacccggtaacccccggaaacccccggg

SEQ ID NO: 183756 - DNA, 561 bp, Homo sapiens
  misc_feature: GYAE6OF02GERZM.13.76.G10.1.454.CMB.1.raw
  modified_base (171)..(171): a, c, t, g, unknown or other
  misc_feature (171)..(171): n is a, c, g, or t
  modified_base (421)..(421): a, c, t, g, unknown or other
  misc_feature (421)..(421): n is a, c, g, or t
  modified_base (463)..(463): a, c, t, g, unknown or other
  misc_feature (463)..(463): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtgtccgtgtccccaggacagacagccagcatcactgctcaggaaataagtggcagataatactactctgtatcagcagagtcaggccacgtccctgtcgctggtcagtctatacaagatcgaccaacggccggtacccctacgacgggtactcccgtagacgtcgtacttctcgtcgcctactaacctcgtacgggactcgacgcctactcgtacaccatcgacggaccggaccgaggactagtgacnggacgtctagtacttatacgtggacgagggtcgtaggaccgngacacgcgaccgtcgacctagttacgtcgttaccgttacggacgtaccggaaccgtacgtaccgtacccgtacgtaaccggtaccaccggtaaccccg

SEQ ID NO: 183757 - DNA, 700 bp, Homo sapiens
  misc_feature: GYAE6OF02GU1CE.13.76.G10.1.454.CMB.1.raw
  modified_base (238)..(238): a, c, t, g, unknown or other
  misc_feature (238)..(238): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataagtggacagataaatntacttcctgtatcagcagaagtcaggccacgtcccgtgtcgctggtcatctatacgaagacgtcgaccgaagcccggaccctacgacgggtacctcccgtaggacgtccgtactttccgtcgtacgggacctaaccctaacgttccggtacgggtaaacctcaaccggtccctaaccgttccgtaccgtaaccctaacgttaccggaaccgggtacccggggtaaccccgacgggtacccttaagggtacgggaacgttcgggaacggtaccgttacgtaacctttaagtttaccggtacggttaccgggtacggggtaccgggtagggaaccgtacggaaccgacgtaccgaacgtcccggtacccgtcttaacgggttcgttaaccggttaccgggaacgtaccgggtaaccgtaacggtcccgtacccgttaacgaaccggtacgaacccgaaccccgg

SEQ ID NO: 183758 - DNA, 730 bp, Homo sapiens
  misc_feature: GYAE6OF02G46Q9.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctatttaaaggtgcccagtgtgaggtgcagctggtggagtcgtggaggaggcttgatccagccgtgggggtccctgacgactctcctgtgcagcctcgtgggttcaccgtcacgtccacacctacagtgacgtcgtcgggtcccgccgagggcctacccggaagggggaacggggtccgtgggacggtggtccggttctttcgtttttaagtttaagttaggttaggttaggttaacgtaacctattaccgtcccgactacggtaccgttccggtaggaccgggggtccctagttcccgaaccctcgttaccctaccgtaaggaacgtaaaccctaactttaacccgaaacggtaacctaccggtaccttttggttttaccttaacgaaaagttcgaaaccgtcgtacccgtaggaacggaccgtaccggaagtacggaaccgtaccgggtcccgttaagttacttacgtggtacgacggtaaggtacggtacggtaccggggaccctaacggttaaccgttacgtaaccgtcgttaaggtcgggtaccggttcgggtaccgggtaaccgg

SEQ ID NO: 183759 - DNA, 756 bp, Homo sapiens
  misc_feature: GYAE6OF02GE9L8.13.76.G10.1.454.CMB.1.raw
  modified_base (305)..(305): a, c, t, g, unknown or other
  misc_feature (305)..(305): n is a, c, g, or t
  modified_base (406)..(406): a, c, t, g, unknown or other
  misc_feature (406)..(406): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggttgagcttgggtttttccttgttgcttaattttaaaaggtgcccagtgtgaggtgcagctggtggagtctgggaggaggcttgactccagccgtgggggtcctgagactctcctgtgcagcctcgtcgggttcaccgtcgagtccaccacctacatgagcgtcgggtccnccgacggcctaccggaggggaacggggcgtaggacgtcggcgtttcttacttttatttaacttaggttaggttaggtacgttaactaagttacctccgtanacgtaccgttccggtagggtacgggggacctaagtttacccgaaccctacttccctaaccgtaagaacggtaaacctaacgtttaccccgaacgaaaccgtccgtctttaacgttttcctaaacctaaagtacggaaactagtaccgtaggtacgacgccgtaagtcggaaccgacccgggtcgttaggttaacttacgttcgtaggacgtaaggtacggtacggtacccgggggaaccctaaccggttaaaccggttaccgtaaccggttacgttaacgggttacgggtaccgggttttaccgggccggggggtaaccccgtaacggggggtaccccttaaccccgggg

SEQ ID NO: 183760 - DNA, 644 bp, Homo sapiens
  misc_feature: GYAE6OF02H70OY.13.76.G10.1.454.CMB.1.raw
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtcgtggaggaggcttgatccagccgtggggggtccctgagactctccgtgtgcagcctcgttgggttcaccgtcagtcacacctacatgacgctgggtccgccaggctaccggaggggaagggctgggagtgcgttacttcttttatttaagtaggtagtggtatacagttacnccganagactcgtaggaggggccagttccactatcctacagacgactaaacgttccaaacggaacacgtcttagttttacgttaacaaagttcaaacgacgccgtagacgacgccgtaagtaacggaccgtaccgggtacccgttagtttaacgttacgtggtacgacggaaggacgtacggttaccgggggcccctaaaacgggttaccgttaacttaccgcgttaagtcgggtaccggttccggtaagggggaccctaacggggaacccgg

SEQ ID NO: 183761 - DNA, 571 bp, Homo sapiens
  misc_feature: GYAE6OF02F95TY.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccgaggctccgaggggaaggggctgggagtgcgtcttcttttattatagtagtggtagtacatactccgcagactccggtggacggggcctatttacccattcctccagagacaattaccaaagaacacgcttgtttcttacaaatgaacagcctgagagaccgagtcgacgaccggccgttgtaatttactgtggacgaggagacgtcggggacccaacggtaaccgttactaccgtcttagtcggacgtcgcggggaccgagggaccctaccgg

SEQ ID NO: 183762 - DNA, 728 bp, Homo sapiens
  misc_feature: GYAE6OF02JIOUG.13.76.G10.1.454.CMB.1.raw
  modified_base (278)..(278): a, c, t, g, unknown or other
  misc_feature (278)..(278): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacaggatccgtggcctcctatgagctgactcagccaccctcagtgtcccgtgtcccccaggacagacacgccagccactccacctggcctcgtaaggaaaattaaacgttggacaagaattaaatagttaccttccgtaggtacttcgancgaagaacgtcgaggaccctacggttcccctgtcgtcgttcggtctacttcctaatacgtaaagacgttacggacccgtaaaggccccggtaccccgtaaccggtacgggtacccttacccggtagaaccggtgttactttacccgtcgtacggccttaccgtaaccgtccgttacgggaaccctagacccgtaccgtacttaccgtaccgtaaccgtaccgtacgaccgggtaccgggaccccgtacggtaccgtacgttacggacgttacgggacgtaccgtacgttaacttacgttacgtcggttacggacgggtcgggtacgggtacgaccggtagacgccgtaccgacgtcccgttagtcgttaccgttccgttacgggtaaccggttaccggtacgtaaccggtaccgtacccgttaacgtaccggtacgacccggaaccccgg

SEQ ID NO: 183763 - DNA, 661 bp, Homo sapiens
  misc_feature: GYAE6OF02JYXK9.13.76.G10.1.454.CMB.1.raw
  modified_base (131)..(131): a, c, t, g, unknown or other
  misc_feature (131)..(131): n is a, c, g, or t
  modified_base (171)..(171): a, c, t, g, unknown or other
  misc_feature (171)..(171): n is a, c, g, or t
  modified_base (297)..(297): a, c, t, g, unknown or other
  misc_feature (297)..(297): n is a, c, g, or t
tcagtcacgtactacacgaccggtgctcgatttagtcactcatacagggctgggcctcaggaagcagcatcggaggtgcctcagccatggcatggatccctctcttcctcggcgtccttgcttactgcacnggatccgtggcctctatgagctgactcagccacctcagtntccgtcgtccccaggacagacagccagcatcaccttgctctagaaataattggcagataaatactacttcctagtatacagcaagaacgtcacggctacgtccctgtcgcgtggtacatctacgtnaagtactacgaccgaacgccggacctacggacggtacgtccctaggaccgtacgtacttcctcggtcgtactacctacgtacgtacggtacctcgaactccgtaacctcgtaccggtaacctacgaccgtacgggaacccggaccggttaacggtccgtaacgtaggtacgacggtacgggtacgtaacgtaccgtttaacgttacggttcggaacccggtagggacgttaccggggaacaacgtaccgacggtaccgaaccgttccggtacctccgttaagtccggtttaacgtaccggtaaccggtacggtaccggactttacccggtaccggttaacccgtagttaccgacccgtaacccg

SEQ ID NO: 183764 - DNA, 694 bp, Homo sapiens
  misc_feature: GYAE6OF02JTCY8.13.76.G10.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (310)..(310): a, c, t, g, unknown or other
  misc_feature (310)..(310): n is a, c, g, or t
  modified_base (383)..(383): a, c, t, g, unknown or other
  misc_feature (383)..(383): n is a, c, g, or t
  modified_base (426)..(426): a, c, t, g, unknown or other
  misc_feature (426)..(426): n is a, c, g, or t
  modified_base (589)..(589): a, c, t, g, unknown or other
  misc_feature (589)..(589): n is a, c, g, or t
tcagtcacgtactacacgaccggtgctcgatttagtcactcatacagggggggaggagggagcccagcactgggattccgaggtgtttccattcggtgatcagcactgaacacagaggactcaccatggagttttggctgagcgtgggtttccttgttgcttattttaaaggtagccagtgtgaggtgcagctggtggagtctggaggaggcttgatccagccgtggggggtccctgagactctcctgtgacngcctcgtcgggttacnccgtcngtaccncacctacatgaagtctggggccctaccgnggccttccgaggggtacgggctgggagtcggcgttacttactttttagttataggtaacggtgggtactacgnttaacctccggataacgcctccggttggaccgggggtaccctnttaccaaccgtctaccgttccaagggtacctaacgaacctttccgaaaacgtaacccagggttaccttacggtttcttaacccaaaggtccttaaaacgccggtacgtagacgacggtccgaacttcggacgtaacccgtcggtctttaaagttcccgtaggngtacgggaactaggaacggttccggggcctaaacccgtacgggttacctaaccgtgttaacgtcgggtaacgtttcccggaggggttaccgaaacggggtacccc

SEQ ID NO: 183765 - DNA, 503 bp, Homo sapiens
  misc_feature: GYAE6OF02F3QZP.13.76.G10.1.454.CMB.1.raw
  modified_base (428)..(428): a, c, t, g, unknown or other
  misc_feature (428)..(428): n is a, c, g, or t
  modified_base (436)..(436): a, c, t, g, unknown or other
  misc_feature (436)..(436): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaaatatacttcctggtatcagcagaagtcaggccagtcccctgtgctggtcatctatcaaagatgccaagcggccctcagggactccctgagcgattctactggctccaactctagggaactcagccacgtctgaccatcagcggacccagctatggatgagctgactatactgtcaggcgtgggacagcagcacncgacccgntagtcgtaccgttccggaacgtacgggaccaagggttccaccgttccgtaacgtcacgtaaccccgg

SEQ ID NO: 183766 - DNA, 585 bp, Homo sapiens
  misc_feature: GYAE6OF02IZTAE.13.76.G10.1.454.CMB.1.raw
  modified_base (335)..(335): a, c, t, g, unknown or other
  misc_feature (335)..(335): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttacctaccccagctggtaccaacacgacccacgcaggctccgcgcacgctcatctacaacacaacactcgctcttctcggggtcctcatcncttctctgctcatcgttaggaacaagctcgtcctatcatcgacgggccaggcagagatgatctagtattattactgtttacgttacttttagtagttagggttacgtgtaccttagttttcctgtacgttggttacggtttacgggtagggtacggtaccggacccggtcggttaccggtacccggttcccgttccgggttaccgaccggtacccgaaccgggtcctccggtacccctaggttaccccgg

SEQ ID NO: 183767 - DNA, 669 bp, Homo sapiens
  misc_feature: GYAE6OF02G5JVT.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtgggttccaccgtcagtccacacctacatgagcgtcgggtcccgccgacggcctaccggaggggaacggggccgtggaggtcgtcgttcttacttttattagtaggtaggttggtactacatacctcgacagtacctcggaggacggggccgtactcgaccactctccagacgaactaactaccgaaagaacctcgtctttacgtttcctaactaaatcgaaacctcgtccgtagaacgacgaccgaagtaccggaaccgtaccgggtccgttaagttactttacggtagacggtacgaaggacggtccgggtacccggggtaccctaaaccggttaacgttaacccgtaacggtaccgtttaaggccgggtaccggttcgggtacccgggggacccgtaacggggtaacccccg

SEQ ID NO: 183768 - DNA, 734 bp, Homo sapiens
  misc_feature: GYAE6OF02I5OA8.13.76.G10.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (656)..(656): a, c, t, g, unknown or other
  misc_feature (656)..(656): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgcttatttaaaggtgcccagtgtgaggtgcagctggtggagtctggaggaggcttgatccgaggccgtcggggggtccctggacgacctcgtccgtgtgctacgcctcgttcgggttccaccggtcacgtcacgacctacngtcgagtcgtcgggtccgcgtacggcgtccgagggtaacgggcgtgggngtcgtcgttcgttacgttttagttagttacggttaggttaggttaacgtacgtagtaccgttaccggcgtaaacgtccgttcggtacggaaccggggtccgttaacgttacccgaacccgtacgtttaccccgtacccgaaggaaacgtaaaccttaaacgttcccgaaaaagaaccgttaccgtcgtttacggttttaccaacggtaaattacggaaacccgttgaccgtcgggaaacgtacgacccgggtattaaccgggaccgtaccgggtcgtttacgtaacgttacgtccgtggaaccggtanaacgggttcggaccggggtaccccaacgttaaccggttactaccggatttacgaggggtaccctcgggtacgggaccg

SEQ ID NO: 183769 - DNA, 675 bp, Homo sapiens
  misc_feature: GYAE6OF02H1C70.13.76.G10.1.454.CMB.1.raw
  modified_base (213)..(213): a, c, t, g, unknown or other
  misc_feature (213)..(213): n is a, c, g, or t
  modified_base (270)..(270): a, c, t, g, unknown or other
  misc_feature (270)..(270): n is a, c, g, or t
  modified_base (297)..(297): a, c, t, g, unknown or other
  misc_feature (297)..(297): n is a, c, g, or t
  modified_base (502)..(502): a, c, t, g, unknown or other
  misc_feature (502)..(502): n is a, c, g, or t
  modified_base (539)..(539): a, c, t, g, unknown or other
  misc_feature (539)..(539): n is a, c, g, or t
tcagtcacgtactacacgaccggtgctcgatttagtcactcatacgagggggggagaggagcccagcactgggattccgaggtgtttccattcggtgatcagcactgaacacagaggactcaccatggagttttggctgagcgtggttttcctgttgctatttaaaaggtgccagtgtgaggtgcagctggtggagtctggaggagggcttgntccgagccgtggggggtccctgagctctccgtgtgcagccttcgtgggttcaccgtnagtcaccactacatgagcgtgggtccncgagctccggaggggaagggctgggagtggcgttctttacttttagttagtaggtagttaggtagtaccgattaccgtacgcgaggtaccgtcggtacggaggggcccgtattccgaacctcgtaccgtaccgaagaacgtaactaaacgtttcaaaaccgaactacggtctttagtttcccgttaactaaaagttcgtaaaacncgacccgttagacggtacgccgtaagtccggaaccgnggggtacccttagttaaccgtttcgttaggacggtacgtaaaggaggtacggtaccggggaacccttaaacggtaaccgttagtacccgagttagtcgggtacgttcccggtaggggacccgaagggtaaccccgg

SEQ ID NO: 183770 - DNA, 732 bp, Homo sapiens
  misc_feature: GYAE6OF02FUTHI.13.76.G10.1.454.CMB.1.raw
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (370)..(370): a, c, t, g, unknown or other
  misc_feature (370)..(370): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgttggggggtccctggacgactcctcctgtgcacgcctcgtgggttccaccgtcagtccacaccctacatgancgtcgggtccncaggctcgaggggagggctggagtgcgtcttcttttattattagtagtgtagtactatacctcgntacgaccgtcggtaggacggggtccctatttccaacctactccgtaccaaggaacgtaacctaaacttacccaaaggtaaacccgacgttaccgtttaggtttttacctaccgtaaaagttacgaacgttaaccggaccttggaaacggttacggcccgtaaacgttacggaacccgggtaccgggtccggtttaagtttacgtttaaccgttgggtaccgacggggtaacggtggtaacgggttacccggggaccccctaaacgggttaacccgtttaaccgtaaccggtaccgtttaacgggtcgggttaacccgggttaccgggtccgggggtaaccccgggaaggggtaaccccccgg

SEQ ID NO: 183771 - DNA, 708 bp, Homo sapiens
  misc_feature: GYAE6OF02HV8WO.13.76.G10.1.454.CMB.1.raw
  modified_base (535)..(535): a, c, t, g, unknown or other
  misc_feature (535)..(535): n is a, c, g, or t
  modified_base (628)..(628): a, c, t, g, unknown or other
  misc_feature (628)..(628): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctaattttaaaaggtgcccagtgtgaggtgcagcgtggtggagtcgtaggagggaggtctgactccgacgtccgggtcgggggtcctaggacgtacctccgttccgttggtcgacgaccgtccttcggttcgggttacctaccgtcgtacgtaccacctaacctaactagtacgacgtccggtcgggtccccgaccggacggtccgtacgggaagggggacgggtcgtagggtagtcggtccgtttactttacttttagttagtaggtaggttaggtataactacgtactccgacgtacgtacgtcggtagggacgggtacgtactaccgactctccgtaccgaaggtaactactaaacttaccgaaagtaaccncgttactttacgtttactaacgtaaacgtacgaacgtgtaccgtaggacgaccggacgacgtacgaccggacgttccgttaagtacttgcggngacgagaggccgggtacggacccgtaaggttaaccgttacgacgtacgttacggtcggtacggttcgggacggtaaccgg

SEQ ID NO: 183772 - DNA, 717 bp, Homo sapiens
  misc_feature: GYAE6OF02HVD5G.13.76.G10.1.454.CMB.1.raw
  modified_base (552)..(552): a, c, t, g, unknown or other
  misc_feature (552)..(552): n is a, c, g, or t
tcagtcacgtactacacgaccggtgctcgatttagtcactcatacagggggggagaggagcccagcactgggattccgaggtgtttccattcggtgatcagcactgaaacacagaggactcaccatggtagttttggctgagtcgttgggtttttcctttggttgctttaatttttaaaaagggtcgaccctaggttgtggtaggtgcagcgtggtggagtcgtgggaggtaggtcttggacttccgaggtccggtcggggggtccctggagtcctctcctggtgcgacgtccgtcgttcgggttcctacccgtcaacgtccaacctacctaacagtagagtccgtccgggtccgccgacggccgtaaccggaggggggtaacgggtcgtagggtcgggttaggggttttaaggtttcgtaaggttacggacgacttaacgttccgttagaagtcggagtacgggaacaacgaagtaaccgtaccggccctaggttacgttaaaggtaaacgacacggttactacccgtactacttacgtaacgaaaggtancgtaaggtccgtaacgaaagtacaacgttccgttccgttactttcgacggtacaggttaactagggaacgtcacgtaaggaccgtaacggactaaacgcgacgtactattacgtaattctagtaccgtagaggtagtactagtacgtctaccggtcttaaaccgg

SEQ ID NO: 183773 - DNA, 710 bp, Homo sapiens
  misc_feature: GYAE6OF02IMATN.13.76.G10.1.454.CMB.1.raw
  modified_base (247)..(247): a, c, t, g, unknown or other
  misc_feature (247)..(247): n is a, c, g, or t
  modified_base (303)..(303): a, c, t, g, unknown or other
  misc_feature (303)..(303): n is a, c, g, or t
  modified_base (335)..(335): a, c, t, g, unknown or other
  misc_feature (335)..(335): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggtttcgtgtgctatttaaagtgccagtgtgaggtgcagctggtggagtctggaggaggcttgatccagccgtcgggggtccctagagactctccgtgtcgacngcctcgttcggtccaccggtcacgtacaacctacctacatggacgcgtcgggtccnccgacggcctaccggaggggaaggggctaggngtcgcgttctttacttttaagtttagtaggttaggttaggtaacgttactaacgtactcccgacgacgtaccgtccggtaggacgggtacccgtattccgtaacctactccgtaccaagaacgtaaccgtaaacgttaacccaaacgtaaaccgtaccgttcgttcgtttaacctagtaaaacgttccgaaacgtagtcccgtaaggacgtacgaccgtaagtcgtaaccgaccgtcgttaagttacgttcgtaggtcgacgacggtagtacccggttcggggaccccttaaacggggtaacccgtttaacgtaacgtacggttataccggggtaggttcccgggacggggtaccccggaacggggttaaccccg

SEQ ID NO: 183774 - DNA, 683 bp, Homo sapiens
  misc_feature: GYAE6OF02H38W8.13.76.G10.1.454.CMB.1.raw
  modified_base (236)..(236): a, c, t, g, unknown or other
  misc_feature (236)..(236): n is a, c, g, or t
  modified_base (387)..(387): a, c, t, g, unknown or other
  misc_feature (387)..(387): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggtttttccttgttgctattttaaaaggtgcccagtgtgaggtgcagctggtggagtctggaggaggcttgatcagccgtgggggtcctgngtactctctgtgcagcctcgtggttcaccgtcagtcacacctacatcgagcgtcgggtcccgccgacggccgtccggaagggggacggggcgtgggaggtcggtccgtcttttacgttttaatttagttagtaggtggttagtacattacnccgcagtaccgtcgtggacggggctacttaccacctactccgaccgtagaacgtacctaaacgttaccaaacgaaaccgtacgtccgtttacgtttttacctaacgtaaaacttacgaaaccgacgtccctaggaacggaccggaccgtaagtacggaccggtaaccgggttcccgttaagttacgttaccgttggtagaccggtaaggacggaacgggtttccgggacccctaaacggtaacccgtttaacgaccggtcttaaggtccggtacggttccggacggggtaacccgg

SEQ ID NO: 183775 - DNA, 737 bp, Homo sapiens
  misc_feature: GYAE6OF02JD4ZM.13.76.G10.1.454.CMB.1.raw
  modified_base (310)..(310): a, c, t, g, unknown or other
  misc_feature (310)..(310): n is a, c, g, or t
  modified_base (416)..(416): a, c, t, g, unknown or other
  misc_feature (416)..(416): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagctggtggagtctggaggaggcttgatccagccggtcgggggtcctgagactcctcctgtcgcacgtcctcgtcgggttccaccggttcagtcaccaacctacatgagtctcggggtcccnccgaggcctcccggaagggggacggggctgggagtcgtcgttctttctttttaattagtaaggttggttaggtagtactataccgtcccgctaacgtacgtccggngggacgggggtcccctacttccaacccgtattcccgtaccgaacgacgaaacctaaacgttaaccccgaaaggtaaccctaccggttactttaccgtttttaccttaaacgtaaacgttcgaaacctacggtcccttaggaacggtacgccgtaataccggaaccgtaccgggtaccgttagttaacgttttacgtggtacgacgaaggtagaccgggttccggggaaccctaaccgggttaacgtttaacccgtaacgtaacccgttaggtaccgggtaccggttcgggaaccggggtacccggaaaccgggtaccccgg

SEQ ID NO: 183776 - DNA, 700 bp, Homo sapiens
  misc_feature: GYAE6OF02HBE11.13.76.G10.1.454.CMB.1.raw
  modified_base (384)..(384): a, c, t, g, unknown or other
  misc_feature (384)..(384): n is a, c, g, or t
  modified_base (392)..(392): a, c, t, g, unknown or other
  misc_feature (392)..(392): n is a, c, g, or t
  modified_base (463)..(463): a, c, t, g, unknown or other
  misc_feature (463)..(463): n is a, c, g, or t
tcagtcacgtactacacgaccggtgctcgatttagtcactcatacagggggggggggctgagcccttctctggaaaccacacagctcctcctgcagcagcccctgactgctgatttgcatcacgggccgctctttccagcaaggggataagagaggcctggaagaacctgcccagcctgggcctcgaggaagcagcagtcgggaggtgcctcgacgccatggcatcggactcccgtcttccttccgtcggcgttcctgtccttactcgacacgaggtactccggtcggtcccgtcctagtcgacgtctcgacgtcgaccgccctacccgtcgacgttccggtccgtccgtaccccgaggaccgacgacgaccgccacgcctacnccgtaccncgtacctacgtaaggtaaaacttaaagtggactaagtaaactaaacgttacgtacgttacgtacggttacncgtaagaccgtaaggtaacgtaccggaccggtacccgtaccgttacccgtagttccggtccttaggttctattccgttaataccgaaacggttcgacgacccggtaacgtcccggtaaccgacgggtaacggtcccgttacgggacgaccggtccggttactttaccggtccgtcgggttacccctaccggtaaccgttcgggttaaccgggaaccctcggtaccggtcctaacccg

SEQ ID NO: 183777 - DNA, 661 bp, Homo sapiens
  misc_feature: GYAE6OF02H7R9O.13.76.G10.1.454.CMB.1.raw
  modified_base (296)..(296): a, c, t, g, unknown or other
  misc_feature (296)..(296): n is a, c, g, or t
  modified_base (314)..(314): a, c, t, g, unknown or other
  misc_feature (314)..(314): n is a, c, g, or t
  modified_base (583)..(583): a, c, t, g, unknown or other
  misc_feature (583)..(583): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttaattttaaaaggtcgccctagtgtgaggtgcagcgtggtggagtcgtgggaggaggcttgatccagccgtggggggtccctgagactctcctgtgccagtcctcgtgggttccaccgtcagtccaacacctacntgacgtcgtgggtacccncaggcctaccgaggggaaggctggagtgcgttcttactttttagttagtaggttaggtaggttaacgtactaataccgtccgactaacggtacccgttcccggagggacgggggtacctacttaccgacctactccttaccgaagaacgaataacgttaacccgaaagaacccgtattcgttacgttttacctaataaaacgtaggaaacctactaccgtaggtagcgtaacccgtatacgaccgtaccggtccgttatacgtttacgnggtcaggagaggtacgtcgggaccctaacggtacgttaactacgcgtacgtcggtacttcggacggacgaggtacccg

SEQ ID NO: 183778 - DNA, 682 bp, Homo sapiens
  misc_feature: GYAE6OF02HSJSM.13.76.G10.1.454.CMB.1.raw
  modified_base (270)..(270): a, c, t, g, unknown or other
  misc_feature (270)..(270): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgacgactctcctgtgcagcctcgtggttccaccgtcngtcaccacctacatgagcgtcggggtccgccaggccgtccgaaggggacggggctagggacgtcgcgttcttacttttttaacgtttagtacggttaggttgggtaagttaactacttaccgtccgacacgtacctccggtggacgggggtaccctattccacctatcctaccgagtacgaacctaaattacccaaaggaacctacggtcttacggttttcctaacaaacttcgaaacacgtaccgagacgtacgccgtaatcggaccgacggggttcccttagttaaacttcggtagtcgaacggtagacggtacggtcccggggaaccctaaccgggtaaactttaccgaaccggtagtttaacgtacgggcccgttacgggtacgggtacccggaaggggtaacccccg

SEQ ID NO: 183779 - DNA, 688 bp, Homo sapiens
  misc_feature: GYAE6OF02G1OVV.13.76.G10.1.454.CMB.1.raw
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctggacgacctcccctgtcgcacgcctcgtggggttcaccgtcacgtcacacctacatgagcgtggtccgccgaggcctccgagggaacggggctgggagtgcgtcttcttttatttattaggtagtggttaagtacataccgtccgacagaccgtccggtggacgggggtacctagttcccacctatcctaccgaagaacgaactaaacttacccgaaaagaaccgaccgtactttacgttttaccttactaaaagtcgtaaacagtccctaggagacggtaccgatacggaccaccgggtaccgttagttaacgttacgtggttacgacgggtacgtaaggacgggttacccggggacccctaacgggttaaaccgtttaacccgtaccggtacgttaacggtacgggttaaccccggtcgggtaccggggtaacccggtaaacccgggg

SEQ ID NO: 183780 - DNA, 871 bp, Homo sapiens
  misc_feature: GYAE6OF02FYIMJ.13.76.G10.1.454.CMB.1.raw
tcagtcacgtactacacgaccggtgctcgatttagtcactcatacaggggtcgtgggagaggagcccagcactgggattccgaggtgtttccattcggtgatcagcactgaacacagaggactcaccatggtagttttggctgagcgttgggttttccttgttgcttaagttttaaaaggtgcccagtgtggaggtgcgagcgttggtggagtcgtgggaggaggcttgatccgagccggttcgggggtccctggacgacctctccgtgtcgcgacgtccttcggttcggtaccaccgtctacgtacctaaccacctaacgagtgacgtccggtcgggtccccgaccgacgggaccgttcccgggaaggggtaacgggggtccgtaggggtacgttcggtaccgttttcgttttacgttttttaacgtttagtacggttaaggttacggttaaacgttaaccgtactttaaccgtacccgtacgtaaccggttaccgtaccgggtacggggtaccggggtacccgttaacttaccccgaacccgttagtaccctaacgaaacgggtaactaaaccgttaaaccttaacccgaaacgtaaaccctaccgggtttacctttaccgggttttaaccttaaaccgtaaaggttaaccgaaaccgtacggtaccgtaggaacgtaccggaacccgtaagtaaccgtaacccggaccggttaccgggttattaacggtttacgtagggtaggtaccggtaggaaaccgggtcgggtaaccccggggtaccccgtaaaaccggtttaacgttttacccggaaccgttccggttaaggacccggtttaccgggttccggggaaaccgggtaaccccggg

SEQ ID NO: 183781 - DNA, 652 bp, Homo sapiens
  misc_feature: GYAE6OF02G2LBP.13.76.G10.1.454.CMB.1.raw
  modified_base (377)..(377): a, c, t, g, unknown or other
  misc_feature (377)..(377): n is a, c, g, or t
  modified_base (462)..(462): a, c, t, g, unknown or other
  misc_feature (462)..(462): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctcgtgggttcaccgtcagtcacacctacatgagctgggtcccgccgaggcctaccgagggaacggggcctagggagtgacgtcttctttttattatagtagtggtatacatacctcgcagactcggnggacggggcctagttccacctactcctcaagacgactaattaccaaagaaccgacgtcttagtttaccttacaaattgaaccacncccgtagacgacgaccgagtaccgaacgacgggtacccttaggttaactttacgtggttaggacgtaagacgggtacggtaccgggggaacccctaaccgggttaaccgttaacccgtaaccggtacgtaacggttacgggtaaccggttaccgggtacgggggtaccggtaaaccggggtaacccccgg

SEQ ID NO: 183782 - DNA, 607 bp, Homo sapiens
  misc_feature: GYAE6OF02HFNU1.13.76.G10.1.454.CMB.1.raw
  modified_base (177)..(177): a, c, t, g, unknown or other
  misc_feature (177)..(177): n is a, c, g, or t
  modified_base (181)..(181): a, c, t, g, unknown or other
  misc_feature (181)..(181): n is a, c, g, or t
  modified_base (183)..(183): a, c, t, g, unknown or other
  misc_feature (183)..(183): n is a, c, g, or t
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (225)..(225): a, c, t, g, unknown or other
  misc_feature (225)..(225): n is a, c, g, or t
  modified_base (231)..(231): a, c, t, g, unknown or other
  misc_feature (231)..(231): n is a, c, g, or t
  modified_base (235)..(235): a, c, t, g, unknown or other
  misc_feature (235)..(235): n is a, c, g, or t
  modified_base (392)..(392): a, c, t, g, unknown or other
  misc_feature (392)..(392): n is a, c, g, or t
  modified_base (452)..(452): a, c, t, g, unknown or other
  misc_feature (452)..(452): n is a, c, g, or t
  modified_base (495)..(495): a, c, t, g, unknown or other
  misc_feature (495)..(495): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcggtcgtttcgtcgtaggctattaaagtgcagtgtgnggtncngctgtgagtnggagagctgatcgagcgtggggtccncgancnctctgnagcnctgtggtacacgtcacgtcaccactacatgacgcgtacggtccgcaggcctacggaggggaacgggtcgtgggcggttcgtcgttacttttacgtttaatttaccgtaggttaaggacgttagtaacacggttccacgtacgaacgtttccacgggngggtaaccgggtctaattccgaactcgttgaccaagacactaactacgaacgacaccgtnttcgttaacttacgaacttagactagaccgtgacgaccggtanacgtaccggactaccggttcttagttacgttacgtcggtacgaggagacggttacggccggaaccgtacgtacgtactcgtagtcggtacggcgtcggacggacgtacgacg

SEQ ID NO: 183783 - DNA, 725 bp, Homo sapiens
  misc_feature: GYAE6OF02HC0GU.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttggttgcttattttaaaaggtgcccagtgtgaggtgcagcgtggtggagtcgtgggaggaggcttgatccagccgtgggggtccctgagactctcctgtcgcacgcctcgtcggttcaccgtcacgtcaccgacctacatagacgcgtcgggtcccgccgacggccgtaccggagggggaacggggcgtagggaggtcggtccgttcctttactttttaacgtttagtaggtaggtggttaagtactacgtaccgtccgacgacgtaccgtccggtacgggtaacggggcccgtaacttaccgtaaccctactcccgtacccgaagggaacctaaccgtaaacttaacccaaaacggaaaccctacggtacctttcgttttaacccttaacgaaagttacgaaaccgtacgtccgtaggaacgacgaccgtaagccggaacccgacgggtccgttaagttacttacgtggtcggacgtagggacggtacggtcccgggggaacctaaccggtacttaaccgaccgtagtacggtacggtaccggtccgggtacggacccgtaacggtacccgg

SEQ ID NO: 183784 - DNA, 597 bp, Homo sapiens
  misc_feature: GYAE6OF02GZ8UP.13.76.G10.1.454.CMB.1.raw
  modified_base (168)..(168): a, c, t, g, unknown or other
  misc_feature (168)..(168): n is a, c, g, or t
  modified_base (179)..(179): a, c, t, g, unknown or other
  misc_feature (179)..(179): n is a, c, g, or t
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
  modified_base (286)..(286): a, c, t, g, unknown or other
  misc_feature (286)..(286): n is a, c, g, or t
  modified_base (300)..(300): a, c, t, g, unknown or other
  misc_feature (300)..(300): n is a, c, g, or t
  modified_base (314)..(314): a, c, t, g, unknown or other
  misc_feature (314)..(314): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
  modified_base (374)..(374): a, c, t, g, unknown or other
  misc_feature (374)..(374): n is a, c, g, or t
  modified_base (377)..(377): a, c, t, g, unknown or other
  misc_feature (377)..(377): n is a, c, g, or t
tcagtcacgtactacacgaccggtgctcgatttagtcactcatacaggggggggagaggagcccagcactgggattccgaggtgtttccattcggtgatcagcactgaacacagagactcacatggagtttggctgagcggtggtttctgtaggctagttagaaggtntccagtgtagnggtcgcagtggtggactcgagggggcgcttgggccaggccgtgggggtcccagagcctctccgtgaacanccgtcgtggtcatctcaaggtctagtntggtatgacngtggccgctaagcnccgagggtaggcgngtggcggtgaccaattaanacngagactaggnacctatnacgngtacntgtagaggacgntanaccagtactacgacgagtaacgacaacgactatacactacttagtacttacgaacgaacgtcggaccgtcgtaagaaggacgacggttaacgaacggacgttcttaacgagtttagttaacgagtcgggaactaggtagttacggaggtccggtagtacggtacgtacggtacgggtacgggtaccgggtaccggtaccggtaccgtaccgtacgtaccg

SEQ ID NO: 183785 - DNA, 728 bp, Homo sapiens
  misc_feature: GYAE6OF02I4LDB.13.76.G10.1.454.CMB.1.raw
  modified_base (633)..(633): a, c, t, g, unknown or other
  misc_feature (633)..(633): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttaatttaaaaggtgcccagtgtgaggtgcagctggtggagtcgtggaggaggcttgatccacgccgtcgggggtcctgagactcctcctgcgcacgcctcgtggtcctaccgtcagtccaaccgaacccctactagagagtaccgtcgggtcccgtacccgagggcccgtacccggtaagggggaacggggggacgtgggaacgtcggccgtttccgttaccttttttaattaattaacggttaggttgggttaaacgtaactaactaaccttcccggactaggtacccgttacggtgggtaccggggcctaagttcccaaacctacgtcctcgaggaaactacctaaactttacccgaaaagaacaccgtcctttagttaccttaactaaaagttcgaaacacgtaaccgtaaggaaaaccgccggtataacggacccgacggtcccgttagttacttacggtgcgaacggtanaggtaggtacccgggacccctaaaggttaaaccgttactacggacttaggtcgggacgttccggtacccgggacgaacggggtaccctaacccgg

SEQ ID NO: 183786 - DNA, 749 bp, Homo sapiens
  misc_feature: GYAE6OF02IG3FC.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggtttccttgtgctattttaaaggtgcccagtgtgaggtgcagctggtggagtcgtggaggaggcgttgactccagccgtggggggtccctgacggctctccgtgtcgcgagcctcgtgggttccaccgtcacgtcaccacctacatggagtccggtgggtcccgaccgacggccgtaccggaggggtaagggccgtagggacggtggtccggttcttacgtttttacgtttaacgttagttaaggttaggttaacggtactaacgtacctaccgtcgtacgtacgtccggtacgggtacgggtccggtacctaccgtaccgtactcttaccgaagtacgaacctaacgtaccaacgaacgtaccgagttaccgttactttacaaactaacgtacgacgtacctaggtagaaccgacgtacaggttaacccgaccggtccggttacgtaacgtttaccgtaggtaccgtacgggacgtacggaggtacccggggtacccgtaaaccggtaaaccggttaacccttaaccgtacgggtaccgtttaaaccggggtccggtttacccggggtaccggggtacccgggaaaccccggggttaaacccggg

SEQ ID NO: 183787 - DNA, 792 bp, Homo sapiens
  misc_feature: GYAE6OF02I6UIS.13.76.G10.1.454.CMB.1.raw
  modified_base (521)..(521): a, c, t, g, unknown or other
  misc_feature (521)..(521): n is a, c, g, or t
  modified_base (610)..(610): a, c, t, g, unknown or other
  misc_feature (610)..(610): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccgtagtgtggtaggtgcgagtcggtgggtagggtacggttcggtaggggaagggtacggttcgttaggtaacgtcccgacggtcccggggggttccggggggttcccctagggtaacgtaccttcccgttccggttggtcgaccgtaccgtccccgttcggtttccggggtttacccgtacccggttacgtaacggttacccaaacccgtaaccccttaactaaggtacggacggtcgggttccggggtccccgaccggtacgggtcccgtaccggggaaggggggaacgggtcggtgggtagtcggtcgtttcctttactttttattagtaggtaggttaggtaanacgtacttaccgcgacgacgtacgtcggtacgggacgggtcctactaccactacttccgacagactaacttactaacgaagactccgtntttactttactaataagttaacgactacgtccgtagacggacgacgtagtacggaaccggccggtcttacgttaacttcggtggtacggagttaggacgtcgggtacccgggacctaaccggttaacttaccgacgtacgttaggccggtaccggtcgggacgggtacgaaccggtacccgg

SEQ ID NO: 183788 - DNA, 904 bp, Homo sapiens
  misc_feature: GYAE6OF02HKNPP.13.76.G10.1.454.CMB.1.raw
tcagtcacgtactacacgaccggtgctcgatttagtcactcatacaggggggggaggaggagcccagcactgggattccgaggtgtttccattcggtgatcagcactgaacacagaggactcaccatggagttttggctgagtcgttgggtttttccttgttgtcttaagtttttaaaaggtcgcccgagtgtaggaggtgccagcgtgggtggagtcgtgggaggtaggcttgatccgagccggttcggggggtccctggacgtaccgtccttccgttggtcgccgacgtcccgttcggttcggggttaccctaccggttcgtaacgttccaaccgtaaccctaccgtaagtacggtaacggtcccggttacggggtccccgaccgtaacgggcccccggttaccggaacggggggtaacgggggtcgttaggggtaggttcggtcccggttttacttttacttttttaagttttaaggttaaggttaggttggtaacgttaactacgtaccgtccgacgtacgtaccgttcgggtcggtaacggggtccctagtccctaccctattcccgtaccgaacggaacctaacctaaacgttaccccgaaagtaaccccgcgtttaccgtttacgttttaccctaaagtaaaccgttacggaaaccgtaccgttacggtacggaaacgggtccgaaccggtaacttacgggaacccgttacggggtacccgtttaagtttaaaccgtttcggtaggttaccgggaacggtagggtaccggggttaacgggttcccggggaaaccccttaagggttaaaccccgttacggttaaccggtcgtttaaccgggtcgggttaccggttacccgggggtaccgggtaacccggtaaacccgggtaccccggg

SEQ ID NO: 183789 - DNA, 658 bp, Homo sapiens
  misc_feature: GYAE6OF02GRY4J.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttggtccaggccgggggggtccctggagactctcatgtgcggcctcgtgggctcaccgtcaaaccaccaaacctacatgagctgggtccgccaggcctccgagggaagagggccggagtcgggtctcgagttattttatggtcgacgggtgccgactagtttctacgcaagacctttcccggtagggacggggtcccggtttccaacccattctcccgaagacgaaccgtaacttacccgaaagaaacaacgggtagtattacttacaaatcggaacgtaccgtagagacgttacgaggaccgacggccgtacttacttacgtgtgaacgaaagacgtagacgagacggaccgggtacccccggtaaaggtccggggtccggtgggtacggggtagggttttccgtttcggttttacgtacgttcggtaccggtacggggtacccggg

SEQ ID NO: 183790 - DNA, 743 bp, Homo sapiens
  misc_feature: GYAE6OF02INPWZ.13.76.G10.1.454.CMB.1.raw
  modified_base (692)..(692): a, c, t, g, unknown or other
  misc_feature (692)..(692): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcagctggtggagtcgtggaggaggcttgactccgaggtccggtcggggggtaccctggacgtaccgttcctcccgtggtcgaccacgtcccttcggtcgggttccacccgttcacgtccacctacctacagtgagcgtcgggtcccgccgacggcctaccggaggggacggggctgggtacggtcgtcgttctttacgttttattaagtaggtagttaggtagtacactaccgtccgcgacgtaccgtcggttaggacggggcctacttcccgacctagtcccgtaccgaagtacgaaaccctaacgtaaccgaaacggtaaacctaccgggttcttacgggttttacctaaaccgtaaaggttacgaaaccgcggtcccgtaaggaacggtaccgtaccggtatacggtaccggaccggttcgttacgttactttacgggtagcggtacggaagtcgtaacggtcccgggaacccttaaccggtaaccgtttacgaccgtnttaaccgggtcggtaccgggtacggtaccgggggtacccaagggtccccgg

SEQ ID NO: 183791 - DNA, 677 bp, Homo sapiens
  misc_feature: GYAE6OF02HCNQG.13.76.G10.1.454.CMB.1.raw
  modified_base (258)..(258): a, c, t, g, unknown or other
  misc_feature (258)..(258): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (479)..(479): a, c, t, g, unknown or other
  misc_feature (479)..(479): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctattttaaaaggtgcccagtgtgaggtgcagctggtggagtcgtggaggaggcttgatccagccgtggggggtccctgagactctcatgtgcggcctgnggctcaccgtcaaccaccaactacatgacgtcgtcgggtcccgccgacgggtcctaccggaaggggaaggacggggcccgggtagggtcgggttcctacgttaagtttagttttacgtcggtccggtacgggtcaccctatacttacgacgcacgtaccgtcggtggacgggcctatccacntcnccaagnaacaactcaaacgactcgtcttcgttctanaaactcgaacacgtcctaggacgaacgccggtaactcggaccgaccggtccgttagttacgtttacgtgtacgacggaaggtagtaccgggttacccggggaacccctaacgggttaaccccgtttaacgtaacccggtacggttacggttacgggtaccccgggtaccgggtaccggggaaccccggtaaaccgggg

SEQ ID NO: 183792 - DNA, 666 bp, Homo sapiens
  misc_feature: GYAE6OF02ICFME.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtcgtccgtgtcccccaggacagacagccagcatccactgctctaggaataattggcagataatatacttcctaggtactcagcagaacgtcaggccacgtcccctagtcgctggtacatcgtatacaagactcgaccgaagccggcccgtacgagggtactcccgtgacgacgtacttccgtcgtcggtcctaccgtaacctcggttacgggaaaccttcgaaccggtcctacgttaccgtaccgtaacctacgtaccggaccggaccgggaaccccgtagggtacccgttaaggtcgggtaacgtcggaacggtaccgttagtaaccttacgttacgtcggtaaccgagggtaccggttagggacgtaggtacgaccgtaccgtacgtcccggtattacggttccggtacggtttaccggaaacggttccgggaacccgttaacggttccgtacccggttaccgaacggtaccggtaccgacccgtaacccgg

SEQ ID NO: 183793 - DNA, 621 bp, Homo sapiens
  misc_feature: GYAE6OF02JDKA5.13.76.G10.1.454.CMB.1.raw
  modified_base (293)..(293): a, c, t, g, unknown or other
  misc_feature (293)..(293): n is a, c, g, or t
tcagtcacgtactacacgaccggtgctcgatttagtcactcatacagggctgggagaggagcccagcactgggattccgaggtgtttccattcggtgatcagcactgaacacagaggactcaccatggagttttggctgagctggttttccttgttgctattttaaaaggtgcccagtgtgagtgcagctggtggagtctggaggaggcttgatccagccgtgggggtccctgagactctcctgtgcagcctctggttcaccgtcagtcaccacctcatgacgctgggtcccncgaggcctcgagggagggctggagtgcgtcttcttttattctaggtgtggtagtatatctcgcacgtctccgtggacggggctattcacctatcgtaccagacgtaacaacgttaccgaagtaacacggtacctttagtttccgttaacgtaacttacggaacctacgtaccgtacggacgtaaccgggccgagttacggaacctccggggttacccgttaggttacttaacgtggtagtcggaaggtcggaacggtcggggaccctaacggtaaccgtttaccaccggtcgttagtaccgggtcgtaccgggtgggtaaaccccggg

SEQ ID NO: 183794 - DNA, 569 bp, Homo sapiens
  misc_feature: GYAE6OF02GFUBC.13.76.G10.1.454.CMB.1.raw
  modified_base (446)..(446): a, c, t, g, unknown or other
  misc_feature (446)..(446): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtcccgccgaggctccgagggaagggctggagtgcgtcttcttttattatagtagtggtagtacatactccgcacgactcgtggacgggccgtattccaccactctccagagaactaacttccaaagaacacgtcttgtttactacaaattcgaacngtccctagacgacgcccgagtcaccgaccggtccgtagttatcgtagtgcgagagtacgtcggggacctaacgtacgttactacgtactacgtcggacgtcggtcgggaccgacgggtacccg

SEQ ID NO: 183795 - DNA, 620 bp, Homo sapiens
  misc_feature: GYAE6OF02IR7OG.13.76.G10.1.454.CMB.1.raw
  modified_base (147)..(147): a, c, t, g, unknown or other
  misc_feature (147)..(147): n is a, c, g, or t
  modified_base (168)..(168): a, c, t, g, unknown or other
  misc_feature (168)..(168): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (426)..(426): a, c, t, g, unknown or other
  misc_feature (426)..(426): n is a, c, g, or t
tcagtcacgtactacacgaccggtgctcgatttagtcactcatacagggggggaagcctgggaacacttagccttcatgagtgtccccaccatggcctgtatgatgcttctcctcggactccttgcttatggatcaggatggattcncagactgtggtgacccagganccatcgttctcgagtgtctctgggaggacagtcacactcacttgtggcttgagatacggctcagtctctaagtacgttacctacccagctggtaccaacacgacccagccagctccgcgcacgctcatctacaacaacaaacnctcgctcttcgtcggggtccctcatcgtcttcctntcgctccctnttccgtagggaaacaaacgtctcgtcccttaatcacgtccggaaccgggggccccaggacaaggaaacgntaggaactgtgtaatttattacgttgttcgtttactttagtagtgggtacgtcgtcgttacgtttctgttccgttggtttcggtacgggtagggacggtacccgtacccgggtcgtaccggtaacccggttccgtaccgggttccgaaccggtacccgtaacggtccctaccggacccccgtaggttaccccgg

SEQ ID NO: 183796 - DNA, 709 bp, Homo sapiens
  misc_feature: GYAE6OF02G6PZ7.13.76.G10.1.454.CMB.1.raw
  modified_base (240)..(240): a, c, t, g, unknown or other
  misc_feature (240)..(240): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataatggacaagataaactntacttccgtaggtactcgagacaaggaacgtcacgggccctacggttccccttaggtcgccgttaggtcctattaccgtaacgtacgaaagtactcggaccccgtaaagcccgggtcccctacggacgggtacctcccgtagaaccggtcgtaactttcctcgtcggaccttaccgaacgttccggtaacgggtaaaccctcgaccgtaccctacgttccgtaccggaccctaacgtccggaccgggtacccgggtacccgagggtacctaggtaccgggtagtacggtacggtaccttacggtaaccttacgttacggtacggtacggtagggtcggggttacgacgacgtaccgacgaccgtaccgtccgtcccggtattacggttccggtaccgttaccgggtacgtaccgggtaacccgtaccggtaccgtaccccgtacgtacccggtaccgacccgtaacccg

SEQ ID NO: 183797 - DNA, 783 bp, Homo sapiens
  misc_feature: GYAE6OF02F3RM4.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgctattttaaaaggtgcccagtgtgaggtgcagcgtggtggagtcgtggaggaggtcttgatccgagccgtcgggggtccctgacgactctccgtgtcgcacgcctcgtggttccaccgtcagtccacacctacatgagcgtcgggtccgccgacggccgtaccggagggggaacgggcgtagggagtcggtccgttcgtttacgtttttaagtttagtaggttaggttggtagtaactacttaccgtccgtacacggtaccgttccggtagggaacggggtccgtaacgttacccgaacctacgttcccgtacccgaaaggtaaccgtaaacccttaaacttaccccgaaaagtaaaccccgtcgttccgttttacgtttacccttaaacggaaaaacgttccgaaaaccgtcggtaccccgtaagggacgtaaccgggacccgttaagtaccgggacccgttaacccggggtctttacggtttaattcccgtggtaccggaacgagggtaccggtaggtaccccgggggtaaccccaaagggtttaaacccttccgtaacgtacgttaacgggtccgggtaccgttcccgggggtaccgggggaaccccaaagggggtaccccccg

SEQ ID NO: 183798 - DNA, 831 bp, Homo sapiens
  misc_feature: GYAE6OF02IV2J2.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaggtgcccagtgtgaggtgcagctggtggagtctggaggaggcttgatccagccgtgggggtccctgagactctcctgtgcagcctcgtgggttccaccgtcagtccaaccacctacagtgagtcgtcggggtcccgccgagggcctaccggaagggggaaggggcctgggagtcgcgttctttcgtttttatttataggttagttggtagttaccagtacctccgactacgtacccgtccggtagggaccgggggtaccctacgtttacccgaacctaccgtttccgtacccgaaggtaaaccgtaaacccttaaaccgtttaaccccgaaaacggtaaacccgtacccggttcctttacggttttttaacccaaccggtaaaaattaccgggaaaccctacgggtacccttaggaaacggaccgggtaacccgaagttaccgggaacccgtaccgggggtaccgttttaggttaaacgttttaccgtagggtaccgggacggtaaagggtaccggtaaggggttccccggggggaacccccttaaacgggttaaccccggttttaaaccgtacccggttaccgtttaaggttaccggggggtaaccccgtttacggggtaaccccgggggggttaacccggaaacccgggggttaacccccgg

SEQ ID NO: 183799 - DNA, 759 bp, Homo sapiens
  misc_feature: GYAE6OF02HTSSS.13.76.G10.1.454.CMB.1.raw
  modified_base (559)..(559): a, c, t, g, unknown or other
  misc_feature (559)..(559): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgactccaggccgtcggggggtccctgagactctcctgtgcagcctcgtgggtccaccgtcacgtccaccacctacatgagcgtcgggtcccgccgaggcctccggagggggaacggggcgtgggacgtggtccgttctttactttttagtttagtacggttaggttgggttaacgttaacctacgttaccgttcccgcgaacgtacccgttccgggtacgggacgggggtccctacgttcccaaccgtacttccctaaccaggaaccgtaaactaaacttacccgaaaacgtaaaccctccggttactttacggttttaccctaacgtaaaagttcgaaaaccncggttacccgttaggaacggtaaccggcccgtaaagttaccggaaccccgtaacggggttccgttaagtttaacgttaccggtggacggtacggaaggacggtacggtacccggggaacccctaaacgggttaaccgttacctaacgtcgttaacggtacgggaccggttccggacgggggtacccgaaaggggtccccg

SEQ ID NO: 183800 - DNA, 678 bp, Homo sapiens
  misc_feature: GYAE6OF02GDD84.13.76.G10.1.454.CMB.1.raw
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (413)..(413): a, c, t, g, unknown or other
  misc_feature (413)..(413): n is a, c, g, or t
  modified_base (577)..(577): a, c, t, g, unknown or other
  misc_feature (577)..(577): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagtctgggttttccttgttgtcttaagttttaaaaggtcgtcccagtgtggacggtgcagctggtggagtcgtggaggaggtcttgactccgagccggtcggggggtccctagtacgtactcctcctgtcgcacgtcctcgtcgggttaccaccgtcagtccacctacctanagtgacgtcgtcgggtcccnccgtacggtcctaccggaaggggacgggctgggagtcgtcttgttacttttagttataggtagtggtatactatacctccganaacgtctccggtaggacgggtcctagtccacgtatccaccagaacgtaactaacgtacgaaacgtaccacgttccttacgtttactaaactaagtacgtaacacggtcccttagggacgaccggccgtaagtccggaacgccggggtacttggtaaactttcgngtacgcgaagtcggacggtaccgggaacctaacggttaaccgtaacgttacgtacgttaacggtcggtaacggttccggacggggtaccgacgggtacccg

SEQ ID NO: 183801 - DNA, 637 bp, Homo sapiens
  misc_feature: GYAE6OF02HIIS8.13.76.G10.1.454.CMB.1.raw
  modified_base (237)..(237): a, c, t, g, unknown or other
  misc_feature (237)..(237): n is a, c, g, or t
  modified_base (295)..(295): a, c, t, g, unknown or other
  misc_feature (295)..(295): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcacgcccaccctcagtcgtccgtcgtccccaggacagacagccagcatcacctgctcagaaatatgacagataatntactctgtatcagcagaacgtcacggccacgtccctgtcgcgtggtcatctatcaagngtcgacaacggcccgccgtcggacggtactcccgtagacgtcgtacttccgtcgtccggtaccttacctaacgttccgttaacggacctcgaccgtacctaccgtcctacgacctagacccggacggcccgggaacccgaggtacgtaggtacggtaacgtaggacgtccttacgtacttacgttacgtacggtccgaggggtccggtaggaaccgcggaccacggtccgtaccgtccgacccgttagtcggttccgtaccggttacgggaaccgttacccgggtaaccgtaccggttacccgaccggttaccgtaaccgtacccggaacccgtaaccccgg

SEQ ID NO: 183802 - DNA, 696 bp, Homo sapiens
  misc_feature: GYAE6OF02FIW29.13.76.G10.1.454.CMB.1.raw
  modified_base (133)..(133): a, c, t, g, unknown or other
  misc_feature (133)..(133): n is a, c, g, or t
  modified_base (174)..(174): a, c, t, g, unknown or other
  misc_feature (174)..(174): n is a, c, g, or t
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgccttactgcacnggatccgtggaccttcctatgagctgacctcagccaccctnagtgtcctgtccccaggcagacngccagcatcacctgctctggaataatggcagactaaatatacttcctggtatcngcagtaacgttcacggcctacggtcccctcgtacgaccgtcggttaccgaagttccttaactaccgtaaagacgtacgtaccaaacggtccgggaccccctcgtaccggggtaacttcccccgtaggtaaccggtaccgtaacgtttcccgttacgtcgggtcccttaccgtaaacccgttccgttaacggggaactttcccgacggtacctaccgtcgtacgttacccacgtccgtaacggacccgggaccctacggcctagttcgacgtcggacgacttcgtacttacgttacgtacgtacgtacggacgttacgggactacgacacgtaccgactcggtaccctcgttaccgtcggttaccgttaccgggaacgttaaccgggtacccgtaacggtacccgttacccgttaccctaacggttaccgaaccgtaaccccccgg

SEQ ID NO: 183803 - DNA, 903 bp, Homo sapiens
  misc_feature: GYAE6OF02IHILD.13.76.G10.1.454.CMB.1.raw
  modified_base (337)..(337): a, c, t, g, unknown or other
  misc_feature (337)..(337): n is a, c, g, or t
tcagtcacgtactacacgaccggtgctcgatttagtcactcatacaggggggagaggagcccagcactgggattccgaggtgtttccattcggtgatcagcactgaacacagaggactcaccatggtagttttggctgagtcgttgggtttttccttgttgtactttaagttttaaaaggtcgtaccctaggtgtggaggtgacagtcgtgggtaggtagttcgtagggaggaggtcctttaggactccgacggtccggtcggggggtcccctggacgtactcctccgtgtcgacgacgtccttcgtcggttccaccgtcacgtacaacctacctanacgtagacgtcggtcgggtcccgtccggaacggtccggtacgggaagggggaacggggtccgtagggtacggtcggtactttacgttttacgttttaagtttaacgttaaggtttagggttacggtaacgttaactacgtacccgtccgtaccgtaaccgtacccgtccgggtacgggtaccggggtaccttaacgtacccgtaaacccgtagttacccgtacctaacgggtaacctaaactaaacgttaacccgaaaacggtaaaccgtaccgttacgtttaccgttttaacgtaaccttaaaggtacggtaaaacccgtaccgtaaccgttaacgggaacgtaaccgggtacccgtaacgtaacccgggaacccggtaacccggtccggtttaaccgttaaacgttttacgtacgggttaccggaaggtaaccggtagggttacccggggaaccgggttaccccgaaaaccggtttaccgtttaacccggtaacgttacggttacgggttacgggtaacccgttaccggggtaaccggggttacccggaaacgggtaccccggg

SEQ ID NO: 183804 - DNA, 898 bp, Homo sapiens
  misc_feature: GYAE6OF02H2RY4.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcaggcgtggtggagtcgtggaggagcttgatccagccggtgggggtccctgacgacctctccgtgtgcagccctcgtcgggttccacccggtcacgttaccaccacctaaccagtgacggtcgttcggggccccgaccgacgggccctaccggaagggggaacgggggtccgtacgggtaggtcggtccgtttccgttttacgtttttaagttttaacttaacggggtttaggttaggggttaacttacgtaaacttacccgtaccgaccgtaaaccggttccgtacccgggtacggggtaaccggggggtaccctaacgttccccgaaacccgtaacgttccccgtacccgaaagggtaaccctaaaccgttaaaccgttaacccgaaaacgtaaacccgtacccgttacgtttcggttttaaaccttaaccgtaaaaccgtacggtaaacccaccgggttacccttaaggggaacccgtacggtacccgtaacggtaccggacccggtaaccgggttacccggtttagttacccgtttaacggtcgggttaccggtaaaccgggaaggtaaccggtacggggttacccggggaacccccggtaaccggtttaacccgggttaacccgttaaccggtccgtttaagggtaccggttacccgggttaaccgggtcccgggggtaacccggtaaccgggtacccccggg

SEQ ID NO: 183805 - DNA, 926 bp, Homo sapiens
  misc_feature: GYAE6OF02JFDY7.13.76.G10.1.454.CMB.1.raw
  modified_base (326)..(326): a, c, t, g, unknown or other
  misc_feature (326)..(326): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctattttaaaggtgcccagtgtgaggtgcagcgtggtggagtcgtggaggaggtcttgatccgagccggttcggggggtccctggacgacctcctcctggtcgcacgtccttcgttcggttccaccgtcgagtccaccaccctacatgagtccgtcgggtcccaccgnggccgtaccggaagggggaaggggtcgtaggggtagtcgggtccgtttcgtttacttttttaatttacgttaaggttagggttacggttagttaaaccacgttaaccgttcccggtaccgtaacggtaccgttacccggggttaggggacccgggggtacccgtaaatttccccgaaacctaccgttcccgttaacccgaaggttaaaccgaaccctttaaacgttaacccgaaaacggtaaaacccccgtaggttcctttttacggttttaacccgttaaactaaaaaggtttaccggtaaacccgtaacggtccccgttaagggaaaccggtaaccgggtaccccgttaaagtacccgggaaacccggtaccccgggggttaacgttttaacggtaaacctttttaacgggttacggtaccggggtaacgggtaaagggacggtttaacccggggtacccgggggtaaccccttaaaaacccgggtttaacccgggtttaacccgaaaccggttaccgtttaacggggtttccggggtaaacccgggtttcccgggtaacgggggggtaacccccgtaaaaccgggggggtacccccc

SEQ ID NO: 183806 - DNA, 640 bp, Homo sapiens
  misc_feature: GYAE6OF02F5HRG.13.76.G10.1.454.CMB.1.raw
  modified_base (371)..(371): a, c, t, g, unknown or other
  misc_feature (371)..(371): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtggggggtccctgacgactctcctgtgcagcctcgtggggttccaccgtcagtccacacctacatgagcgtcgggtcccgccgaggcctccgaaggggagggcgtgggagtgcgtcttacttttattatagtagtggtagtacatacncgacagtacgtccgtggacgggccattccacactcctaccgaagacgaccaattacccgaaagaacccacggtcttacgttttacctacaaaagttcgaaacctcgtccctaggaacgacggcccgaatccggaaccgccgggtcgtgtttaaacttacgtggtacgacggagtaggacggtcggggaaccccctaaggtaacccgttttacgaaccggtcgttaacggtcgggaaccgttccgggacgggggacccaaggggtacccc

SEQ ID NO: 183807 - DNA, 697 bp, Homo sapiens
  misc_feature: GYAE6OF02HQE6H.13.76.G10.1.454.CMB.1.raw
  modified_base (284)..(284): a, c, t, g, unknown or other
  misc_feature (284)..(284): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagtcttgggttttccttgttgcttaagttttaaaaggtgcccagtgtgaggtgcagctggtggagtcgtgggaggaggcttgagtccagccgtcgggggtccctgacgactcttcctgtgcacgtcctcgtgggttccaccgtnacgtcacctacctacatgagtcgtcgggtccgccgaggctaccggaaggggaacggggtcgtggaggtcggtcgttcttttacttttaatttagttaaggtaggttaggtacgttaactactaccgtccgacgtagtaccgtcggtacggtacgggaccctactaccgaccgtactccgtaccgaaagtaacgaacctaaacttaccgaaagaaacccgcgttacgtttacgtttacctaaacgtaaattaacggaacaacgtccgaagaacggaccgtaccgagtacgacccgtaacgggtcgtttaagtacgttacgtggtaccggaggaagtacggtaacggccgggtaccccaagggttaaccttaccgacgtcgtacgttacgggacgttccggtaagggaaccccgg

SEQ ID NO: 183808 - DNA, 820 bp, Homo sapiens
  misc_feature: GYAE6OF02FJ988.13.76.G10.1.454.CMB.1.raw
  modified_base (237)..(237): a, c, t, g, unknown or other
  misc_feature (237)..(237): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgatccagccgtggggggtcccngagactctcctgtgcagcctctgggttccaccgtcagtcacacctacatgacgcgtcgggtcccgccgacggccgtaccggaaggggtaacgggggccgtaggggacggttcggccggtttccgtttaccgtttttttaagttttacgttaaggttaacggtttgggttaacggtttaaccgtaaagttaccccgttacccggaccgtaacgggtacccgttcccgggttaggggtaccggggggtacccgtacgttttcccaacccgttacgtcccttacccgaacggtaacgtaaaccctaacgtttacccgaaaacgtaaaccctaccgttacccgttttcggtttttaacccttaaccgtaaaaacgtttacggaaaaccctacggtacccgttaggaacgggtaaccggacccgtaacgttaccggaaaccggtacccgggtacccgttaagggtttaactttaaccgttgggttcgaccggagggtaacggtaacggtccgggggaaccccaaccggttaaccgttaaccgtacggtaccgttagtcggggtaaccgttcgggtcggggaaacccgg

SEQ ID NO: 183809 - DNA, 726 bp, Homo sapiens
  misc_feature: GYAE6OF02GO43R.13.76.G10.1.454.CMB.1.raw
  modified_base (301)..(301): a, c, t, g, unknown or other
  misc_feature (301)..(301): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctgggaggaggtcttgatccagccgtggggggtccctgacgtactctcctgtgcagcctcgtcggttcaccgtcagtcacacctacatgagcgtggtccnccgaggctaccggagggaacgggctaggagtcgtcgttcttacttttagtttaataggttaggtaggttaacgtacctagttaccgtcgacacgtacgtccggtaggacggggtaccctattacccgaacccgtatttcccgaccgaggaacgtaacctaaacgttcccgaaaaacggtacccgtaacgtccgtttcgttttaaccctaacgaaaacttacggaaacccgtaggtcccttaaggaacgaccggtaccgtaacgtacgaaccggaccgggttacccgtttagttaacgtttacgtcgggtacaccgggtagaacgggttcggttacccgggggccctaaaccggttaaccgttaccgtacgtacgttaggtaccgggtaccgttccggggtacggggtacccgaacggtaacccgg

SEQ ID NO: 183810 - DNA, 776 bp, Homo sapiens
  misc_feature: GYAE6OF02HHZBC.13.76.G10.1.454.CMB.1.raw
  modified_base (285)..(285): a, c, t, g, unknown or other
  misc_feature (285)..(285): n is a, c, g, or t
tcagtcacgtactacacgaccggtgctcgattttagtcactcatacagggggggagaggagcccagcactgggattccgaggtgttccattcggtgatcagcactgaacacagaggactcacatggagttttggtgagctgggttttccttgttgctattttaaaggtcgccagtgtgaggtgcagcgtggtggagtcgtggaggacggtcttgagtccaggtccggtcggggggtccctggacgccttctccgtgtcgtcacgtcctcgtgggttaccaccgtntacgtcaccaccgtacagtaggtacgtcgtcggggtcccgtaccgaggtccgtaccggaagggggacggggtcgtgggagtcggtctttacgtttactttttaattacgttaggttaggttagggtacttaacgtaacttacccgtccgcgtaacgtccgttaccggtaggacgggggtaccctacgttcccgaaccttacgtcctaccgtaaggactaaccgtaacttacgaacgtaaaccgtacgtactttgtttaccacgtaaacgtacgaaacgtcaccgttaggagaaccggtaccgtaagtacggtaacccgacgggtacccgtttagtaaccttttcgtaacggttggaccgttaacggacgggtaccgggaccgggtaccccggtaaaggttaacccggtttaaccaacccggtacgtttacggtaccgggttaccggtacgggttaacccgggaacccggtaccgggtaccccgtaacgggg

SEQ ID NO: 183811 - DNA, 698 bp, Homo sapiens
  misc_feature: GYAE6OF02HTSMI.13.76.G10.1.454.CMB.1.raw
  modified_base (305)..(305): a, c, t, g, unknown or other
  misc_feature (305)..(305): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggcttgactccgagccgtcggggggtccctggacgactctcctgtcgcacgtcctcgtgggttcaccgtcagtcacacctacatgagtcgtgggtccnccgaggcctaccgaggggaaggggcgtggaggtgtcgttcttacttttattattaggtagtggtacgtactatcctcgctagacgtcggtaggacggggcctattacacctagtcctaccgagacgtaactattacccaagaacctccgtattcgttttacctaacaaagttacgaaacccgtacgtacccgtagaacggtacgacccgggtataccgggaccgaccgggtaccgtttagttaacgtttacgcggtacggtaccgaaggtacgggtacgtacccggggggaacccttaaccgggttaaacgttacccggaacggttcttaacgggttacgggtaccccggttacggggtacccgggggtaccggaaaccggggtaacccccgg

SEQ ID NO: 183812 - DNA, 775 bp, Homo sapiens
  misc_feature: GYAE6OF02IN3DO.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttatttaaaaggtgcccagtgtgaggtgcagctggtggagtctggaggaggcttgatccagccgtgggggtccctgagactctcctgtgcacgcctcgtgggttccaccgtcagtccacctacctacatgagtcgtcgggtcccgccgacgggccgtaccggaagggggaacgggggtccgtaggggaggtcggtaccgtttctttacctttttaagttttagttaaggttaaggttcgggtaacggttaactaacgttaaccgttcccgaccgtaacgtaccgttcccgggttagggtaacgggggtccctaactttacccgaaccctacttccgtacccgaaggaacgtaaacctaaacttacccgaaaaggtaaacctaccgggtcctttaggttttaacccttaactaaaacgttacggaaaaccctacgacccgttagggaaccgaacggtacccgtaagtaccggaaccggtacgggtccgttagtttaaccttacggtggacgacgaaggtaggtacggtccgggggaacccctaaacggttaaccgttaaccgacggtaccttacggtacggtacccggtcggtacgggggacccaacggggtaccccg

SEQ ID NO: 183813 - DNA, 810 bp, Homo sapiens
  misc_feature: GYAE6OF02JDUMN.13.76.G10.1.454.CMB.1.raw
  modified_base (207)..(207): a, c, t, g, unknown or other
  misc_feature (207)..(207): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgtgcttattttaaaggtgcccagtgtgaggtgcagctggtggagtcgtggaggnggcttgatccgagtccggtgggggtccctggagactctcctgtcgcacgcctcgtggttccaccgtcacgtccacctacctacagtgacgtcgtcgggtcccgccgacggccgtaccggaagggggacgggcgtgggagtcggtcgttccgtttactttttaagtttagtaggttaggtagggttacgtacgtacttaccgtccgacgtacgtaccgtcgggtacgggacggggtaccgtacgtttacccgaacctacgtcccgtaccgaacggtaacgtaaccttaaacgttaacccgaaacgtaaacccgtaaccgttcctttaaacggtttttaccctaaacgtaaacgttaaggaaaccccgtaacggtacccgttaagggaaccgggaccgtacccggtaaagttacccgggaaccggttacccgggtaccggttttaaggttaacttttaacgggtcgtaaccgggaaggtaaggaccggttaagggtaccccggggtaaccccgtaaaccggttaaacggttacccttaacggtacgttaccggtacggttaacccgggtccgggtaacgggggacccgtaacgggggtacccccg

SEQ ID NO: 183814 - DNA, 682 bp, Homo sapiens
  misc_feature: GYAE6OF02HHS2Z.13.76.G10.1.454.CMB.1.raw
  modified_base (245)..(245): a, c, t, g, unknown or other
  misc_feature (245)..(245): n is a, c, g, or t
  modified_base (248)..(248): a, c, t, g, unknown or other
  misc_feature (248)..(248): n is a, c, g, or t
  modified_base (404)..(404): a, c, t, g, unknown or other
  misc_feature (404)..(404): n is a, c, g, or t
  modified_base (423)..(423): a, c, t, g, unknown or other
  misc_feature (423)..(423): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctggagactctccngtncagcctctgggttccaccgtcagtcactacctacatgagtcgtcgggtcccgcccgaggccttccgaaggggaaggggtcctgggaggtcggtcgttcttactttttaatttacgtagttaggtggttagtactataccgtcgacagacctccggnggacggggcctatcacctntcctacgagtagaacctaacttacccaaacgaactaccgtacgtttcgttttacctaacgtaaacgtcgtaaaccaacgtcccgtagggaacgtcgaacccggtaataccggaaccggacgggttccccttagttaaccgtttaccgtagggtccgacgggtaagacggtacggtaccggggcccctaacggtaaccggttacctaccgtacgtagtaccgggtaccgtacgggtacgggacccgaaggggtaaccccg

SEQ ID NO: 183815 - DNA, 714 bp, Homo sapiens
  misc_feature: GYAE6OF02G0XAQ.13.76.G10.1.454.CMB.1.raw
  modified_base (347)..(347): a, c, t, g, unknown or other
  misc_feature (347)..(347): n is a, c, g, or t
tcagtcacgtactacacgaccggtgctcgatttagtcactcatacagggggggaggaggagcccagcactgggattccgaggtgtttccattcggtgatcagccactgaacacagaggactcaccatggagtttggctgagctgggtttccttgttgctattttaaaaggtgcccagtgtgaggtgcagcgtggtggagtcgtggaggaggcttgatccagccgtggggggtccctgagactcctcctgtgcacgccttcgtcgggttccaccgtcagtcaccactacatgagctcgggtcccgccgaggcctccggaaggggtaacggggctggagtgcgttcttnttttattagtagtgtgtagtactatactccgactagcgtccggaggacggggtcctattccgacctactctaccgagtaacgactaaacgttccgaaacgtaaacctacggtccgtttacggttttacctaccgtaaaagttacgaaaccgtacggtaccgtaaggtacggaaccggacccgtaggtacggaaccggtaaccggggtaccgttagtttaaaccgtttaccggttggtacgtacggtaaggtcgttacggggtacccggggtaacccgtaaaccgggttaaccggtttaccgtaaccggtccttaacggtcgggtaccggttccgggtacggggtacccggtaacgggtaacccccgg

SEQ ID NO: 183816 - DNA, 760 bp, Homo sapiens
  misc_feature: GYAE6OF02G4WV5.13.76.G10.1.454.CMB.1.raw
  modified_base (269)..(269): a, c, t, g, unknown or other
  misc_feature (269)..(269): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcgagcgtgggtcggagtcgtgggaggaggcttggattccgaggccggtcggggggtcccctggacgactctcctgtgcncgcctcgtcgggttccaccgtcacgtccacctacctacagtcgacggtcgtcgggtcccgccgnggccgtcccggaagggggaacggggtcgtgggtacggttcggtaccgtttccgtttacgttttttaactttaagttaggttaggttaggttaacgttaaccgtattacccgtccgacgacgtaccgttccgtaggggacggggccgttacgttccaccgtactccgacccgaagccgtaaacctaacttcccgaaaagtaacaccgtacctttcggtttaccttaaccgaaagttacgaaaccgtcggtaccctaaggggactaaccgggtaccgtaaggttaccgaaccggtaccccgggtcgtttacgttacctttaacgtgggtcgtacgggaaggtccggtaacggggtccggacccctaaagggtaacctttaccgtacggtaccttagggtcccggtacccggttgggacgggtaccccgg

SEQ ID NO: 183817 - DNA, 753 bp, Homo sapiens
  misc_feature: GYAE6OF02IQ1GU.13.76.G10.1.454.CMB.1.raw
  modified_base (283)..(283): a, c, t, g, unknown or other
  misc_feature (283)..(283): n is a, c, g, or t
tcagtcacgtactacacgaccggtgctcgatttagtcactcatacaggggggagaggagcccagcactggattccgaggtgtttccattcggtgatcagcactgaacacagaggactcaccatggagttttggctgagcttgggttttccttgttgtcttaattttaaaaggtgcccagtgtgaggtgcagcgtggtggagtcgtggagggaggcttgactccgacgtccggtcggggggtccctggacgtactcctcctgtgcacgcctcgtggtcaccgtnacgtccacactacagtgagcgtggtacccgcacggcctcggaggggaacggggcgtggtagtcgtcgttactttacttttaatttagttaacgttaggttggtaacgtaactaactaccgtaccgtacgaacgtaccgtaccggtagggaccgggtcctaacgttccgaacctaactccctaccgaaagtaaccgaaactaaacgttaccaaaacggaacccaccgtactttacgtttactaaaccgtaaattaccggaaactacgcccgtagaacgacggtaaccataccggaacctacggtacccgttagttaaacttcgaggtacggaacccgtaaggtacggaccgggttacccggggaaaccctaaaccgggtttaaaccgttacccttaaaccgggacctttaggggtaaccgggtaacccggttccggggtaaaccggggtacccgggaaccgggtaacccgg

SEQ ID NO: 183818 - DNA, 673 bp, Homo sapiens
  misc_feature: GYAE6OF02IBMV6.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactcctcctgtgcagcctcgtggttccaccgtcagtcaccaccacatgagcgtcgggtcccgccgacgggcctaccggaggggaaggggcgtgggaggtggccgttcttacttttatttataggttacgtggtagtactataccgtccgcagtaccgtcggtaggacggggccgtattccaccctatcctccgaagacgtaactaaacgttacccaaaagaaccgtaccgtcttaggttttccttaacaaagttcgaaaccgtggtaccctgggaacgacggtacccgattacggaaccgtaccgggccgttagttaacttacgtggtagcgaagtacggaacggtcgggggaacccctaacgggtaaccgtttaaccgacgtacgttacgtcgggtaaccggttccgggaacggggacccaacggggtaccccg

SEQ ID NO: 183819 - DNA, 768 bp, Homo sapiens
  misc_feature: GYAE6OF02GS3VO.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggtcttgactccgaggccgtggggggtccctggacgactcctcctgtgcagcctcgtcggttccacgtcagtcaccacctacagtgagcgtcgggtcccgccgaggcctaccggaggggaacggggcgtagggacgtggccgttcttctttttaagtttagtagtaggttggtacgttaacacttaccgtccgcaacggtacccttcgggtagggaccggggtcctagttacccacctacgtcccgtaccgaagtacgaacctaacttacccgaaagaccgtacgtctttacgttttaccctagtaaacgcgtaaacctcggtaccgtagaacggtacgacccgtaatccggaaaccgtccggggttacccgttagttaacctttacggtggtacggtacggaagggtacgtaacggggtaccccgggtaacccgttaaacccggttaacccggtttaaaccgtaccgggttaacccgtttaaggggtacccgggggttaaccgttaccggggggtaacccgggggtaaacccccggtaacgggggtaaccccccggg

SEQ ID NO: 183820 - DNA, 687 bp, Homo sapiens
  misc_feature: GYAE6OF02ISX4B.13.76.G10.1.454.CMB.1.raw
tcagtcacgtactacacgaccggtgctcgatttagtcactcatacagggggggaagcctgggaacacttagccttcatgagtgtccccaccatggcctggatgatgcttctcctcggactccttgcttatggatcagggagtggattctcagactgtggtcgacccaggacgccagtcgttctcgacgttgtctccgtgggacggactagtacaccactcgacgtttggtggtcttaggaatacgtacggcttcgagttctacgttagtaacgttacctacccgtagtctacggtaccaacgacgaccccgacggaccgacggcctccgcgacacgtctccatactaacaacaacaaacactcacgttccttcgtcgggtccctcgactcgtcttcgttcgtcgtcctcacgttccgttaacggaaactaacgcctacgtaccttatctaccgtacggaccggggacccgacggacgaaggtaaacgtagtacgtaatcgttaagttaactttacgtttcgttacgttttcgtttactttaaggttaggtacgggttacgtcgtacctttagtttcgacgttcgtggttcggttaggacgggtaccgcggtacccggtcgtaccggttacctcccggcgttaacccgaccgtcccgaaggtccccgtccggtccctcggttacccgg

SEQ ID NO: 183821 - DNA, 736 bp, Homo sapiens
  misc_feature: GYAE6OF02JMASP.13.76.G10.1.454.CMB.1.raw
  modified_base (361)..(361): a, c, t, g, unknown or other
  misc_feature (361)..(361): n is a, c, g, or t
  modified_base (566)..(566): a, c, t, g, unknown or other
  misc_feature (566)..(566): n is a, c, g, or t
  modified_base (577)..(577): a, c, t, g, unknown or other
  misc_feature (577)..(577): n is a, c, g, or t
  modified_base (586)..(586): a, c, t, g, unknown or other
  misc_feature (586)..(586): n is a, c, g, or t
  modified_base (650)..(650): a, c, t, g, unknown or other
  misc_feature (650)..(650): n is a, c, g, or t
tcagtcacgtactacacgaccggtgctcgatttagtcactcatacagggggggaggaggagcccagcactgggattccgaggtgtttccattcggtgatcagcactgaacacagaggactcaccatggagttttggctgagctgggtttttccttgttgcttatttaaaaggtgccagtgtgaggtgcagctggtggagtcgtgggaggaggcttggactccgacggtcccggtggggggttcccctgacgaccttccgtaccgtgtgccgacggtccttcggttacggttcctaccggtccagttccaacctaaccgtacacttggaacgtcgtcggggttaccccgccgacgggtaccnccggtaacggggggaacgggtccggttaggggacgggtcggtccgtttaaccgtttctttttaagttttaaggttacggttaggttagggttacgtaaacgtactacccgttacgccgtaacgtaccgttccgggtaggacggggtacccgagtttccacctagtcctaccgaagtaacgtactaacttaccgaagtaaaccgtnttgttacctanaattcgaancgtacgtcgagacctacagtacggtaaccgacgggtccgttattaattacgtgacggacgtaancggggtacaggggcccctaaaagtacccgttgaacgtctaacgggttcggaccgttaccggggagggaccccgtaaggggaacccc

SEQ ID NO: 183822 - DNA, 757 bp, Homo sapiens
  misc_feature: GYAE6OF02IRHHC.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccggtggcctcctatgagctgactcacgcccaccctcagtcgtccgtcgtcccaggacagacagccagcatcacctgcctcgtaggtaaaattaagttcggacaagaattaaaattacttacttccgttaggttactcgaagcaagtaacgtcgacggacccacgttccccgtggtcgcgttggtccattcctatacgaagtactaccgaccgaacggcccggtcccgtacgacgggtacctccgtgacgtcgtacttcgtcgcggtacctaccgtaactccgtacggtacctcaccgtcccgtaccttcgtaaccgaccgtacgtaccgccggtacccgggaacccgaggtacccgtagggtacgtaacggtggaaccgggtacttacgttaactaccggtttacgtccggttacggtaccggggtacgggttaccgggaacgtacggtaaccggtaccgtaccgtacccggtccggacccgttaccgttaacggttcccggtttaacccggttaaccgggtaacccggttacccggggtaaacccgttaccgggtaccccggtttaacccggttaacccggtttaacccgggacccgtaacccccgggtaaacccccgg

SEQ ID NO: 183823 - DNA, 738 bp, Homo sapiens
  misc_feature: GYAE6OF02IH4R5.13.76.G10.1.454.CMB.1.raw
  modified_base (417)..(417): a, c, t, g, unknown or other
  misc_feature (417)..(417): n is a, c, g, or t
  modified_base (495)..(495): a, c, t, g, unknown or other
  misc_feature (495)..(495): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgcttaattttaaaaggtgcccagtgtgaggtgcagctggtggagtcgtggaggaggcttgactccgagccgtcggggggtccctggagactctcctgtgcagtcctcgtggtccaccgtcagtccaccacctacagtcgagtccgtacgggtcccgccgtacgtcctaccggaacggggggtaacgggggtcgtacggggagtcgtcgtttctttactttttagtttagttaaggtaggtagtaagtactaacgttaccnccgacacgtacctcggtggacggggcctattccaactactcctaacgagacgtaaacctaacttacccaaacgtaacnccgttcttagtttaccttaacgtaaagtcgaaaccacgtccgtacggaacgaccgtacggaacgacgtaacccggacccgggttaacgttggttaaaaccttcggtagtacggacgaaaggtcggtaacgggttacccggggaaccccgtaaacgttaaaacccggttaccgtaacgtacgttaccggttcggggtaaacccggttcgggtaccggggaaccccggtaaggggaaccccccgg

SEQ ID NO: 183824 - DNA, 876 bp, Homo sapiens
  misc_feature: GYAE6OF02HIS4T.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagtttggctgagcgtggtttctgtgctatttaaaggtgccagtgtgaggtgcagcgtgggtggagtcgtgggagggacggcgttagactccgaggtccggtcggggggggtacccctggaacgtaccttccgttcccgtggttcggaccgacggtcccttcggttacggggtttaccacccgtcgtacgttaccaacctaccctaacgagttacggacggtccggttccggggttccccgaccggaacgggtccgtacccggggaacggggggtaacgggggtcgttaggggacggttcggtccggtttacttttaccgtttttaattttaacggttaggtttaaggggtacggttacgtaactacgtaccgtccgacgtacgtacgttccgggtacgggacggggtccgtaacttcccgaactacgtccgtaccgagtaacgaacctaacgttaacccaaaggtaactaccggtacgtttactttaccgtaactaacgtacgtaaccgcgtcccgaagccggacgacccgtaagtcggtaacccggaccgggttcggttaactttcgttaccgggtagtacgggtaccggtaaggtacggtaaccggggttcccggggggaacccctaaacgggttaaacccgggttttaccccgaagtttacccggtttaacggggtcccggggttaacccggggttaccggggaacccggggggttaccccggaaaccgggggtttacccccggg

SEQ ID NO: 183825 - DNA, 889 bp, Homo sapiens
  misc_feature: GYAE6OF02IA2HW.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctggtggagtcgtgggaggaggcttgatccgagccgtcggggggtccctgagtacttctccgtgtgcagcctcgtcggttcaccgtcacgtcaccaactacatgagcgtcgggtcccgcgacggtcgtaccggaggggaaggggcgtggtagtcggtccgtttctttcgtttttaagttttaagttaggttaggttagggttaacgttaactacgttaaccgtccgacgaacggtacccgttccggtacggggtacggggtaccgttaccgttccaacccgtaactcctaccgaaggtaccgaaacccttaaacgttacccaaaaggtaaaccccgtacgtccgttttacggttttaccttaaacgaaaaacgttacgaaaacccgtacggtacccgttaggaaacgggtaaccggtacccgggttaaataccggggtaaccccgtaccgggggttaccccggttttagttttaaaaccgtttccgggtaggttaacccgggaaccgggtaaggggttaaacccgggtaaccgggggttttacccccggggggaaaaccccccgttaaaacccgggttaaaacccggggtttttaaccccgtaaaccggttacggtttaaccggtaccggggggtaccccggttttaccggggtaccgggggggtaaaccccccggtaaacgggggtaacccccccgg

SEQ ID NO: 183826 - DNA, 683 bp, Homo sapiens
  misc_feature: GYAE6OF02I06HE.13.76.G10.1.454.CMB.1.raw
  modified_base (357)..(357): a, c, t, g, unknown or other
  misc_feature (357)..(357): n is a, c, g, or t
  modified_base (480)..(480): a, c, t, g, unknown or other
  misc_feature (480)..(480): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcttgggttttccttgttgcttaatttaaaaggtgcccagtgtgaggtgcagcgtggtggagttcgtgggaggaggtcttgactccgacgccggttaggggggtccctggagtacctcctacctggtacgcacgtccttcgtggtccaccgtcacgtaccaccaccttacagtgagtaccgtcggtccgccggagccgtcggaaggggacgggcgtagggngtcgcgtttcttacctttttaagtttactagtacggttagtacgttacgatactacgctacgactccggtaggacggtcgtactcactacctctacgagtacgtaacaactaccaaggtaacncgtacttgttaccactaatacgacacggaccgtagacgacgaccgtagtacgaccgtacgggttacctaggttaaacctgttacgtacgaccgaaggaggtacggaccgggaaccccgttaaacgtacggttaaccgtacctaggttaccggacgggttaaccgggtccgttaaccgggggaccgtaacccgggtaaccccgg

SEQ ID NO: 183827 - DNA, 775 bp, Homo sapiens
  misc_feature: GYAE6OF02HST01.13.76.G10.1.454.CMB.1.raw
tcagtcacgtactacacgaccggtgctcgatttagtcactcatacaggggggggaagcctgggaacactttagccttcatgagtgtccccaccatggcctggatgatgcttctcctcggactccttgcttatggatcagggagtggatttctcagacttggtggtcgacccaggacgccattcgttctcagtcgtctcgtggaggacagtcacactcacgtttgcggtcttagagtacgtcggctcgtagtcttcttacggttacgttaccctacccgagtcgtacggtaaccaaccgaaccgaccccgacggcccgacggccgtccggaccgccgaccggtcctcctactacctaaccaaaccaaccaaaaaccgccttccgtacttccgtttccggttccgggggtccctacgtacttccgtccttcgttcgtcggtcctacctacgttccggtaacggaaacgtacgctccgtacctttactcacgtccggaaccggggccgacggtacaaggaagtacgtacacgttactagttatttacttacgtttgtttatttacgttttaaggttacggtttacggggttattacggttactttacgtttcgttacgggttccgtttgggtttacgggttacgggtacggggtccggtaacccggtcccggggtccgttacccggttacccggttccggttacccggtccggtaaccccggtaacccggtaccggtccccggtttacccccggtacccggttacggttacccccggg

SEQ ID NO: 183828 - DNA, 756 bp, Homo sapiens
  misc_feature: GYAE6OF02HRY46.13.76.G10.1.454.CMB.1.raw
  modified_base (291)..(291): a, c, t, g, unknown or other
  misc_feature (291)..(291): n is a, c, g, or t
  modified_base (360)..(360): a, c, t, g, unknown or other
  misc_feature (360)..(360): n is a, c, g, or t
  modified_base (470)..(470): a, c, t, g, unknown or other
  misc_feature (470)..(470): n is a, c, g, or t
  modified_base (627)..(627): a, c, t, g, unknown or other
  misc_feature (627)..(627): n is a, c, g, or t
tcagtcacgtactacacgaccggtgctcgatttagtcactcatacagggggggagaggagcccagcactgggattccgaggtgttccattcggtgatcagcactgaacacagaggactcaccatggagttttggctgagctggtttccttgtgctattttaaagtgccagtgtgaggtgctagcctggtggagtctacgggaggacggtcttcgactcccgtagccggtggggggtcccctggagtaccgtctcctggtcgcaggtcccttcgtgggttccaacccggttnacgtaccactacctacatcggagcgtcgggcctaccgaggcctacccggagggggaagggcctggacgngtcctcgttagtttttattacgtagttaggtagttactacgacttacctccgataacgtacgtccggtagggaaccggggtcctaaacgtttccaaaccctagtttcccnccgtaaaggtaacctacgtaaaacttccgaaaacggacttacgtaccttgtttaaccttaacgaaagttcaaacgcgtaccctaggaacgtaaccggtctcgtaaagtacccgggacccggttaccggtagtttaacgtttacgttccgaaagggtnaccggtaggtaaacggtcccgggggtaaaccccttaaggtaaacccgggtttcaacccgggtagtaacgttccgggggtaaaacccgtttcccggggttcgggaaaccccggggtaacggggtaacccc

SEQ ID NO: 183829 - DNA, 584 bp, Homo sapiens
  misc_feature: GYAE6OF02G5P0J.13.76.G10.1.454.CMB.1.raw
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
  modified_base (482)..(482): a, c, t, g, unknown or other
  misc_feature (482)..(482): n is a, c, g, or t
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgttgctatttaaaggtgcccagtgtgaggtgcagctggtggagtctggaggaggcttgatccagccgtggggggtccctgagactctcctgtgcagcctcgtgggttcaccgtcagtcacacctacatgagcgtgggtccgccgaggcctaccgaggggaaggggctgggagtgcgttcttcttttattatagtagtgtagtacatactcgcagactcgtggagggcctattccacatcctcagacactaatccgaanacacgtcttgttctacaaatcgaacngctagacgagccagtacgacgacgggtccgttagtactttacgnggtagacgagacgtacggtccggggaacccctaaggtaaccggtttcaaccggtcttaacggtcgggtaccgttcgggacggggtacccaaggggtaccccg

SEQ ID NO: 183830 - DNA, 631 bp, Homo sapiens
  misc_feature: GYAE6OF02HF24G.13.76.G10.1.454.CMB.1.raw
  modified_base (371)..(371): a, c, t, g, unknown or other
  misc_feature (371)..(371): n is a, c, g, or t
  modified_base (452)..(452): a, c, t, g, unknown or other
  misc_feature (452)..(452): n is a, c, g, or t
  modified_base (463)..(463): a, c, t, g, unknown or other
  misc_feature (463)..(463): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgactccagccgtggggggtccctggacgactctcctgtcgcagcctcgtgggttccaccgtcagtcacacctacatgagcgtcgggtccgcgaggcctcgaggggagggctggagtgcgttcttcttttattagtagtagtgtagtacatactccgnacgtactccggtggacgggcctatccacctatcctaccagactaactaacgttcccaaagaccacgtcttgtttacctaanaaatacgaacncgtccgtagacgcgaccagttagacccgacgggtccttagttaacgttcgtggtcggacgaaggtacgtacggtacccggggaccctaaacgggtaaccttaccgtaccggtattaacgggtcgggtaaccgttcggggaacgggtaccccgtaaggggtacccccgg

SEQ ID NO: 183831 - DNA, 787 bp, Homo sapiens
  misc_feature: GYAE6OF02G8ANG.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcgtgggttttccttgttgcttattttaaaaggtgcccagtgtgaggtgcagcgtggtggagtcgtgggaggaggtcttgactccgaggtcccggttcgggggggtcccctaggacggtaccttccgttccctggtcgcacgtccttcgttcggggttcacccgtcgacgttccaaccaccttacagtgaacggtccggtccggtcccggacgtcggtcctaccgggaaggggacgggtaggtggtacgtggtcttcgttttacttttaagtttaagtacgttagtacggttagtacgtactaccgtcgactacggtacgtccgtgggacgggtaccgtactccgtacctacgtaccgtccgtaaacgaacgtaacttaaacccgtaccgaaacgtaaacccgtaccggtactttaccgttttaaccgttaaactaaacggttaacgaaaccgttacgtaaccgtacggaagtacccgggaccgttacggtaacgtaacccgggtaccggttacggtttagttacccttaaggtccgtaacgggtacgtagggtacggtacgggtaccccgggtaaccggtaaccgttaaccggttacgaccggttcttaaccggtcggtaccggttgggaacccgggtacccgg

SEQ ID NO: 183832 - DNA, 772 bp, Homo sapiens
  misc_feature: GYAE6OF02FH8GC.13.76.G10.1.454.CMB.1.raw
  modified_base (334)..(334): a, c, t, g, unknown or other
  misc_feature (334)..(334): n is a, c, g, or t
tcagtcacgtactacacgaccggtgctcgattagtcactcatacaggggctgggagaggagcccagcactgggattccgaggtgtttccattcggtgatcagcactgaacacagaggactcaccatggtagtttgggctgagtcttgggtttttacccttgttcgtacttaattttaaaacgggtcgtaccccctagttggtaggacggtcgacgtagtccgtgggtggtacgtcgtcgggacggacggtcgttacgactcccgacggtccgggtcgggggtcccctaggacctcctccgtcctcggtcgacctccgtccgtccgtcggttccnccgtacctcgtcctaccgacctacctacgacgtacgtctccggtccgtccgtcgtaccgtacggacggtacggtcgtgtcgtcggtacgttcctttactttacgttacgtaggtacgtacgtacgtacgtactaccgtaccacgtacgtcgtccggtacggtacggccgtactaccgtaccacaccgtccgaagtaccaacctactaaccgactaaccgtcgtacctttacgtaccgttaacaccgttaaccgacgtacctcggtacacgggactaccaagtaccgtaaccgtaccggttagtaaccttcgtagggaccgttccgggaatcccggtaggggtaacccggtccgtaaacccggtaaccttaccggtaacccggtcgttaacgggtacccggttaggtcccgggtaccccgggtaacgggaacccccggg

SEQ ID NO: 183833 - DNA, 849 bp, Homo sapiens
  misc_feature: GYAE6OF02HDR6A.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcagtcgtccgtcgtccccaggacagacagccagcatccacctgctcgtaggaaattaagttggacaagtaattaaaactacttaacctttccgtaggttaactccgtaagaccgtaagaaggtaccgacgggtaccctaccggttcccccttggtacggtcgttcgggtacctactttaccgttacgttaccgaaacgtacgttaccggacccgtaaacgggccccgggtacccctacgggtaaccggggtacccttccccggtaggtaccggtacgttacttttacccggtcccggtacgggtaccctaaccccgttaacgttccggttaccggttaacgtaacccgttaccgtaaccgtacccgtaacccttacccgtaaccggaaaccctaccgtacccggtacgggtaccccgggggtaacccctaacgggtaccgttaaggttaaccgggtacggttaccgggtacggttaccgttacggtaccgtttaaacgtttacgaccgggtttacggtaacgggtccgggttacggggaacctacggtaccgaccgtaccgggtacccgtccgggtacccgttacgttaccgttacgtttaccgggtaccggaaccgggtaccgggtaacccgtacggttccccgtaaaccgttaccggttaacccgtcgtaaccccgg

SEQ ID NO: 183834 - DNA, 623 bp, Homo sapiens
  misc_feature: GYAE6OF02GGIDK.13.76.G10.1.454.CMB.1.raw
  modified_base (295)..(295): a, c, t, g, unknown or other
  misc_feature (295)..(295): n is a, c, g, or t
  modified_base (462)..(462): a, c, t, g, unknown or other
  misc_feature (462)..(462): n is a, c, g, or t
  modified_base (521)..(521): a, c, t, g, unknown or other
  misc_feature (521)..(521): n is a, c, g, or t
tcagtcacgtactacacgaccggtgctcgatttagtcactcatacagggtgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctctgggttcaccgtcagtcaccacctacatgagcgtgggtccnccgaggcctccgaggggacggggcgtgggagtcgcgttcgttactttttattagtagttagtggtaagtacatacctcgacacgactccggtggacggggccgtacttccgaccatccacaagtacgaactaaacttaccaaagaaccacgtcttgtttacccttanaaaactagaacacgcctaggagacgccgatacgacgacggtccttagttacttacgtgngtacgaggtaggcggtaccggggaccaaccgggtaacgttacccgtaaggtaccgttaggtaccgggacccggttcgggtaccggggaccgtaaacccgggg

SEQ ID NO: 183835 - DNA, 823 bp, Homo sapiens
  misc_feature: GYAE6OF02F3P5V.13.76.G10.1.454.CMB.1.raw
  modified_base (270)..(270): a, c, t, g, unknown or other
  misc_feature (270)..(270): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaggtgcccagtgtgaggtgcagcgtggtggagtcgtggaggaggcttgatccagccgtgggggtccctgagactctccgtgtgcacgcctcgtgggttccnccggtcacgtcactactacatgacgtcgtacgggtccgccgacggcctaccggaagggggtacggggcgtagggacgtggtccggttctttcgtttttaagtttagttaacgggttaggttgggttaacgttaccgaacttacccgttccgacgtaacgtaaccgtcccgtaagtacggggtaacggggtacccgtactttacccgaaccttactcccgtacccgaaacgggaacgtaacctaaacgtttaacccgaaaacgtaaaccccgtacggtacccgttttacggtttttaccgttaaacgttaaaacttaacgtaaacccgtacgtaccgtacgaagggtaaccggtaccccggtaagtacgggaacccctaaccggggttacccgttgtttaaacgtttaccggtacggttacggaacggaagggtaacggaccgggttacccggggggaaccccttaaacgggttaacccggtttaaaccgttacccgggttaaccgttacggggttacccgggtacccggttaccgggggttaaccccgggggg

SEQ ID NO: 183836 - DNA, 555 bp, Homo sapiens
  misc_feature: GYAE6OF02HDTP7.13.76.G10.1.454.CMB.1.raw
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (440)..(440): a, c, t, g, unknown or other
  misc_feature (440)..(440): n is a, c, g, or t
  modified_base (484)..(484): a, c, t, g, unknown or other
  misc_feature (484)..(484): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaggtgcccagtgtgaggtgcagctggtggagtctggaggaggcttgatccagccgtggggggtccctgagactctcctgtgcagcctctgggtcaccgtcagtccacacctacatgagcgtgggtcccgccaggctccgaggggaacggggctggagtcgcgtcttcttttattatagtagtggtagtacatactcncagactcggtgacggggcctattcaccnctctccagcgacaattccaagaacacgcttgtttcttacaaattgaacngcctgagagcgatgacacggccgttagtattacgtgtcgcgagngagtcgggaccctacggtaaacttcgtacgcgttacgtcggtacgtcgggtacgggaccgaacgggacccg

SEQ ID NO: 183837 - DNA, 801 bp, Homo sapiens
  misc_feature: GYAE6OF02HHSCX.13.76.G10.1.454.CMB.1.raw
tcagtcacgtactacacgaccggtgctcgatttagtcactcatacagggggggagaggagcccagcactgggattccgaggtgttttccattcggtgatcagcactgaacacagaggactcacccatggagttttggctgagcttgggtttttccttgttgtcttaagtttttaaaaggtcgccctagttgtgaggtgcagctggtggagtgtggaggaggcttgactccaggcccggtggggggtccctgagtactctcctgtgcgacgccttcgttcgggtcctaccgtcgacgtaccaacctaccctacagtgacgtccgttcgggtcccgacccgtacgggccgtacccggaagggggaacggggtcggtaggtacggtcggtccgtttccgttttactttttagtttaagttaggttaacggttagggttacgttaacctaacgttacccgtccgtacgaccgtaccgttccggtagggtaaccggggtccgtacttacccgtacctaccttcccgtaccgaaagtaccgtaaacctaaccgttaacccaaacgtacgtaccgttaccgtttagttttacctaaacctaaagtacgaaaccgtccggtacccaggtacgaccggtaccgtaagtaccggtaccggtacgggttccgttacgttaaccgtttacgtcggtacggaccggtaggaaccggtcgggtacccgggaaccccgtaaggtaaaccccttgtacggttaccgttacggtaccgggtacgttcccgggaaccggggccggtaacgggtaccccg

SEQ ID NO: 183838 - DNA, 754 bp, Homo sapiens
  misc_feature: GYAE6OF02GQAEH.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccgagccgtgggggtccctgagactctcctgtgcagcctcttgggttcaccgtcagtcacacctacatgacgtcgtcggtcccgccgacggcctccggaggggaagggcgtgggagtcgccgttcgttcgttttagtttacgttagttaggttacggttagttacgtaacttaccgtccggactaacgtaccgttcccggtagggtaccggggtaccgtaacgtttacccgaaccgtactaccgttacccgaagtaacgtaacctaaacgttacccgaaaacggtaaacctaacccggttcgtttacgttttaccgttaaccttaaaacgtacgtaaaaccgaccgtcccttaagggaaccggtccggaacccggtacgtaccgggaaaccctccggggttaccgttaccgttacgttaacgttcgtacggtaccgaggtaacggtacggtcggggaaccccctaacggttaaccggtttaccgtaccggttacgttaacgtacggggtaacgttccgggaaccgggtaacccggg

SEQ ID NO: 183839 - DNA, 571 bp, Homo sapiens
  misc_feature: GYAE6OF02HKCGS.13.76.G10.1.454.CMB.1.raw
  modified_base (164)..(164): a, c, t, g, unknown or other
  misc_feature (164)..(164): n is a, c, g, or t
  modified_base (244)..(244): a, c, t, g, unknown or other
  misc_feature (244)..(244): n is a, c, g, or t
  modified_base (302)..(302): a, c, t, g, unknown or other
  misc_feature (302)..(302): n is a, c, g, or t
  modified_base (393)..(393): a, c, t, g, unknown or other
  misc_feature (393)..(393): n is a, c, g, or t
  modified_base (414)..(414): a, c, t, g, unknown or other
  misc_feature (414)..(414): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
  modified_base (432)..(432): a, c, t, g, unknown or other
  misc_feature (432)..(432): n is a, c, g, or t
  modified_base (445)..(445): a, c, t, g, unknown or other
  misc_feature (445)..(445): n is a, c, g, or t
  modified_base (452)..(452): a, c, t, g, unknown or other
  misc_feature (452)..(452): n is a, c, g, or t
  modified_base (477)..(477): a, c, t, g, unknown or other
  misc_feature (477)..(477): n is a, c, g, or t
  modified_base (487)..(487): a, c, t, g, unknown or other
  misc_feature (487)..(487): n is a, c, g, or t
  modified_base (517)..(517): a, c, t, g, unknown or other
  misc_feature (517)..(517): n is a, c, g, or t
  modified_base (550)..(550): a, c, t, g, unknown or other
  misc_feature (550)..(550): n is a, c, g, or t
tcagtcacgtactacacgaccggtgctcgatttagtcactcatacaggggggagagggagcccagcactgggatccgaggtgtttccattcggtgatcagcactgaacacagaggactcaccatggagtttggctgagctgggtttcttgtgctatttaaaggngccagtgtggaggtgcaggctgggtggagtcgtggaggaggcttgggactccaggcgtggggggtcccctagacggtacncgttccgtgtacgcgagtcccgtgtcgggttacaaccggtccaggtcaactacctacngtagagcgtggtccgccagtctcgaggggaaggctaggagtgccggtatccgtttaattgtaagtattccgggaattagactactccgtanaccgaatcgtagaggggtacnttcnctatccncaggaanagattccgaaaanccagacnttacactagaatccagtccagaacncgactgaacncggctaggtaacttgatgcgagaccgttancggaactaacaccgaatccggattgacggaccngggttaggccctaagacccgg

SEQ ID NO: 183840 - DNA, 722 bp, Homo sapiens
  misc_feature: GYAE6OF02HJR16.13.76.G10.1.454.CMB.1.raw
  modified_base (407)..(407): a, c, t, g, unknown or other
  misc_feature (407)..(407): n is a, c, g, or t
  modified_base (518)..(518): a, c, t, g, unknown or other
  misc_feature (518)..(518): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagcgtggtggagtctgggaggaggcttgactccaggtccgtggggggtccctggacgacctctcctggtgcgacgcctgttcgggttccaccgtcgacgtaccaacctaacctactatgacgcgttcgggtcccgaccgagggtccgtaccggagggggaacggggcgtagggaggtcggtcgttctttactttttagttagtaggttaggtggttanaactacgtaccgtcgcgacgtacgtcggtcggacgggtcgtacttaccacctactctaccgaagaacgactaaactaccgaaagtaacccacgttcttagtttaccttaanaaaattcgaaaccgtactaccgtaggtacgacggtaccgaattaccggacccgtaccgggtaccgttagtaccgtttaacggcggttagacgggtggaacgggtcggggtacccgggtaacccggtaaccgtaaccggttaaccttacggacttacggtacgggtaccggttccggggtacgggacccggaacgggtaacccgg

SEQ ID NO: 183841 - DNA, 745 bp, Homo sapiens
  misc_feature: GYAE6OF02GIBK2.13.76.G10.1.454.CMB.1.raw
  modified_base (251)..(251): a, c, t, g, unknown or other
  misc_feature (251)..(251): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtgtccgtcgtccccgaggacagacagccagcatcactgctcaggaaataagtgacagataaatatacttcgtgtancagacagaacgtcaggaccacgtccctagtcgcgtggtactagtctaatacaagtctacgaccaacggcccgtaccttacggaccgggtacctcccgtaggtacgtacgtactttccgtacgtcggtaaccctaccgtaaccttcgggtacggtaaccctacgtacccgtaccctaccgtaccgtaccggaacctaacggtacccgaaccgggacccgggtacccgtaacgggtacccgtaaggtacggtaacgtacgggacggttacctacgggttaaaccttaacgtttaccggtacgggttaacccggtacggggtacgggtaccggaacgtacggaaccgtacggtaccaccggtacccgtacccggtcgttaacggttacggttacccgggttaaccggaaccggttaaccggggtaaccggttacccgggtttaaccccgtaacccggttaacggttaacccggtacccggaacccgtaaacccccgg

SEQ ID NO: 183842 - DNA, 753 bp, Homo sapiens
  misc_feature: GYAE6OF02G2RHV.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctgggaggaggcttgatccagccgtggggggtccctgagactctcctgtgcacgcctcgtggtccaccgtcagtccacacctacatgacgtcgtcgggtcccgccgaggccctaccgagggggaacgggcgtgggacggtcggtaccgttctttacgtttttaactttagtaacggttaggttacggtagtaactattaccgtccacgacgtaccgtccggtagggaccggggacctactaccacccgtacttacctacccgaagtaacgtaacctaactttacccgaaaaggaacccacggttccttagttttaccctaactaaatacgaaaccacggtacctggaaacgccggaccgtaagtccggtaaccgtacccgggtccgttaacggttaaccttttacggacggtttaccgacggtaacggtacgggtacggtaccccgggggaacccctaaccgggttaaacccgtttaacccgacgttaaccgttacggtacggggtaacccgttcggggtaacccggggtacccgaaccggggtaacccccgg

SEQ ID NO: 183843 - DNA, 643 bp, Homo sapiens
  misc_feature: GYAE6OF02ID289.13.76.G10.1.454.CMB.1.raw
  modified_base (289)..(289): a, c, t, g, unknown or other
  misc_feature (289)..(289): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtgtccgtgtccccaggacagacagccagcatcacctgctctaggaaataattggcagataaatatacttctgtatcagcagatcagccagtcccctgtgctggtcatctatcaagntcgaccaagccggccctcgaagggactcccgtaggacgtcgtaattccgtcgtacgggtcccttacccgaaaccttcgtacggggtaacctccgtaaccggccctaccgtcctacggaaccccagtacccgaacggacccggggtacccgaaggggtccttaacggtacgggaactttgggaacgggccttaggtaccttaacgtttacggtcgtaccgtagggtccgggtagggaaccgagtaacgcgtaccgaccgttcgcccgttactaggtcgtaccggttaccggtaacggtacgggtaaccgacggttacccgtaccgttaaccgtaacggtccgacggtaaccccgg

SEQ ID NO: 183844 - DNA, 703 bp, Homo sapiens
  misc_feature: GYAE6OF02HGG6X.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagataaatatacttcctggtatcagcagaagtcagccacgtcccctgtcgcgtggtcactctatacaagactcgccaaggtccggaccccgtacggagggtaccttcccaggacgtccgtactttcgtccgtcggaccttacccaacgttccgtacgggtaacctccgtacgccctaccgtccgtacggtaacccacgtccgaaccggggacccggggtaccccgagggtacctaaggtcgggttaagtacgggtacggtacttacgttaacttaacgttaccgttggtacccgtaggggtaccggtacggggaacctacgggaccgtaacggtaccgtaccggtaccggaccccgttacgtttacggttaacggttcccggttaaccggggtaaccggttaccggggtaaaccgtaacccggggttccctaacccgggtttaccgtaaacccggtacggaacccccgtaccccggg

SEQ ID NO: 183845 - DNA, 744 bp, Homo sapiens
  misc_feature: GYAE6OF02GARGA.13.76.G10.1.454.CMB.1.raw
  modified_base (242)..(242): a, c, t, g, unknown or other
  misc_feature (242)..(242): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (527)..(527): a, c, t, g, unknown or other
  misc_feature (527)..(527): n is a, c, g, or t
  modified_base (566)..(566): a, c, t, g, unknown or other
  misc_feature (566)..(566): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgtctaattttaaaaggtgcccagtgtgaggtgcagctggtggagtcgtggaggaggcttggatccaggccggtcggggggtcccngagacctctccgtgtgcacgtccctcgtcgggttcaccgtcagtccaccacccgtacagtagngtcgtcggggtcccnccgacgggtcctaccggagggggtaaggggcgtgggacgtggtccgttcgtttactttttacgtttagttaggttagttagggttaagtaacctaacgtaccgtccggacaacgtaccgtccggtgggaaccggggtcctacttacccgacctacgtcctaccgagaacgactaacgtacaaacgacaccgtcttacgttacctaanaagttaacgacgtacgtaccaggacgtaccgaccggtanaccggtaccgaccggttacgtttagttaacgtttaccggtggttcggaacggtaggtacggtaccgggtacccggggtaacccttaaccggtaaacccggtttacgaaccgttaacgtttacggaccggggtacgttccgggggtaaccgggggtacccggtaaccggggtaacccgg

SEQ ID NO: 183846 - DNA, 729 bp, Homo sapiens
  misc_feature: GYAE6OF02FJLV4.13.76.G10.1.454.CMB.1.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgactccagccgtgggggtccctgacgctctctgtgcacgcctgtgggttccaccgtnacgtcacacctanagtgacgcgtcggggtcccgccgaggccgtccgaaggggaacgggctagggagttcggcgttcctttcgtttttaagttacgtaaggttaggttaggttatacctaattaccgtccggctaacgaccgttcccggtagggaccgggggtccctacgttcccaaccctagtttcccacccgtaaggacgtaactaacgttacccaaaaggaccgtcgtacgtttacggttttaccaactaaagttcggaaaccttcggtaccgagtaaacggcggacccgtaaagtccggtaaccgaaccggggtccgtttacgttaaaccgttcggtacggtacgaccgggtaggtacgcgggttaccccggggaacccctaacgggtaaacctttaccgacggtaaccttggtaccgggttaccctggggttaccggaccggtaacggggtaccccg

SEQ ID NO: 183847 - DNA, 818 bp, Homo sapiens
  misc_feature: GYAE6OF02GWMB8.13.76.G10.1.454.CMB.1.raw
  modified_base (721)..(721): a, c, t, g, unknown or other
  misc_feature (721)..(721): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagtcgttgggttttccttggttagccttaagttttaaaaggtcgcccgtagtgtagaggttgacaggtcgtgggttggtacgtcgtgggacgggtaggtcttgacttccgacggtccggtcggggggtccctggacgtaccgtccttccgttgtcgacgtacgtccgttacggtcgggttaccaccggttccgtacgtccgtaacctaacccgtaaccgttacgtacggtaccggttcggttcccgggtcccggtacccggtaccgggtaccggtaccgggtaacgggggaaccggggttaacggttcgggtaacggttcggttcgtttaccgttttacccgttttaagtttacgttaggttacgggtagtttaagtacgtacgtaccgtacgccgtacgtacgtaccggtacggaacgggtcctacgttcgtacctaccgtacgactaagtacgtacctaacgttaccaaaggtcccaaggttccttacgtttacctaaagttaacgacggtaacctcgggtacctacggtagaaccggtacgtaacgtggtaacccggtaccgtcgttaacgtagttaccgngtacggacgtaggacgtcgggcgtaaccgtacggttaaccgtaccgtaggtacttaaccggtgtcccggttacgggtcggtaccggacgtaacccgg

SEQ ID NO: 183848 - DNA, 776 bp, Homo sapiens
  misc_feature: GYAE6OF02JBLNT.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctnagtcgtccgtcgtccccgaggacagacagccagcatccacctgctcgtaggaaattaagtggacaagtaataaatattaccttccgtaggtatcagtacagtaagtacacggcctacgtcccctggtcgtcgtcggtctacttcgtataccgaagtacgtacgaccgtaacggcccgtccccgtacggacgggtacctcccgtaggaccggtacgtaccttacgtccggtcggtacccttacccgtaaccgttacggttaaccggtaaccgtaccgaaccgtacccctaccgttacccgttaccgaacccgttaaccgtacccgaaccgggtaccccggggtaacccgtaacggttaccgtaaggtaccgggttacggtagggaccggtaccgttacgtaacccgttttagttacccggttagggttaccggacggggttaccgggtacgggaccgtaccgtacggacccgtaccgtacccggtacccggtacccgtcgtttaaccgtccgggttacccggttaacccgggtacggtaaccggggtaccgttaaccgggtcctaaacccgggttaccgtaccggacccgtacccggtaacccccg

SEQ ID NO: 183849 - DNA, 699 bp, Homo sapiens
  misc_feature: GYAE6OF02G96JK.13.76.G10.1.454.CMB.1.raw
  modified_base (169)..(169): a, c, t, g, unknown or other
  misc_feature (169)..(169): n is a, c, g, or t
  modified_base (207)..(207): a, c, t, g, unknown or other
  misc_feature (207)..(207): n is a, c, g, or t
  modified_base (218)..(218): a, c, t, g, unknown or other
  misc_feature (218)..(218): n is a, c, g, or t
  modified_base (327)..(327): a, c, t, g, unknown or other
  misc_feature (327)..(327): n is a, c, g, or t
  modified_base (331)..(331): a, c, t, g, unknown or other
  misc_feature (331)..(331): n is a, c, g, or t
tcagtcacgtactacacgaccggtgctcgatttagtcactcatacagggggggaagcctgggaacacttagccttcatgagtgtccccacatggcctggatgatgcttctcctcggactccttgcttatggatcaggagtggattctcagactgtggtgacccaggacnccatcgttctcgagtgtctccgtggagggacagtcacnctcactttggngtcttagagattacggctacagttctacgtagtacgttacctacccagctacggtaccaacacgaccccaggccaggcctccgcgcacgctcatccaacaacaacaacnctcnctactcgtcggtcctacgactcgtcttccgtctcggactccatccggttaggaaacaagcctcgtacccttatccacgtcggaccggggaccgtaggacgagaacgtagtacgtaagttaccgtaggttaatttaacgtttacgttcggtttacgttttacgttttaaacgtggtttaccggggttaagtttccggtaccgtttaactttttcgggacgtttccggttaaggtttcgggtttaaccgggacgggttaccgggtaccccgtaaccgggttcgtaacccggttaccgttacccggttaccggtaccggttaaccggacccgtaaccggtcccgttaccggtacccctcgggttaacccgg

SEQ ID NO: 183850 - DNA, 706 bp, Homo sapiens
  misc_feature: GYAE6OF02FHQUM.13.76.G10.1.454.CMB.1.raw
  modified_base (169)..(169): a, c, t, g, unknown or other
  misc_feature (169)..(169): n is a, c, g, or t
  modified_base (470)..(470): a, c, t, g, unknown or other
  misc_feature (470)..(470): n is a, c, g, or t
tcagtcacgtactacacgaccggtgctcgatttagtcactcatacaggggtgggcctcaggaagcagcatcggaggtgcctcagccatggcatggatccctctcttcctcggcgtccttgcttactgcacaggatccgtggcctctatgagctgacctcagccaccctnagtcgtccgtcgtcccgaggacagacacgccagccactccacctgccttacgtaaggaaaacttaagttcggactaagtaattaaaatcttacttccgtaggtactcagacgaagtaacgtcgacggtaccaacggttcccccgtagtcggtcgtacgggtcacttacgtactacgaagtactacgaccgaacggtccggaccctacggaggtacctcccgtaggtacgtccgtattccgtcgtacggcctaccgtaacgtcggtaacggtacctccgacgtacccactacgtacaccctntaccggaccgggacccggtaccgtacggtaccgtaggtaggtatcgggtaggtcgttaacgactttacgttaacgtcggtacggaggtcggtacggacgtacgggacctagaccgtacgttaccgcccgttactaggtttccgtaaccggttacggtaccgggttacggaaaccccgggtacttacccggtacccggttaaccgtaacggtcccgaccgggtaccccaaccccggg

SEQ ID NO: 183851 - DNA, 822 bp, Homo sapiens
  misc_feature: GYAE6OF02IEOBB.13.76.G10.1.454.CMB.1.raw
  modified_base (193)..(193): a, c, t, g, unknown or other
  misc_feature (193)..(193): n is a, c, g, or t
  modified_base (221)..(221): a, c, t, g, unknown or other
  misc_feature (221)..(221): n is a, c, g, or t
  modified_base (285)..(285): a, c, t, g, unknown or other
  misc_feature (285)..(285): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggtttttccttgttgcttagttttaaaaggtcgcccagtgtgaggtgcngcgtggtgagtcgtgggaggaggcttgntccgagccggtcgggggtccctgagtactctcctgtgcacgccgttcgttcggttcctaccgtnacgtcacctacctacatgacgtcgtcgggtcccgcgacggccgtaccgggaggggtaacggggtcgtaggtacggtcgtcgtttcgttttatttttaacgttagttagttaggttgtaacgtactacgtacgtaccgcgtacgaaccgttcggtacgggacgggtacctactttaccgacctacgttcccgtaccgaaggaaccgtaaccttaaacgttaaccccgaaagtaaccgtaccggttactttacggttttaaccttaaaccgtaaaaggttaccgaaaccgtcggttaaccctagggtaaccgtaccggacccgttaacggtaaccgggtacccgtaaacccggggttcgtttacggtttaaacctttccggtagggtaccgtaagggaagggtaaccggtccggggtaacccgggttacccccgaaaccggtttaaccgggtttaccccacgggtttaccgttacgggttaaccccggttacgggttacccgggtaaccggggtaccccggtaaaaccgggtccccggg

SEQ ID NO: 183852 - DNA, 749 bp, Homo sapiens
  misc_feature: GYAE6OF02G2L2Y.13.76.G10.1.454.CMB.1.raw
  modified_base (126)..(126): a, c, t, g, unknown or other
  misc_feature (126)..(126): n is a, c, g, or t
tcagtcacgtactacacgaccggtgctcgatttagtcactcatacagggggggaggagggagcccagcactgggattccgaggtgttccattcggtgatcagcactgaacacagaggactcaccanggagttttggctgagctgggtttccttgttgctattttaaaaggtgtcccagtgtgaggtgcagctggtggagtctgggaggaggcttggatcccaggcccgttgggggggtaccctggaggacctctcctggtcgcaagcctgtcgggttccaccgtcagtcacgacctacatgagtctgggtcccgtccgaggtcctccggaggggtaacgggcctggacggtgcgtagttcttttacgttgtagttagtggttacgtacagttaccgtcggcttaaggccgtacggtgggtaccggggccgttacttaccgtaccacgtaccgtccgacgtaacgaaccttaagttaccccgaaagtaaacccgtaaccgtcgttaggttccttaaacgtaaatcgggtaaactacgacccgttaggagtaacgtcccgtaaggtaccggaaccgtaccggggtaaccgtagtttaaaccgtttacggttacggcggtacgtaaccggagggttacggtacccggggggtaaccctaacccggttaaaccggtttaccgtaaccggtaccgttactacgggggtaaccttccggggtaaccggggacccggtaacgggtaaaccccgggg

SEQ ID NO: 183853 - DNA, 761 bp, Homo sapiens
  misc_feature: GYAE6OF02I5TQT.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggtagttttggctgagcttgggttttccttgttgcttaattttaaaaggtcgcccagtgtgaggtgcgagcgtggtggagtcgtgggaggaggcttgactccgagccggtcgggggtccctgagtaccttccgtccgtgtacgcacgtcctcgttcgggttccaccgtcacgtaccaccaacctaccagtcgaggtccgttcggggtcccgccgacggtccgtaccggaagggggaggggtcgtgggaggtcggtccgttcttttacgttttaagtttatacgggttaggttcggttaacgtaacttaacgtacctccggacgtaacgaccgttacgggcggacggggtacctagttacccgaacctacgttccaccgaaaggtaccgaaacttaaccgttaaccgaaacggtaaccaccgtttccttaggttttaacccttaaagaaacgtactaaaacgtcgtaccgtagggtaacgagaccctaaggtaccggaaccgttaccgggtcgttaacgtttacttaccggttagggcgtacggaggtaagccggggtacgtacccggtaaacgttaacggtttaccacggttactagggaccgtttaccgggtaccgggtagggtaaccccgg

SEQ ID NO: 183854 - DNA, 683 bp, Homo sapiens
  misc_feature: GYAE6OF02JX818.13.76.G10.1.454.CMB.1.raw
  modified_base (133)..(133): a, c, t, g, unknown or other
  misc_feature (133)..(133): n is a, c, g, or t
  modified_base (292)..(292): a, c, t, g, unknown or other
  misc_feature (292)..(292): n is a, c, g, or t
  modified_base (408)..(408): a, c, t, g, unknown or other
  misc_feature (408)..(408): n is a, c, g, or t
  modified_base (469)..(469): a, c, t, g, unknown or other
  misc_feature (469)..(469): n is a, c, g, or t
  modified_base (515)..(515): a, c, t, g, unknown or other
  misc_feature (515)..(515): n is a, c, g, or t
  modified_base (586)..(586): a, c, t, g, unknown or other
  misc_feature (586)..(586): n is a, c, g, or t
  modified_base (606)..(606): a, c, t, g, unknown or other
  misc_feature (606)..(606): n is a, c, g, or t
tcagtcacgtactacacgaccggtgctcgatttagtcactcatacagggtgggcctcaggaagcagcatcggaggtgcctcagccatggcatggatccctctcttcctcggcgtccttgcttactgcacaggntccgtgccctctagtgagctgactcgagcccaccctgagtcgtccgttacgtaccccaggactacggacaagcccagccatccacgttcgacttacgtaagaaaacgttaacttcgggacctaaggtaattaaacgtacttaaccgttcgttaggtacnccgtaaggtaccaaggtaaagttccgaacggtccctaaccggtccctaggtccgtaccgtcggtaccttagtactaagtcaagtactccgccaaggcccgtccctaggtaaccggnttcccgagcgtccgattccgtagtcggaccctagtaaccgttgggtaacacctaggtaccnccggttacctcgtacgacgttaccgaccggcggaacccggtaccgnggtaccgtagtcggaacgttcgacggtctaggtacttacggtcagggtcgtacgggccgtaagccacgtanacgctaacgcccgtccttanccggttacgccgttaacggcggtaaccgtaccgtagtaacccgggttcccaacgttcggaccgaccgtacgtcccgg

SEQ ID NO: 183855 - DNA, 687 bp, Homo sapiens
  misc_feature: GYAE6OF02IBPV4.13.76.G10.1.454.CMB.1.raw
  modified_base (188)..(188): a, c, t, g, unknown or other
  misc_feature (188)..(188): n is a, c, g, or t
  modified_base (512)..(512): a, c, t, g, unknown or other
  misc_feature (512)..(512): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgctattttaaaaggtgcccagtgtgaggtgnagctggtggagtcgtggaggaggcttgatccgagccgtggggggtcccctggtagacctctcctggtgcagcctcgtcggggttccaccggtcagtccactaccgacataggcgcgttcgggccgcgacggcccttaccggagggggaacgggtctaggggacgtcggtacgtcttttacttttaatttagttaaggtggtaggttagtactagtacctcgacagactcggtgacggggctatccgaacctatcctaccaaggtacgactaaacgttccaaaagaccgtagtcctttagtttaccttaacaaaagttcgaaacncgtaccctgggaagaccggtacccgtaatacgggaccaccgggttaccgttactttaagttacgcggtacggtacggaagtacgggagttcccgggggaacccctaaacggtaacttaacccgacgtaccgtggtaccggaacgttccgggtacgggaccgtaacggaaccccgg

SEQ ID NO: 183856 - DNA, 654 bp, Homo sapiens
  misc_feature: GYAE6OF02H8QBY.13.76.G10.1.454.CMB.1.raw
  modified_base (197)..(197): a, c, t, g, unknown or other
  misc_feature (197)..(197): n is a, c, g, or t
  modified_base (283)..(283): a, c, t, g, unknown or other
  misc_feature (283)..(283): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgccaccctcgagtgtccgtgtccccaggacagacngccagcatccacctgctctaggaaataagtggacagaataatactacttcctggtatcagacagaacgtcaaggccacgttccccngtacgcctggtcatctatacaagctcgaccgaacgccggccctcgaagggacctcccaggacgtccgagtcctcgtggtccctacgtaactcgtacggaacttccgacgtaccctaccgttcctacgaaccctagtacccgagggaccggacccgtaacggtcgtaggttacgaaggtcggtacgggcttacgtacgttaacttaacgttcggttaccgacgggtaccgttcgggacgtacgtaccgacgtaccgtcgaccgtcccgttacgtacgttccggttaccggttacggtaaccggttaccgggaaccgttaaccgggtaccgttaaccccggtacggtaaaccgttacccgaccgtaaccccgg

SEQ ID NO: 183857 - DNA, 712 bp, Homo sapiens
  misc_feature: GYAE6OF02G83KV.13.76.G10.1.454.CMB.1.raw
  modified_base (247)..(247): a, c, t, g, unknown or other
  misc_feature (247)..(247): n is a, c, g, or t
  modified_base (295)..(295): a, c, t, g, unknown or other
  misc_feature (295)..(295): n is a, c, g, or t
  modified_base (333)..(333): a, c, t, g, unknown or other
  misc_feature (333)..(333): n is a, c, g, or t
  modified_base (361)..(361): a, c, t, g, unknown or other
  misc_feature (361)..(361): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctggagactctcctgngcaacctctgggttcaccgtcagtcacacctacatgacgctgggtccnccgaggctaccgagggaagggtctggagtcgcgttctnttttacttatagttagtgtagtacatcncgcagacgtcgtggagggcctagttcaccgatctccgagacgactaattaccaaagaacacggtcttacggtttacttacccgaaaagttgaaacctacgttacccgtagaagggacggtacccgtaattagggaacccctacgggggtaccctttagggttaacctttacccggttgggtacgttaacccgggaaggtagggtaaccggttccggggggtaacccccgtaaacgggttaaacccggttttacgtaacccggtcccgtttaaaacgggttcggggtaaccccgttttaccgggttacggggggaaacccccctaaggggggtaccccttaaaccccggggg

SEQ ID NO: 183858 - DNA, 724 bp, Homo sapiens
  misc_feature: GYAE6OF02HXTPN.13.76.G10.1.454.CMB.1.raw
  modified_base (151)..(151): a, c, t, g, unknown or other
  misc_feature (151)..(151): n is a, c, g, or t
  modified_base (271)..(271): a, c, t, g, unknown or other
  misc_feature (271)..(271): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagcgtggtttcgtntagctattaaagtgccagtgtgaggtgcagctggtggagtcgtggaggcgtcttgatccgagccgtggggggtccctgacgtactcgtccgtgtgacacgcctcgtcgggttcaccggtnaactcacatcttacatgtacgtacgtcggtacccgtacgaggtaccgtaccggaaggggaagggggtccgtagggacggtgtcccgttatttacgtttttacttaagttcggtaacgggtacggttaacgttacgaaactaccgttccgagtaacgtaccgtacggtacggacggggtacctacgttaccaaccgtacgtcctaccgagaacgacttaacgtacgaaacgtacaacgtcgtacggttttaccttagtaaacgtacgaaacgtagtaccgtaagaccgttaacgaacgtaacgttcgaaccggtacggtaccggtttacgttacgttaacggtgttacggaacgttagggaccggtagaacccggggtaaccaaccgggttaaacgttacccggtaactaccgttaaggtaccggtacggtaccggtacggggtaccgaacggg

SEQ ID NO: 183859 - DNA, 558 bp, Homo sapiens
  misc_feature: GYAE6OF02FITIV.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctgtatcagcagaagtcaggccagtcccctgtgctggtcatctatcaagtatcgaccaagccggccctcgacgggactccctggacgcgtacttctcgtcggcctaccaactcgtacgggtaactcgacgccactcgcgaccatcgagccgggaccacggctagtggatggagctgactattacgtgtacgagggtcgtaggacgacgcacgcgacgtccgcccgtcttagtccgttacggttaccgggtaaccgttcggggaacccttaacgggtaccgtaacccggttaccctacggtacccgaccgtaccccgg

SEQ ID NO: 183860 - DNA, 702 bp, Homo sapiens
  misc_feature: GYAE6OF02GPBD8.13.76.G10.1.454.CMB.1.raw
  modified_base (234)..(234): a, c, t, g, unknown or other
  misc_feature (234)..(234): n is a, c, g, or t
  modified_base (422)..(422): a, c, t, g, unknown or other
  misc_feature (422)..(422): n is a, c, g, or t
  modified_base (612)..(612): a, c, t, g, unknown or other
  misc_feature (612)..(612): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagcgtggtttcgtgtagctatttaaaggtgccagtgtgaggtgcagctggtggagtcgtgggaggaggcttgatccagcccgtcggggggtccngagactctccgtgtgactacggcctcgtggggttaccaccgtcgagtccaacctacccttaacagttggacgccgttcggggtccccgaccgagggccttaccgggaagggggaacgggtctggggagttcggacgttcgtttactttttaagttagttagttaacggttggtatactaacgttcccncgtacgagtaccgttccgggtagggacccggggcctagttcgaacctatcctaccgagggaactactaaacttaccccgaaaagacgtaccgttacgtttagtttaccgttaacaaaagttcggaaactcggaccctagggtacgcgacccgtagtaccgaccggtaccgggtcttcggttacttaccgnggtaccgaggagtacggtcggtacccggaccgtaaccggtaacgttaccgtacgtccgtacggtcggtaccggttacgggacgggaaccg

SEQ ID NO: 183861 - DNA, 648 bp, Homo sapiens
  misc_feature: GYAE6OF02JCHEJ.13.76.G10.1.454.CMB.1.raw
  modified_base (310)..(310): a, c, t, g, unknown or other
  misc_feature (310)..(310): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagccatccacctgctctaggaaattaagttggcagaataaatactacttcctggtatcgagacagaagtcacggcctacgtcccctgtcgcgtggtcatctatacaagntcgaccgtagccgcccgttacgacgggacttcccgtagacgcggtactttcgtcgtcggtacctccgaacgtcgtaggacctccgacgaccctcgtacctaccgacctactaccgacggaccggtacccacgggtactacggtagtacggtacggacgtcctagtaccttaacttcgtcggtacgacggtcggtacgggacacggacaccggtacctaccggtacgcccgttagtttacggttccgttaccggttaaccggtaacccggttaacgggtaacccgtaacgggttcccgttaaccgttacccgtaacggtccccgaaccgtaacccccgg

SEQ ID NO: 183862 - DNA, 690 bp, Homo sapiens
  misc_feature: GYAE6OF02FVNQ4.13.76.G10.1.454.CMB.1.raw
tcagtcacgtactacacgaccggtgctcgatttagtcactcatacaggggctgggcctcaggaagcagcatcggaggtgcctcagccatggcatggatccctctcttcctcggcgtccttgcttactgcacaggactccgtggcctcctatgagctgactcacgccaccctcagtcgtccgtcgtcccgaggacagacacgccagcatccacctgctcgtaggaaataattggacagataaatattaccttcctagtactcacgactagaagtacgacggtcctaccgtcccctaggtcgcgttagtctaagttctactcgaaagtactacgaccgaacggtccggtaccccgtacggaacgggtaccttacccggtacggtacgtaccggttacgttaccgtcgttccggtacctaccgtaaccgttccggttacgggtaacctccgaccgtaccctacgttccgtacgtacccacgtaccggaacgggtcccggtaacccgagtaccgttaacggtcggtaactcgggtacgtacgtcgttaactacgttacgtacgtacgggtacggcggtaggactaggccgtacgaacgtcgacctccggtacttacggtcgtaccggttacggaccggtacggtaacccgacggtccgtaacccggtaccgtacgtacccgaccggtaaccccg

SEQ ID NO: 183863 - DNA, 614 bp, Homo sapiens
  misc_feature: GYAE6OF02HDAEZ.13.76.G10.1.454.CMB.1.raw
  modified_base (409)..(409): a, c, t, g, unknown or other
  misc_feature (409)..(409): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtgggaggaggcttgatccagccgtggggggtccctgagactctcctgtgcagcctcgtgggttcaccgtcagtcaccacctacatgagcgtcgggtcccgcgacggcctccgaagggagggcgtaggagtgcgttctcttttattagtagtagtggtagtactataccgtcgacacgtactcggtaggacggggctacttccaacctntctccgagacgaacctaattaccgaaagaaccacgtcttagtttcctagaatacgaacacgacctggaacgcgacgatacgaccgacggtcgtagtactttacgtagtgaccgtaggacgtacggtccgggaccctaacggtaaccgttaccaccggtagttacgtccggaccggttaccggcgggtaccgaacgggtaccccgg

SEQ ID NO: 183864 - DNA, 600 bp, Homo sapiens
  misc_feature: GYAE6OF02IOE2Y.13.76.G10.1.454.CMB.1.raw
  modified_base (174)..(174): a, c, t, g, unknown or other
  misc_feature (174)..(174): n is a, c, g, or t
tcagtcacgtactacacgaccggtgctcgattttagtcactcatacaggggctgggcctcaggaagcagcatcggaggtgcctcagccatggcatggatccctctccttcctcggcgtccttgctttactgcacaggatccgtggcctcctatgagctgactcagcccaccctnagttgtccgtcgtccccgaggacagacagccagcatcacctgcctctaggaaattaagttggacaagaataaatctacttcctggtatcagacaagaacgtcacggccacgtcccctgtcgctggtcatctatacaagactcgaccaacggtccgacccgtacggacgggtacctacccgtaggacgtaccgtactttccgtacgtcggtacctaccgtaacgtcgtacggacctacgacgacctacgtcgtacgactacgtaccgacggaccggaaccgaggtactagtcggagtcggagtactacggtaactacttacgcgttagacggtacggtacgacacgcacgaccgtcgtacgtcctatcgtcgttaccgtacggacgtacggacgtacgtaccgtacgtacgtacgtacgacgaaccg

SEQ ID NO: 183865 - DNA, 683 bp, Homo sapiens
  misc_feature: GYAE6OF02GGRT7.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctatttaaaaggtgcccagtgtgaggtgcagctggtggagtctggaggaggtcttgactcgacgtccggtcggggggtccctgacgacctctcctggtgtcacggtcctcgtggtccaccgtcagtcaccacctacatggcgtcgtcgggtcccgccgacggccgtacggaggggacggggcgtagggagtggtccgttctttcgttttaattagtaggtaggttcgtagtactatcctcgctaacgtaccgtcggtaggtacggggcctcttaccactacgtccacgaagtacgactaaactaccgaaacgtacgtaccgtctttctttacttaacgaaatcgaaacgactccggtagagtaccggacgtaagacggtaccggacgttccgttaagttaccttacgtggtcgaacggtaggacggtacggcccggggtaaccctaaccggttaaccggttctaaccgtcgtaacggtcgggttaactccgggggtaaccgggaccggggaaacggtacccccgg

SEQ ID NO: 183866 - DNA, 712 bp, Homo sapiens
  misc_feature: GYAE6OF02JZ6XD.13.76.G10.1.454.CMB.1.raw
  modified_base (259)..(259): a, c, t, g, unknown or other
  misc_feature (259)..(259): n is a, c, g, or t
  modified_base (533)..(533): a, c, t, g, unknown or other
  misc_feature (533)..(533): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgactccgagccgttcgggggtccctggacgtctctcctgtgcncgccttcgtggttaccaccgtcgagtcacacctacatgagtcgtcggtcccgcgtacggcctacggaacggggagggtccgtgggagtcgtcgttcgtttcttttaatttagtaggttaggtggttagtacattaccgtcgacgtacgtacgtccggtacggacggggtcctcggttaccacgtactccgtacgaggtaaccgtaactaaccttaccgaaacgtaaacctacgttctttcgtttaacgttaacaagttacgaaccgagtaccgngaacggtacgtaccgagttaccgaccgacggttaaccgttggttaaacgttacgtgggtacctgggaacgtacgggtcgggtaaccgggacccgtaaaccgggttaacctttacccggtacgttacggttaaccggtaccggggttaccgttcggggtaacccggggtaaaccccgggg

SEQ ID NO: 183867 - DNA, 709 bp, Homo sapiens
  misc_feature: GYAE6OF02ITVYJ.13.76.G10.1.454.CMB.1.raw
  modified_base (208)..(208): a, c, t, g, unknown or other
  misc_feature (208)..(208): n is a, c, g, or t
  modified_base (315)..(315): a, c, t, g, unknown or other
  misc_feature (315)..(315): n is a, c, g, or t
  modified_base (318)..(318): a, c, t, g, unknown or other
  misc_feature (318)..(318): n is a, c, g, or t
  modified_base (477)..(477): a, c, t, g, unknown or other
  misc_feature (477)..(477): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggactgagcttcgggttttccttggttgcttaattttaaaaggtcgcccagttgtgacggtgctagctgggtggngtcgtggaggagcttgactccgagccggtcgggggtcctgacgtacctctccgtgtcgacgacgtcctcgttcgggttacctaccgtacaggttccacctaccgtanagngagtccgtcggccgacgacggcctacggaggggtacggcgtggacgtcgcgttacttacttttattagtagttacgtggtaatactagtacctcggacagtcgtccggtaggacgggtcctactccgactactcgtacagtactaacaacgtacgaaanactcgtattcttacctaataatacgaaactcgtaacgtgaacgcgccgtaagtaccgtacgtaccggtcgtttaacgtaacgttttgaccggttacgacggttaaggtaccggtaacgggtttccggggaaaccctttaaaacgggtaaccgtttaacccgtaggtaaccgttaagggtttcggggaacccggtttacgggtaccggggaaacccttaccggggtaacccgg

SEQ ID NO: 183868 - DNA, 826 bp, Homo sapiens
  misc_feature: GYAE6OF02GPJQ8.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggtttttccttgtttgtcttaagtttttaaaaaggtcgcccaggtgtggaggtgcagcgtggtggagtcgtggaggaggcttgactccaggtccggtcggggggttccctggacgtaccgtcctccgtggtcgccacgtccttcggttcgggtcctaccgtcctaggtccactactactactagtgaggtccggtcggggtccccgaccgtacggtcccgtaccgggaagggggacgggtccggtgggtacggttcggtaccggttttcttttaactttttaagtttagtagggtttaggttggttaacgttactaacgtaccgtccgcgtaacgtccggttacggtacgggtacggggtaccgtacttaccgacctaacttcccgtaaccgaaggttaccgtaacttaaaccgttaaacccgaaaggtaaacctccggttacttttaccggttttacctaaacgaacgttaacggaaccctaggttccaaggaccggtaaccgtaccgtaacgttaccggtaaccggaccggttccggtttaagttacttttacggcggttaaggacgtaacgggacgtaccgggtacccggggtaacctaaaccggttaaccgtacgtaccggttaacgttacggtccgggtaaccggttccgggggaccggaacccgtaaccgggg

SEQ ID NO: 183869 - DNA, 673 bp, Homo sapiens
  misc_feature: GYAE6OF02GV3DL.13.76.G10.1.454.CMB.1.raw
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (371)..(371): a, c, t, g, unknown or other
  misc_feature (371)..(371): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcagtcctcgtgggttcaccgtcagtccacacctanatgagcgtgggtcccnccgaggcctccgaggggagggctgggagtgcgttcttcttttattagtagtagtggtagtacataccgtcngacgtactcggtggtacggggcctattccacctacttcccgtccaagtaccgtactaaacttacccgaaagtacccacgtcctttgtttacctaccgaaagttacgaacctaggtcctaagggacgtacgacccggtataccggaccggaccgggtcgttagttaacttaccgtggtacgaccgggaaggtacggtacgggtaccgggggacccctaacgggttaaacccgttacgtacccggtagttacgggtccggaaccggtttcgggacccgggggtacggaaacccgggtaacccgg

SEQ ID NO: 183870 - DNA, 616 bp, Homo sapiens
  misc_feature: GYAE6OF02GF0AB.13.76.G10.1.454.CMB.1.raw
  modified_base (203)..(203): a, c, t, g, unknown or other
  misc_feature (203)..(203): n is a, c, g, or t
  modified_base (209)..(209): a, c, t, g, unknown or other
  misc_feature (209)..(209): n is a, c, g, or t
  modified_base (237)..(237): a, c, t, g, unknown or other
  misc_feature (237)..(237): n is a, c, g, or t
  modified_base (316)..(316): a, c, t, g, unknown or other
  misc_feature (316)..(316): n is a, c, g, or t
  modified_base (415)..(415): a, c, t, g, unknown or other
  misc_feature (415)..(415): n is a, c, g, or t
  modified_base (449)..(449): a, c, t, g, unknown or other
  misc_feature (449)..(449): n is a, c, g, or t
  modified_base (596)..(596): a, c, t, g, unknown or other
  misc_feature (596)..(596): n is a, c, g, or t
tcagtcacgtactacacgaccggtgctcgatttagtcactcatacaggggggggtctcaggaggcagcgctctcgggacgtctccaccatggcctgggctctgctattcctcaccctcctcactcagggcagtagggtcctgggcccagtctgccctgactcagcctgcctccgtgtcgtggtctcctggacagtcatcaccntctccngcacgtggaccagcaaggtgacgttcgnggtacaagactattgtcctcgtacgtaaccaaaccaacgaccgagaccgaaaccgacccccaaatctaattaactttancgttaactttaccaacttacgtccggtccctcgtaggttcgtaattacgtaactcgtcttacacgtcgtccacgtatcgtgaccaacgccgcctccganacctcgtcctgtcggcctacgagcaggacggacngtagtagttacttacgtctggccgtactcggtaagacgttactcccggtaaccttacgtttcgttcggtcggttacgtcgttagaccgtaacgtaccgtcctaccgtccggtagtccaccgccgtaaccgccctacgtctcgtaccnccttcgtaccctccctaccg

SEQ ID NO: 183871 - DNA, 659 bp, Homo sapiens
  misc_feature: GYAE6OF02JB46T.13.76.G10.1.454.CMB.1.raw
  modified_base (511)..(511): a, c, t, g, unknown or other
  misc_feature (511)..(511): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgactccagccgtcggggggtccctggagacctctcctgtcgcagcctcgtgggttcaccgtcacgtcaccacctacatgagcgtcgggtcccgccgaggcctccggaggggtaagggcgtgggagtcgtccgttcttacttttatttagtagtacggttggtaagtactaacttaccgtccgtacacggtaccttcccgggtggacgggggtaccgtacgtttccacccgtatcccgtacgacggtaacaactacttaccaaagtaacacgtcttacgtttactacaatgaaccncgtactgagaacgccgaatcgaaccgtccgggtactaggttacttacgtacgtcgacggtaacgaggtaaggtcccggggaccctaacggtaaccggtttacgtaccggtacttacggtacggtaccggtcggtacccggggaaccgg

SEQ ID NO: 183872 - DNA, 689 bp, Homo sapiens
  misc_feature: GYAE6OF02G4LKV.13.76.G10.1.454.CMB.1.raw
  modified_base (265)..(265): a, c, t, g, unknown or other
  misc_feature (265)..(265): n is a, c, g, or t
  modified_base (477)..(477): a, c, t, g, unknown or other
  misc_feature (477)..(477): n is a, c, g, or t
  modified_base (576)..(576): a, c, t, g, unknown or other
  misc_feature (576)..(576): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgatccagccgtggggggtccctgacgactctcctgtgcagtcctcgtggttccnccgtacgagtccaccacctacatgcgtcgtcgggtccgccgaggcctaccggaggggaacgggtcgtaggagtcgcgtctttacgttttattagtaggtaggtcgtagtactataccgtcgacacgtacgtcggtagggacggggccgtattcccgactacgttccacgtagactacctaacgttaccgaaacgtaacctaccttacggttnttttacccgtactaaatacgggaactaccggtccgtaacggtaggacccgtacgtaagtacggaaccgtaccggggttacgttagttaacctttacggnggtacccggagtaacggccggtaaggtcccggggaaccctaacggtaaccgttaccgtaccgtagttacggtacggtacccgtagggtaccgggacccggaaggtacccccgg

SEQ ID NO: 183873 - DNA, 732 bp, Homo sapiens
  misc_feature: GYAE6OF02IQ4WO.13.76.G10.1.454.CMB.1.raw
  modified_base (272)..(272): a, c, t, g, unknown or other
  misc_feature (272)..(272): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtggaggaggcttgatccagccgtgggggtccctggacgactctcctgtgcacgcctcgtgggttccacccgtnacgtccacaccctacatgacgcgtcgggcccgccgacggcctaccggagggggacggggcgtggagtcgcgttcttcttttaatttataggtagttggtagtacattacgtccgctacgtacccgtcggtcgggacggggcctacgttccacctatccctaccgaagtaaccgtaacaaacttacccgaaagtaaccgacgttcctttaacggttttactacgaaagttcgaaacctacggtcctaggaacgaccggtaccgtaagttccggaaaccggtacccgggttaccgttaagtttaaacctttccggtaggttaccggaccggaaagtacgggtaccggtacccgggggaaccccttaaaccgggtaaccgttttaccgaaccggttaccgttacggtaacccggggtccgttaccggggtaaccgggggtaccccgtaagggggtaacccccg

SEQ ID NO: 183874 - DNA, 628 bp, Homo sapiens
  misc_feature: GYAE6OF02JB211.13.76.G10.1.454.CMB.1.raw
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
  modified_base (330)..(330): a, c, t, g, unknown or other
  misc_feature (330)..(330): n is a, c, g, or t
  modified_base (348)..(348): a, c, t, g, unknown or other
  misc_feature (348)..(348): n is a, c, g, or t
  modified_base (429)..(429): a, c, t, g, unknown or other
  misc_feature (429)..(429): n is a, c, g, or t
  modified_base (517)..(517): a, c, t, g, unknown or other
  misc_feature (517)..(517): n is a, c, g, or t
tcagtcacgtactacacgaccggtgctcgatttagtcactcatacagggggggaggaggagcccagcactgggattccgaggtgtttccattcggtgatcagcactgaacacagaggactcaccatggagtttggctgagctgggttttcttgtgcttatttaaaggtgcccagtgtgtaggtgcagcgtggtgagtcgtggaggaggcttgaactccgaggccggttcggggggtccctggaacgcgtctcctggngcagtcctcgttggttccacgtcagtcaccgtacctacatgacgctcggtcccncaggccacgaggggacggntcggagtcggcttacttntttttaattagtacgttagtggttaatactaataccgttccgctaaggcttccgggtagcggggaccgttataccgacctntacctcgacgtagacctaaacgttaccaaacgtacacgtcgttatttacgttaacaattagaccagtcctgagacgtacgacgttacncggtaaccgtccgttagtattaccgttgcgtacgagagccggtacgggaccctaaggtactaaccgtagacgttacgtggggtacgtcgtcggggacgaaaccggtcccgg

SEQ ID NO: 183875 - DNA, 641 bp, Homo sapiens
  misc_feature: GYAE6OF02HF20G.13.76.G10.1.454.CMB.1.raw
  modified_base (314)..(314): a, c, t, g, unknown or other
  misc_feature (314)..(314): n is a, c, g, or t
tcagtcacgtactacacgaccggtgctcgatttagtcactcatacaggggggggagaggacgcccagcactgggattccgaggtgtttccattcggtgatcagcactgaacacagaggactcaccatggagttttggctgagcgttgggttttccttgttgacttaatttttaaaaggtcgcccagtgtgaggtgcagcgtggtggagtcgtggaggaggcttgatccagccgtggggggtccctggacgactctccgtgtgcacgcctcgtcggttccaccgtcagtcactacctacatgagctggggtcccnccgaggcctccggaggggaacggggctgggagtcggcgttcttcgttttattagtagtaggtgtagtacatcctcgcagtacctcggtaggacggggtccattcaaccatcctaccagacgactaactaccaacgaaactacgtacttgttactacaagtacaactagccagacgacgaccgtagacgaacccgcgggaccgttagttactttaacgtcggtagtacgaggtacgacggtacggggaccctaaccggttaaccgttaacgtaccgtagttaacggtcggacggttccggtacgggggaccctaaccggggtaaccgg

SEQ ID NO: 183876 - DNA, 805 bp, Homo sapiens
  misc_feature: GYAE6OF02GH9M3.13.76.G10.1.454.CMB.1.raw
  modified_base (222)..(222): a, c, t, g, unknown or other
  misc_feature (222)..(222): n is a, c, g, or t
  modified_base (259)..(259): a, c, t, g, unknown or other
  misc_feature (259)..(259): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
  modified_base (691)..(691): a, c, t, g, unknown or other
  misc_feature (691)..(691): n is a, c, g, or t
tcagtcacgtactacacgaccggtgctcgatttagtcactcatacaggggtctgggagaggagcccagcacgtgggattccgaggtgtttccattcggtgatcagcactgaacacagaggactcaccatggagttttggctgagcgttggttttccttgttgcttaatttaaaggtgccagtgtgaggtgcagcgtggtaggtagtcgtgggaggagcttgntccgagccggtcgggggtccctggagtactctctgtncgacgtcctgtcggtccncgtcagtccacacctacngtgcgtcgtcggtcccgcgaacggccgtaccgggaagggtacggggctgggtacgttcgtacccgtttcgttttaacgtttttaatttacgttaacggttacggttacggttaaacggttaacacgtttacccgacccggtacgtacggttacccggtaccggttaagggggaccccggggtaaccgttacgttaaccccgacttaacccgttaccaccggtaacgaaaccgttaacctaaacgtttaacccggaaacaacccgtacgttaccgttttacgttttaacccgttaaaataacgttaacggtaacctaccgtacgttaacgggacgtaaccggaccgtaagtaccggaccggtaccggttaccgttaaccgttcgttaacccgggttnttaccgggacgttacggaacggtttaccggaccgggtaaccccgtaaacggtttaccgttaaccgtcgtaacccggtagttaccggggacccttacggggtaccggaacccggg

SEQ ID NO: 183877 - DNA, 553 bp, Homo sapiens
  misc_feature: GYAE6OF02F5A1A.13.76.G10.1.454.CMB.1.raw
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
  modified_base (333)..(333): a, c, t, g, unknown or other
  misc_feature (333)..(333): n is a, c, g, or t
tcagtcacgtactacacgaccggtgctcgatttagtcactcatacagggctgggcctcaggaagcagcatcggaggtgccgtcagccatggcatggatccctctcttcctcggcgtccttgcttactgcacaggatccgtccccggctcctatgagctgactcagccaccctcagtgtccgtgtcccccaggaccagacagccagcatcacctgctctggaataatggcagataatatacttcctggtatcagcagaagtcaggccagtccccngtgctggtcatctatcaagatgaccaagcgccctnacgggtactccctagcgcgattcncgtcggctccaactcgtagggactcgagccactctacgaccatacagccggaccaggcctagtcggatgaggtctagactatacgtgtcacgggtcgtcgggactagcagtaccacgtccgtcccgacgtacgtcggtaccgttaccggtaaccgttacgggtaacccgtaacggttcccgtaacccgttaccggtaacggttcccacggtaacccccgg

SEQ ID NO: 183878 - DNA, 714 bp, Homo sapiens
  misc_feature: GYAE6OF02IMAWZ.13.76.G10.1.454.CMB.1.raw
  modified_base (279)..(279): a, c, t, g, unknown or other
  misc_feature (279)..(279): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcttattttaaaaggtgccagtgtgaggtgcagctggtggagtcgtgggaggaggcttgatccacgtccgtcggggggtccctgacgacctctccgtgtcgcagcctcgtggttcaccgtnagtcacacctacatagagcgtcggtccgaccgaggacctaccggaagggggtaaggggccgtggacggtcggtccgtttcgttacttttttaatttacgtagttaggttggtaacgtactactaccgtaccgacacgtacgtccgtagggacggtccgaattccgaacctactctaccgaagtaaggaacctaacgttaacccgaaagaaccctaacggtccttacggttttacctaacgaaaacttacgaaactcgtaccgtaggtacgacggaccgtaataccggacgtaccgggtcgttagttaacgtttacgtagtacggacgtaaggacggtaacggttccgggaaaccctaaacgtaaccggtttaaccgaccgtagttaacgtcggggttaccgtaccggtacgggggacccgtaaaccggggtcccg

SEQ ID NO: 183879 - DNA, 648 bp, Homo sapiens
  misc_feature: GYAE6OF02GC3G7.13.76.G10.1.454.CMB.1.raw
  modified_base (251)..(251): a, c, t, g, unknown or other
  misc_feature (251)..(251): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcngcctcgtgggttccaccgtcacgtcacctacctacatcgagcgttgggtcccgccgacggctaccgaggggaacggggcgtgggagtcggcgttcttcttttattataggttagtggtagtacattacgccgctaagctccgtaggacggggcctattccacctatccctacagagaactaattcccaaagaccacggtcttgtttacttacgaaattcgaaacctgaccctaggaacacggaccgaattcgaccgaaccgggtccgttagtaaactttcgtcgtacggtacgaaggtaccggtaaggttacccgggggaccccttaaacggtaaaccgttttaaccggtacgtaccggttaggttacgggcccgtttacggtcgggggaaccccgg

SEQ ID NO: 183880 - DNA, 933 bp, Homo sapiens
  misc_feature: GYAE6OF02GX8A3.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgcttaatttaaaaggtcgcccagtgtgaggtgcagctgggtggagtcgtgggagggaggtcgtttagacgttccgaacggtccgggttcgggggggtacccctagggaacgtacccgttccttccgttaggttcggacctaacggtccccttacggtttccgggggtttacccaaccccggggttaccaacggttaccgaaaccctaaccttaacgagtacggaacggtccggttacggggtccccgacccgtacgggtcccgttacccgggaagggggggtaccggggtaccggtaggggtaacggttccggtccgggtttacccttttaccgttttttaaaggttttaacggttaacgggttaagggtttacgggttaaacggttaaccgtaccttaaaccgttcccggaccgtaaacgtacccgttccgggttaaggggaccgggggtaccctttaacgtaacccgtaccgtaaaccgttccgtacccgaaggtaaccggtaaactaacgttaaccaaacgtaaactccgtacgtttacgtttacctaacgtaaaagttacgaaaccacgttaaccgtaggaaccgtacgaccggtagttaaccggaccgtaccggtaccgttacgttaactttaaccggtcggtagtaaccgaaggtacgggtaaccggtccggggaaacccttaaacggggtaaaccgttaccgtaacggtacggtaacgttacgggttaaccggttcgggtaacgggtaccccgggaaggttaaccccgg

SEQ ID NO: 183881 - DNA, 747 bp, Homo sapiens
  misc_feature: GYAE6OF02G0F6S.13.76.G10.1.454.CMB.1.raw
  modified_base (171)..(171): a, c, t, g, unknown or other
  misc_feature (171)..(171): n is a, c, g, or t
  modified_base (295)..(295): a, c, t, g, unknown or other
  misc_feature (295)..(295): n is a, c, g, or t
tcagtcacgtactacacgaccggtgctcgatttagtcactcatacagggggggagaggagcccagcactgggattccgaggtgtttccattcagtgatcagcactgaacacagaggactcaccatggagttgggactgagctggattttcctttggcttatttaaaaggtntccagtgtgaagtgcagctggtggagtcgtggggggagcgttggtacagtccgtggcaggtcccctgacgtacctcctccgtgtcggcacgtccctcgtacggtcttcctaccgttttagattntattatcgtaccatgaccgtacggttcgggggtacccgacgtaaccgccgttaccgggaaggggaccgggtccgtgggacgggttcgggtctaacggtaggttagttaggttaggtaaacgtagggtggtacgtactagtaggtacgtagcgggtctacgtgtcggtagggaacgggtaccgtacgttacccgactacgtacgtccgtaacgaacgtaaccgaaaccgtacccgaaaccgtaaccttacccgtacgttactaccgtacgaacctaaacgtacgaaaccgtacgtacccgtagggtaccgtacggcgttaccggaacggtacccggtaccgttaccgtttagtttacttacgttaggtaactaaacgtaaaccgtacccttaacccgttaaccccgttagttttaccggtttacggttacggttacggttacgttaaccgggg

SEQ ID NO: 183882 - DNA, 663 bp, Homo sapiens
  misc_feature: GYAE6OF02HCW13.13.76.G10.1.454.CMB.1.raw
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagtcacgtactacacgaccggtgctcgatttagtcactcatacaggggcgtggggcctcaggaagcagcatcggaggtgctcagccatggcatggatccctctcttcctcggcgtccttgcttactgcacaggatccgtggcctctatgagctgactcagccacctcacgtgtccgtgtccccaggacagacagccagcactcacctgntctaggaaataaattggactanacgtaaatatacttcctggttancgagcaagagtcaggcctacgtccctagtcgctggtctactctaanctagatcggaccaagccgtacctacgagggactcccgtgacncggtatttcacgtggcctacgtaaacgttccgtagggaacccttcgacacccgtataccgtacgacctactcgaacggtaccggaacccgagggtaccttaggtacgggaactcggaacggtactagtaacgttaatttaaccgtggttaccgtaagggtcgttacgggaacgtacggtaccaaacggaccgttaaccgtccgtacccgttacggttaacctgggttaacccggtagggtaacgttaccggggtaacccttaaccgggttacccgtaaacccggttaccctaaacgggttaccgaaccggtaaccccgg

SEQ ID NO: 183883 - DNA, 730 bp, Homo sapiens
  misc_feature: GYAE6OF02G3S2G.13.76.G10.1.454.CMB.1.raw
  modified_base (530)..(530): a, c, t, g, unknown or other
  misc_feature (530)..(530): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtcgtggaggaggctgatccagccgtcggggggtccctggagactctcctgtgcacgcctcgtgggttccaccgtcacgtcaccacctacatgacgtcgtcggggtcccgccgacgggcctcccggaaggggtaacgggggccgtggggagtggtccgttcgtttactttttaatttagtaggttaggttggtagtacgtatacctcccgacacgtaccgttccggtagggtacggggaccctacgttccacctactcctccgaagacgtaactaacttaccgaaacgaacctaccgtcgttacgttttacctaactaacgttacgaaaccncgtaccgtaagacggacggccgaagttacggaaccggtaccgggtccgtttagttaaccgtttacgtcgggtacgtaggaggtacggcggttacccgggggaacccttaaaccgggttaaaccggttaccgtaccggttaacgttacggtaacgggtacccggtacggggtacggggacccgggtaaaccgggtacccgg

SEQ ID NO: 183884 - DNA, 960 bp, Homo sapiens
  misc_feature: GYAE6OF02H9ET9.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggtagttttggctgagcttgggtttttccttgttgcttaattttaaaaggtgcccagtgtgaggtgcagcgtggtggagtcgtgggaggaggtcttgactccgaggtcccggttcggggggttcccctaggacgtacccttccgttcccgtggtcgccgtacggtcccgtttccggttcggggtttcccacccggttaccgtacgttcccaacccgtaacccttaacgtagttacggacggtaccggttccggggtccccgaccgaccgggtcccgttaccgggaaggggggtaccggggtccggtagggtacggttcggtccggttttaccgtttttaccgttttttagtttttaaacgttaacggtttaagggtttacgggtttaaaccgttaaccgtaaccgttacccggttacccgtaccgtaaccgtttaacccggttcccgggtacggggtacccgggggtacccttaacgttccccgaaccctaccgtttacccgtacccgtaagtaaacgtaaacccttaaaccgttaaacccgaaaaccggtaaacccgttaccggttacctttacgttttaaccgttaactaaaacgttacgaaacgtaccgtacgtagaaccggtaccgtaccgtaacgtacggtaccgtaccggttaccgttacgttaaccgtttacgtcggtacggtaccggaagtacggtaccggggttaacccgggcccgttaaacccggttacccggtttaaacccgtaccggttaccggttacggttacccgggttaaccggttacccgggtaaccggggtaaccccgggtaaccggggtaacccccgg

SEQ ID NO: 183885 - DNA, 848 bp, Homo sapiens
  misc_feature: GYAE6OF02H4VC9.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggtactcaccatggacgttttgctgagcttgggttttccttgttgcttaagttttaaaggcgccagttgtgtaggtgcagtcgtggtcggagtcgtagggaggaggtccgttgtacgtccgacggtccgggttaccggggggtccctaggtacggtaccttccttccgtgtcgccgtacgccgttcgttcggttccaccgtcgacgtccaactaccgactagtcgacgtcggtcgggacccgcgtacggtcctacgggaacggggtacgggcgtagggtagtacgggtccgtttaccggtttttaacttttacgttttaaaggtcggtttaacgggttaacggttaacgttaaccgtacgttaacccggtacccgaacgtaaccggttaaccggttcccgggaagggtaacccgggggtaccttaacgttccccgaaacttccgtttacccgaaccggaaggtaaccgttaacgtaaaacccgtttaaccgaaaacggtacccgttacgtaccgtttcgtttaaccctaagttaaacgaaccgtaaagccgtacgtgtaacgacgtacgtaacggtaccgacggtaccggtacccgttagttaaccgttcgtggtaacgcgggttaacgacggacggttacccgggaccttaaccggttaacgtttccgaacgttacggtttacggtacccggttacggttcccgggtacgggtacccgaacgggttaccccgg

SEQ ID NO: 183886 - DNA, 656 bp, Homo sapiens
  misc_feature: GYAE6OF02HC0U4.13.76.G10.1.454.CMB.1.raw
  modified_base (441)..(441): a, c, t, g, unknown or other
  misc_feature (441)..(441): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagtttggctgagctgggttttccttgttgctattttaaaaggtgccagtgtgaggtgcagctggtggagtcgtgggaggaggcttgatccgagccgtggggggtccctggagactctccgtgtgcacgcctcgtgggttcaccgtcagtcacacctacatgagcgtgggtccgcaggctccgagggaagggctggagtgcgttctcttttattatagtagtgtagtacataccgtcgcagtaccgtcggtggacggggtccgtattaccgacctactcctaaccgagaacaacaaacgttaccaaacggaacncgtacttcgtttactaaccaaagtcgaaactacgacgtagaacgacggcccgaagtacgaaccgaccgggtcgttacgttaacgttaccgtggtacgacgaagacggtacggtaccgggggacccctaaacgggtaaccgtttaaccacggttaccgttacggtacgggttaaccggtccgggttacgggggaacccgtaaacggggtaccccgg

SEQ ID NO: 183887 - DNA, 933 bp, Homo sapiens
  misc_feature: GYAE6OF02HNLZO.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagaggactcaccatggtagttttggctgagtcgttgggttttccttgttgtcttaagttttaaaaggtcgccctaggtggtggaggtgcgacggtcgtggggtaggtacggtcgttagggagggaggtcgttggactccgacgggtccgggttcggggggttcccgtggtacgtacttccgttcccgttggtacgccgtacgtcccgttcggttcggggtttaccacccggttaccgtacggtacccaaccgtaacccgttaactacgtaggtacggtccggttaccgggtccccgaccgacggtacccgtaccgggaagggggaacggggtccgtggacggtcgtccggtttacgttttacgtttttaagttaacgttaggttacggttacgggttaacgttacgtaaccgttacgacccggtacgtacggtaccgttcgggacggggtaaccggggaccttcgttaacctacctaaccgttccctaaccgtaaaggtaacgtaaccttaaacggttacccgaaacggtaaccgtacgtttacgtttacgtttaccgtaacgttaaagtaccggtaaaccgtcggttaaccgtgtaaccggaccgtaccggtaaggtaccgtaacccggtaccgggttcgttaacgtttaacgttaaccggtcggtaacgggtacgtaaggtacggggttaccgggtacccggtaaacccggttaaaccggttaaacccggttaacccggtttacgaaccggtttacggtaccggggttaacccgttacgggggaaccccggggttaaaccggtacccgggtaccccggg

SEQ ID NO: 183888 - DNA, 666 bp, Homo sapiens
  misc_feature: GYAE6OF02JMM5I.13.76.G10.1.454.CMB.1.raw
  modified_base (559)..(559): a, c, t, g, unknown or other
  misc_feature (559)..(559): n is a, c, g, or t
  modified_base (608)..(608): a, c, t, g, unknown or other
  misc_feature (608)..(608): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggtttttccttgttgcttaattttaaaaggtgcccagtgtgaggtgcagctggtgagtctggaggagcttgatccagccgtgggggtccctgagactctcctgtgcagcctcgtcgggttccaccggtcacgtccactaacctacatgagtccgtcggggtcccgaccgacggtccgtaccgaaggggaacgggctgggagtcgcgttcttctttttattagtagtaggttggtactacacgtaccgtcgacagtacgtcggtaggacgggcctaacttcgacctagttccgtaccgagacgtactaaacttcccgaaaagaacctacgtcctttcggtttacctacgtaaagttcgaaacgtcgaccgtaggacgccgaccgtagtcgaaccgtccggaacgttgttaacttcgngtacgacgaagagtacgggtacccggacccgtaaacgttaccgtaaccncgtacgttacggtccgggaaccgttcggggtaaccggggtaccgaaaccgggtccccg

SEQ ID NO: 183889 - DNA, 800 bp, Homo sapiens
  misc_feature: GYAE6OF02G23EF.13.76.G10.1.454.CMB.1.raw
  modified_base (171)..(171): a, c, t, g, unknown or other
  misc_feature (171)..(171): n is a, c, g, or t
  modified_base (211)..(211): a, c, t, g, unknown or other
  misc_feature (211)..(211): n is a, c, g, or t
tcagtcacgtactacacgaccggtgctcgattttagtcactcatacaggggctgggcctcaggaagcagcatcggaggtgcctcagccatggcatggatccctctcttcctcggcgtccttgcttactgcacaggactccgtggcctctatgagctgactcacgccacctnagtctccgtcgtcccaggacagacacggccagcactaccnccttgccttacgtaaggtaaaacttaggttacggactaagtaaacttaacttaacttaccgttccgttaggttactacgacgacgtaacggtaacgtaccgacgggaccctaaccggttccccgttagggtcgtccgttggttacctaacgttacgttaactaccgaaggtactaccgacgtaccggacccggtccgtacgacgggtaccttccggtaggacgtcgttactttcgtccgtacggttcctaccgtaacgttacgtaccgggttaacctcccgacgtccctacttacccgtacacgttaccgccggtaccgggacccgggtaacggtacgtacggtacgttacgacggtacggaacgtccgttaacgttaccgttacgttcgtacggttccggtacggttaccgggacggtaccgaaccggtacaccgggtacgtacccgttaccggtacccgttacgttaccggtttccgggtaaccgggtttaaccgggtaccggtttacccggggaaaccccgtttacggtaaccccggttacccgttacccgggttaacccgtacccggaaccccggtaacccccgg

SEQ ID NO: 183890 - DNA, 696 bp, Homo sapiens
  misc_feature: GYAE6OF02JTG50.13.76.G10.1.454.CMB.1.raw
  modified_base (296)..(296): a, c, t, g, unknown or other
  misc_feature (296)..(296): n is a, c, g, or t
  modified_base (455)..(455): a, c, t, g, unknown or other
  misc_feature (455)..(455): n is a, c, g, or t
  modified_base (481)..(481): a, c, t, g, unknown or other
  misc_feature (481)..(481): n is a, c, g, or t
  modified_base (495)..(495): a, c, t, g, unknown or other
  misc_feature (495)..(495): n is a, c, g, or t
tcagtcacgtactacacgaccggtgctcgatttagtcactcatacaggggtctgggagaggagcccagcactgggattccgaggtgttccattcggtgatcagcactgaacacagaggactcaccatggagtttggctgagctgggtttccttgttgctatttaaaggtgcccagtgtgaggtgcagctggtggagtctggaggaggcttgatccagccgtggggggtccctgagactctcctgtgcagcctcgtagggttcaccgtcagtcacacctacatgagcgtcgggtccncgaggtcctacgaggggacgggtcgtggagtcgtcggtcttcgttttacttagtagttagtaggttacgtactacgtacctccgacgtacgtaccgtcggtaggacgggtccgtactccactacttccgtacgaaggtacaacctaattacccggaaanaaaccgtcgtacttagtttaccgaanaaacttcgaaaccncggttccgtaaggacgtacggtacccgtaagttaaccggaccggtaccgggtaccgttagttaaaccttaccgttaggacggaccgtaacggtagggtaccgttaccccgggggacccctaaacgggttaacccgttttaacgggcgttacccgttaaagggtaccgggtaacccggtttacgggaccggggtaaccccgg

SEQ ID NO: 183891 - DNA, 716 bp, Homo sapiens
  misc_feature: GYAE6OF02GPETF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtcgtgggaggaggtcttgactccgagccgtgggggtccctgagactctcctgtcgcagcctcgtggttcaccgtcagtcacacctacatcgagtcgtgggtcccgccgaggcctccggaggggagggcgtggagtcggtcgttctttacgttttatttacgttaggttaggttagggtactacgtaataccgtccgccgacgtaccgtccggtagggacggggtccacttaccgacctactcctccgaagtacgtaactaacttaaccgaaacgtaaccgtacgtcgtttacgtttaccctaactaaacgttacgaacgtacggtccagtaccggaacggccgtagtaccggtaacccgtccgggttaccggttaacgtttacgttacgtacggtaacggaccggtaggacggtaacgggtccggggtaacccctaaacggttaaccggttaacctaccggtacttaggttaccgggaccggttccggtaccggggacccgtaacgggtacccccgg

SEQ ID NO: 183892 - DNA, 635 bp, Homo sapiens
  misc_feature: GYAE6OF02FSKGF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctgggtggagtctggaggaggcttgatccagccgtggggggtccctgagactctcctgtgcagcctcgtggttccaccgtcagtcacacctacatgagctcgggtccgccgaggcctccgaggggaacgggctgggagtgcgtcttcttttattatagtagtggtagtactatacctccgcgtacgactcggtggacggggtccgtattccaccgtactcctaccgaggacgaacctaattacccgaaagaaccacgtccttacgtttactacaaattcgaaactgtcctagacgacgccgatacggaccgacgggtccttagtaacttcgtgtcgacgtaggagtacggtccggggaccccaacgggttaaccgttaccgtaaccggtcctttaacggtcgggtaaccgttccgggtacgggggtaccccgaaaggggtaccccg

SEQ ID NO: 183893 - DNA, 682 bp, Homo sapiens
  misc_feature: GYAE6OF02G86LC.13.76.G10.1.454.CMB.1.raw
  modified_base (580)..(580): a, c, t, g, unknown or other
  misc_feature (580)..(580): n is a, c, g, or t
tcagtcacgtactacacgaccggtgctcgatttagtcactcatacagggggggaggaggacgcccagcactgggattccgaggtgtttccattcggtgatcagcactgaacacagaggactcaccatggtagttttggctgagcttgggttttccttgttgcttaattttaaaaggtgccagtgtgaggtgcagctgggtggagtcgtgggagggaggtcttgactccagccggtcggggggtccctggacgactcctcctgtcgcacgtcctcgttcgggttccaccgtcagtaccaccacctacatgagtcgtcgggtccgccgaggcctacggagggggaacggggtcgtagggaggtcggcgttctttctttttaatttagttaggtaggttggtaagtactactaccgtccgcacgtaccgtccgggtgggacggggccgtacttccaacctactcctaccgaagtactaacctaacttaccgaaagtaaccacgtcttcgtttacctaacaaattcgaaactcgcctagacgaccgccgaagaccgaccgccgggtacgttattacgtttacgngtaggacgtaggagtacgggtccgggaaccctaacggtaaccgttaccgacgtagtacggttccgggtacgttccggggacggggacccgaaggggtacccg

SEQ ID NO: 183894 - DNA, 781 bp, Homo sapiens
  misc_feature: GYAE6OF02FG7VY.13.76.G10.1.454.CMB.1.raw
  modified_base (328)..(328): a, c, t, g, unknown or other
  misc_feature (328)..(328): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagctgggttttccttgttgcttattttaaaggtgcccagtgtgaggtgcgagcgtggtggagtctggaggagggtcttggactccgacgtccggtggggggtccctggacgtaccgtctcctgtcgccgacgccttcgtcgggttccaccggtcacgtacacctaacctacatcgagagtcgggtcccnccgacggtccgtaccggaggggaacggggtctagggaggtcgcgttctttcgtttttaagttagttaggttagttacggtagtactacttaccgtccgactaagtacccgtaccggttagggaaccggggtccgttaacttacccgacctaacgtcccgttaccaaaggaccggtaaactaaaccgttaccccgaaaagggaaccctaaccggttaccgttttacggttttacctaaaccgtaaagttacgaaaaccctggtaccctaaagaacggtacgtacccgaagtaccggaacctaccgggggttccttaaggtaacttttacgcggttacggacgaacggacggtacgggtcccggggtaacccttaaacgggtaaccgttaccggtacgtacgtacggttccgggtaccttacggggacccggggttacgaaccggggtaaccccg

SEQ ID NO: 183895 - DNA, 675 bp, Homo sapiens
  misc_feature: GYAE6OF02FOD9K.13.76.G10.1.454.CMB.1.raw
  modified_base (299)..(299): a, c, t, g, unknown or other
  misc_feature (299)..(299): n is a, c, g, or t
  modified_base (569)..(569): a, c, t, g, unknown or other
  misc_feature (569)..(569): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgcttattttaaaaggtgcccagtgtgaggtgcagctggtaggagtctggtaggaggcttgatccgagccgtggggggtccctggacgtacgtcgtccgtgtcgcagcctctggggtccaccggtcagtccactaccgtanatgagtccggtcgggtccgaccggacgtccgacgggacggggacgggcgtagggcgtacggtcgttctttacttttagttagtaggttggttaggttactatacgtccgtcgacgtacgtccgtcggtagggacgggtacgtacgtaccacgttcgtcctacggagtaaccgtaactaccttaaccgaaagacccaccttcgtttcgttaccaaagtaggtaacacgcgtaccgtaggaagtccgagtacgacgtacggtccgtacgttntaacgttcgacgtcgggagtaggacggtccgggtacccggaccgtaacggttaaccgtaccgacgttacggtacggtaggtacccggtcgggtacccggaaccggg

SEQ ID NO: 183896 - DNA, 706 bp, Homo sapiens
  misc_feature: GYAE6OF02GPRXN.13.76.G10.1.454.CMB.1.raw
  modified_base (279)..(279): a, c, t, g, unknown or other
  misc_feature (279)..(279): n is a, c, g, or t
  modified_base (326)..(326): a, c, t, g, unknown or other
  misc_feature (326)..(326): n is a, c, g, or t
  modified_base (337)..(337): a, c, t, g, unknown or other
  misc_feature (337)..(337): n is a, c, g, or t
  modified_base (460)..(460): a, c, t, g, unknown or other
  misc_feature (460)..(460): n is a, c, g, or t
  modified_base (478)..(478): a, c, t, g, unknown or other
  misc_feature (478)..(478): n is a, c, g, or t
  modified_base (486)..(486): a, c, t, g, unknown or other
  misc_feature (486)..(486): n is a, c, g, or t
  modified_base (517)..(517): a, c, t, g, unknown or other
  misc_feature (517)..(517): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttgctgagcgttgggttttccttgttgtcttaaagttttaaaaggtcgccctaggtgtgaggtgcagtcgtggtggagtcgtggaggaggtcttggactccgaggtccggtggggggtccctggacgaccgtccttccgtgtcgacncgtccctcgttcgggttccaccgtcacgtaccactacctacagtcgnggcgtcggccncgacgccgtcggaaggggaggtcgaggtacgtcgtcgttcttacgttttattagttagtaggtagtatactacgtactcgactacgtacgtcggtacggaccgggctacttcactctcacganaacgactaactacgaaanaccgcgtnttcttacaagtaatcgaactcgactacgganaaccgcgattcggaaccggttccgtacggttttacgtaacgtttacgtggtaacggaccggtaagacggggttaacgggaacccgggtaaccctaaaccgggttacccggttaaagttaccgggtaaccgttaagttccggggtaaccccgttggggaacccgggggaaccgtacccgggtaaccccgg

SEQ ID NO: 183897 - DNA, 886 bp, Homo sapiens
  misc_feature: GYAE6OF02HNVKV.13.76.G10.1.454.CMB.1.raw
  modified_base (142)..(142): a, c, t, g, unknown or other
  misc_feature (142)..(142): n is a, c, g, or t
  modified_base (174)..(174): a, c, t, g, unknown or other
  misc_feature (174)..(174): n is a, c, g, or t
  modified_base (719)..(719): a, c, t, g, unknown or other
  misc_feature (719)..(719): n is a, c, g, or t
tcagtcacgtactacacgaccggtgctcgatttagtcactcatacaggggtgggcctcaggaagcagcatcggaggtgcctcagccatggcatggatccctctcttccgtcggcgtccttgcttacgtgcactaggactcgnggcctcctatgagctgactcacgcccaccctnacgtcgtacccgttacgaccccaaggaccacggtacacgacccagtacctaactccaccttggacccttacgtaaaagggtaaaacgttaacgttacgggaccaaaggttaaattaaactactttaccgtttaccggtaggttaacctaggaacgtacgtaaacggtacgttaccgacggggtacccttacggtccccgtagtccgtccgtgtactacgttacgtactaacgtaacgtacgtacgtaacccggacggtcccgtaccccgtaagggtacccggggtaccccttcccggaaggtactaaccggtttcctttccgtccgtttaaacggcctaaccggtttaaccggcgtttaaccggaaccttaacgccgtaaccctaacgtttcccggaaatacccctaaaggttcgaccgggggaacccgtaacgtaccggttaactacgttaccgggattgggtacccgttataacgttaacgttcgttaaacgtccgggtaaccgtccgggtacggtagaaccgggtactacggtaaacccggntaaccccggggtaccctacgggtttaccgtaaaccgggtttccggttttaacccggcggggttaaaccgttaaccccggggtaacccgtaaaggtttaccccgggaccccggtttttaaccgaaaacggtttacccccgaacggggtaccccctaaaaccccggggg

SEQ ID NO: 183898 - DNA, 832 bp, Homo sapiens
  misc_feature: GYAE6OF02IVPUA.13.76.G10.1.454.CMB.1.raw
tcagtcacgtactacacgaccggtgctcgatttagtcactcatacagggggtgagaggagcccagcactgggattccgaggtgtttccattcggtgatcagcactgaacacagaggactcaccatggaatttcggggactgagctggggtgtccttcctttgttgacttattttaggaagggtggccagtgtgagatgcgacgtggtaggagtcgtgggggaggtctttggtaccgcgggccggggggtcacgtgagaccttcctcctagtacacgcctacgagactttactaatttttcgaaggttaatttagttggattggtaggtttcgggtcccgaccgtagtccgttaccggagggggtaaggggccgttagggtagggtgggtaccggacccgaaacggtagttaaaacgggtaggaggttacgggacggttacgtaacggtaactaagtttaagtttaggttacgggttagggtacttccggttggggtaccggggtcccggggggcccgtttaaccgttttacccgtaaccgtttaaccggtttttacccggaacgggtaacccggttaaaccggaaacccggtcccggtaacggtaccgtttaacccgggttacctaacggtttaaccgttacgttacggtacgtaactaaacggtagggtacgggaaccgtacccgttaggaaacgtaccgttacggagttaccggtaacgtaaccggttactacgttaattacgttagtttcggaggttaccggaagttaaccgttggtaaccgttttacgttccggtaagtaccggtaccggttacgttacgggttacgg

SEQ ID NO: 183899 - DNA, 884 bp, Homo sapiens
  misc_feature: GYAE6OF02GW7IH.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctggttttccttgttgcttaattttaaaaggtcgcccagtgtgaggtgcagcgtgggtggagttcgtaggaggagggtcttagtaatcctacggtccggttacgggggggtcccctggacgtacctccttccgtggtacgcgacgcccttcgttcgggttaccgtacccggtctacgtaccgaacctaccctaactaagtgtacggtcgtacgggtccccggacgtacgccgtaccggaaggggaacggggtcgtagggacggtcgtaccggttcttttacgtttttaacgttttaagtaggttaaggttagggttacgtaactacgtaaccgtacccgtacgtaacggtacccgttacgggtacgggtaccgggggtaacccgtaacgttaccccgaaacccgttaaccgttaccccgttaaccgaacggtaaaaccgtaccctttaaaaaccgttaccccggaaaaaacgttaaccccgtaaacggtttccgttttaacggtttttaacccttaaataaaccggttaacgaaaccgttaccggtaccgttaacgggaacggtaaccggtacggtaacgtccgggaacccgtaccggggtacgtttacgtttaacggtaaccgttggaacccgaggtaagaggttaaccggcgggtaaaccctaaccggtaaacggtttacctaacggagttaccgtaccggggttacgtcggggttaacccgggaaccgtaccggtacccgg

SEQ ID NO: 183900 - DNA, 727 bp, Homo sapiens
  misc_feature: GYAE6OF02G2NL8.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagctgggttttccttgttgcttattttaaaaggtgcccagtgtgaggtgcagctggtggagtcgtggaggaggtcttgatccgagccggtcggggggtccctgacgacctcctcctgtcgcacgcctcgtcgggttccaccgtcacgtccaccacctacatgagtcgtcgggtcccgccgaggccgtaccggaggggacgggcgtgggaggtcggtcgttctttacgttttatttagtaggttaggtaggttaacgtactacgtaccgtccgacacggtaccgtccgggtagggtacggggtaccgtacgttaccgaccctacgttcccgtaccgaagtaacgtaacctaacgttacccgaaaacgacctaccgtctttacgtttacctaaacaaagttacggaacctcggtccgtaggaaccgaccggtccgaacgtacggaacccgtaccgggttccgttaagttacttacggtcgacgacggagtacggtacgggtcccggggaacccctaacggttaaccgttacgaccggtacgtacggtcggtacccggttccgggtaccgggggacctacgggtaccccgg

SEQ ID NO: 183901 - DNA, 752 bp, Homo sapiens
  misc_feature: GYAE6OF02GGCAS.13.76.G10.1.454.CMB.1.raw
  modified_base (286)..(286): a, c, t, g, unknown or other
  misc_feature (286)..(286): n is a, c, g, or t
  modified_base (428)..(428): a, c, t, g, unknown or other
  misc_feature (428)..(428): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgctttactgcacgaggactccgtcggcctcctatgagctgactcagcccaccctcagtcgtccgtcgtaccccgaggacagacacgaccagccataccacctgcttacgtaagaaaattaagtcggacagaataactagttacttctggtatcgaagcagacgtcnggacccacgttccctggtcgtcttacggtctactactactacgaagactcgacccgaaggtcccgtacccgtagacggaccttcccgtaggactccttacgtcgtcgtacgtcctacgtaacccgttcggaccggttaaacnccgaccgtacctactacccgtagtaaccctacgtaccggaacggtaccccggaaccggtacggtaaccgttagtaacgggttccgtaacgggtacgtaccggttaacgttaaacgtttaacggttacggtacgttaccgggacggtttaccggggtaacgggaccttaacggggactacccggtacggaaccgtcccgtacccgttaggtttaccggttacgtacccgggtttaaccgggaaaccggttcccggtaaaccggtaccggttttaacccggaacccgttaacggttaacccggtaccggaaccccggtaaccccgg

SEQ ID NO: 183902 - DNA, 730 bp, Homo sapiens
  misc_feature: GYAE6OF02HJJHH.13.76.G10.1.454.CMB.1.raw
  modified_base (259)..(259): a, c, t, g, unknown or other
  misc_feature (259)..(259): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagcccaccctcagtcgtccgtgtccccaggacagacagccagcatcacctgctctaggaaataattggacagaataaatatacttcctaggtatagngcaagagtcacgccacgtccccgtagtcgcgtggtacacttctatacgaagtactcggaccaacggtccggaccccttacggaacgggtactcccgtaggacgtaccgttacgttcgtaccgttcggtaccctaccgtaaccgtccggtacgggtaaccctacgaccgtaccctacgttaccgtaccgaaaccgttacgtaccgacggggtacccggaaacccgtacgggaccttacggtacgggtacgtacgggacggtaccgtaacgtacctttaacgttcgtacgttaccggtaccgggtacgggttaacgggacctaaccgggacgacggtacccgtaccgtcccggaccccgttacgttaccggttccggttaaccggtttacgggtaacccggtaacgggtaacccggtaaccggttcccgtaaccggttacccggtaacgttacccggaacccgtaaccccggg

SEQ ID NO: 183903 - DNA, 815 bp, Homo sapiens
  misc_feature: GYAE6OF02HB9G7.13.76.G10.1.454.CMB.1.raw
  modified_base (219)..(219): a, c, t, g, unknown or other
  misc_feature (219)..(219): n is a, c, g, or t
  modified_base (423)..(423): a, c, t, g, unknown or other
  misc_feature (423)..(423): n is a, c, g, or t
tcagtcacgtactacacgaccggtgctcgatttagtcactcatacaggggggtaggaggagcccagcactgggattccgaggtgtttccattcggtgatcagcactgaacacacgaggactccaccatggagttttcggctgagctgggttttccttgttgcttattttaaaggtgccctagtgtgaggtgcagtctggtggagtctggaggagtctgntccagccgtgggggtccctgcgactctccgtgtgcacgcctcgtgggtcctaccgtctacgtccactaccctacacgtgacgtcgtcgggtcccgccgagggcctaccggtaagggggaacggggtccgttagggaacggttcggtacgtttctttccgtttttaattttaacgtacggttagggttaacggtacgttaaccgngttaacccgtccggacgtaacggtaaccgttcccggtagggtaccgggggtaccctagtttacccaacccgtacgttccgtaacccgaacgaaccgtaaccttaaacgttaccgaaaacggaaccctacggttaccgtttaaggttttacccttaaccgaaaagttacgtaaccgtacgtcgtaacgtacggtacgtacccggtaagttaccggacccgtaccggtcggttaaccggttaatttacccggtaggttacggacggtacggtacggtaccggtaaccgggggtaccccctaaacgggttaaccccggttacttacccggtacgtttaacggtacgggtacccggttaccgggtaccgggggtaaccccaaccggggtacccccg

SEQ ID NO: 183904 - DNA, 824 bp, Homo sapiens
  misc_feature: GYAE6OF02IB2Y0.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccatggagttttggctgagcttgggtttttccttgttgcttaattttaaaaggtgcccagtgtgaggtgcgagcgtggtggagtcgtgggagggaggtcgttggatccgaggtccggttcggggggtcccctggacgacctccgtcctggtcgcgacgtccgtcgttcgggttccaccggtctacgtaccacctacctacagtacgacgtccgtcgggtcccgaccgacggtctaccggaaggggtaacggggtcgtaggggtagtcggtcgttcctttagtttttaagtttaagttaggtaggttaggttacgtaacgtacttaccgtaccgacgtaacgtaccgttcggtagggacggggtacccgtaactttacccgaacctacttcccgtaccgaaggtaacgtaaccgttaaacttaacccgaaaacgaacccgtaccggttacgtttacgttttacccgttaacaaacggttaccgtaaaccgacgttacccgtaaggaccggtaacggtacccgtaagtaccgggaaccccggtaccgggttacccggtttaggttaaactttaccgggttatacgggacgtaacgggtacgtaaccggggttaccgggaacccccttaacggtaaaccgttaaccgttaccggtacgttaacggtcgggttaacccgggttacggaccggggtaaccccggg

SEQ ID NO: 183905 - DNA, 1003 bp, Homo sapiens
  misc_feature: GYAE6OF02HD2XF.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttggttttccttgttgtctattttaaaaggtgcccagtgtgaggtgcagcgtggtggagtcgtggaggaggtcttgatccgagccggtgggggtccctggacgtacctcctcctggtgccgagtcctcgtgggttcctaccgtcacgtcaccacctacagtgacgtcgtcgggtcccgaccgacgggtccgtaccggaagggggtacggggtcggtacggggtacggttcggtccggtttaccgtttacgttttttaagttttaaggttaacggtttagggttacgggtttaacgtaaccgtaaccgttaacccgtaccggtaaccgtaaccgggtaaacccggttacccggggtacggggtaaccgggggtaccccgttaaaccgtttaccccgtaaaccccgttaaccgtttaccccgtaacccgtaaacgggtaaaccggtaaacccttaaaaaccgttttaacccccgaaaaacggggtaaaccccttacccgggtttaaccgttttaccggttttttaaaccctaaacccggtaaaaaacgtttcccgggtaaaaaaccgtccgggttacccgtttaaaggggaaccggttaaacccgggtaaccccggttaggttaaaacccccggaacccgggggtttaaccccgggttacccgggttttttaaacgttaaaaccggtttttaccggtcggggttaaacggaccgggtaaagggaacgggttacccggggtaacccgggggtaacccttaaacccgggttaaccgtttaaacccgttacggtaaccgttttacgggtacccgggttaccgggttaccggggtaacgggggtaaccccgtaagggggtaacccccg

SEQ ID NO: 183906 - DNA, 819 bp, Homo sapiens
  misc_feature: GYAE6OF02J1B50.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagtttgggctgagctggtattttcctcgctgctatttaaaggtgtccagtgtcgaggtgcaagtggtggtacgtcgggtgggggtcttaggtacgtccgggtcggggtcctaggacgtaccgtccgtccgtggtacgcgtaccgtccgttcggttcggtaccgtaccgttagtcgtaccacctaccgtagtagtacggacgtacggtcgggtacccgacgtacggtccgtaaccgggtaacggggacgggtcgtaggtcggtcggttccgtttacgttttagttttaacgtttacggtaggtttaccggttacggttaacgtaacgtacgttacccgtacgacgttacggtaccgttcgggtacgggaccgggtacctacgtaccgtacccttacgtacccgtacggaacgtaccgtaaccaaccgtttaccggaacctaacgtacgttccgttattaccgtaactaagtaccgaactccggaatcggtaacgccgtaacgtacgtacgtaccgacggtttacgtaacgtttaccaggtttaccggcgtaacggtaacggtcgtaaccgggtcccgtaacgtacggtttaaacccgtcgtaaccggttgtaaacccgggtttccgggaaccggttaccggggtaaccgggtacccggaaacggtccccggttaacccgggtcttaaccccgg

SEQ ID NO: 183907 - DNA, 679 bp, Homo sapiens
  misc_feature: GYAE6OF02HLAEH.13.76.G10.1.454.CMB.1.raw
  modified_base (280)..(280): a, c, t, g, unknown or other
  misc_feature (280)..(280): n is a, c, g, or t
  modified_base (403)..(403): a, c, t, g, unknown or other
  misc_feature (403)..(403): n is a, c, g, or t
  modified_base (431)..(431): a, c, t, g, unknown or other
  misc_feature (431)..(431): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtgagtctggaggaggcttgatcagccgtgggggtcctgagactctcctgtgcagcctctcgggttcaccgtcagtcacacctanagtcgagcgtcgggtcccgccgacggtcctacggagggggaacgggccgtgggagtcgcgttcttacttttagttagtagttgtgtagtacagtcctcgcagtctcgtgacgggctatcactntcctacgagacactaattccaaagaacncgtctttcgttacttacgagtaatcgaaaccgtcgacccgttaggaaccgtacggaccaacggtcgaaaccggtccgggttaaccgttgttaaacgtttacgtcggtacgggtaaccgtagggtaacgggtaacgggtttacccgggggaaaccccgtaaccgggttaaacccggtttttaaccggtaccggtaaccgtttaagggggttaccggggtacccgggttacgggttaacccccggggggg

SEQ ID NO: 183908 - DNA, 692 bp, Homo sapiens
  misc_feature: GYAE6OF02H7N4Y.13.76.G10.1.454.CMB.1.raw
  modified_base (652)..(652): a, c, t, g, unknown or other
  misc_feature (652)..(652): n is a, c, g, or t
tcagtcacgtactacacgaccggtgctcgattttagtcactcatacaggggggagaggagcccagcactgggattccgaggtgtttccattcggtgatcagcactgaacacagaggactcaccatggagtttggctgagcttgggtttttccttggttgctaattttaaaaggtgcccagtgtgaggtgcagctggtggagtcgtggaggaggcttgactccgagccgttcggggggtccctaggagtctcctccgtgtgccgacgccgttcgttcggggttaccacccggttcacggttaccacctaaccgtacagtcgaggtcgtcggtacccgccgacggtccgtaccggaggggaagggcgtaggacgtcgtcgttcttttacttttatttagtaggttagtagttaagaactacgtacctccgacacgtaccgtcggtagggccggggtactactcaacctcttaccgacgacgaacgaccttaacttaaccgaaacgaacgtcgtacttcgtttactaacgtaaagttcgaaactacgaccgtagaacggacctacggtaacgtacgacccgtacgggtaccgttagttaacttcggcggttgacgagtacggcggtaccgggacctaacgtacgttaacgtacgngtacggtacggtcgtacgggacggtaccggaagtacccgg

SEQ ID NO: 183909 - DNA, 691 bp, Homo sapiens
  misc_feature: GYAE6OF02G3MV5.13.76.G10.1.454.CMB.1.raw
tcagtcacgtactacacgaccggtgctcgatttagtcactcatacaggggggggagaggagcccagcactgggattccgaggtgtttccattcggtgatcagcactgaacacagagactcaccatggagttttggctgagcttgggttttccttgttgcttaagttttaaaaggtcgccctagtgtagaggtgcagcgtgggtggagtcgtgggaggaggtcttagactccacggtccggtcggggggtccctagagacctcttcctgtagccacgtccgttcgtcggttccaccgttcacgtcctactacctacatgacgtcggtcggtcccgtaccgagtcccgtacggaggggaacgggctggggagttcgcgtttactttacttttatttagtagttaggtaggtactactacgtacctcgacgacgtccgtcggtaggaccggggactacttccacgtacctccgtacgaagtacgtaactaactacgaaagtaccacgttctttacgttacctaacgaattacggaaacctccgaccttaagacgaccgtcgacgttacggaacccgtacggttccgtaagtttacttcggtagtccggagagtacgtcgggacccggtacccaaaggtacccgttacgaacgtcgtaggtcggtacccgtcggggaaccgggcaaacgggcccg

SEQ ID NO: 183910 - DNA, 649 bp, Homo sapiens
  misc_feature: GYAE6OF02F6WCB.13.76.G10.1.454.CMB.1.raw
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (463)..(463): a, c, t, g, unknown or other
  misc_feature (463)..(463): n is a, c, g, or t
  modified_base (555)..(555): a, c, t, g, unknown or other
  misc_feature (555)..(555): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagcgtggtggagtctgggaggaggtcttgatccagccggtggggggtccctgacgactctccgtgtcgcacgccttcgtcgggttccaccgtcacgtccacacctacatcgagtcgtcgggtccgccaggcctcgaggggaggggctgggagtcgtcgtcttcttttattatagtgtggtacgtacatacnccgntacgtaccgtcggtacggacgggcctacgtttaccgacctacgtcctacgacgaactactaacttaccaaacggtaaccnccggtactttcgtttacgtactaaagtacaactacgccctagacgcgaccgacgtacgaccgtacgggtcctagttacttctggtcgagagnggacggtcggggaaccctaacggtaacgttacccgtagtaccgttacggtacgggtaccgttacggggtaccgggacgggtaccggtaaccccg

SEQ ID NO: 183911 - DNA, 707 bp, Homo sapiens
  misc_feature: GYAE6OF02JKTXC.13.76.G10.1.454.CMB.1.raw
  modified_base (420)..(420): a, c, t, g, unknown or other
  misc_feature (420)..(420): n is a, c, g, or t
  modified_base (544)..(544): a, c, t, g, unknown or other
  misc_feature (544)..(544): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgcccagtgtgaggtgcagctggtggagtcgtggaggaggcttggatccagccgtggggggtccctggagacgtcctccgtgtcgcacgccttacgtggttccacgtccaggtccaccaccgtacatgacgtcgtgggtcccacgtacggtcctaccggtaaggggaacgggccgtagggtacggtagccggtttacttcgtttttaacttagtaacgttaggttaggtacgttaacacgttaccgccganacggtaccgtcgtacgggacggggtacctaattccgaagctttaccaccgaggaactaaccgaagttacccgaaacgtaccgaccgtatttacgtttaccctactaaagttacaaaccggttanaccgtagaaccgagaccgtaagtccggaaccgacggttaccgttgtaaattccgtacggagacgaagtaggtaccgtacggggaaccctaacggaacgttaaccgacgttaccggacgttacggacccggttaggaaccgggtaccggtaaacggtaacccgg

SEQ ID NO: 183912 - DNA, 648 bp, Homo sapiens
  misc_feature: GYAE6OF02GFA1W.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtcgggttcaccgtcagtcacacctacatgagcgtgggtcccgccgagggcctacccggaggggaacggggcgtgggagtggccgttcttctttttaatttagtaggttagtggtagtaacattaccgtccgcaagtacctcggtggacggggcctattccaccactcctccgagacaactaacttaccgaaagaaccacgtcttcgtttcctacgaaattcgaaactgcctagagacggccgatcggaaccgccgggtaccgttcgtaactttaacgtgtagacgaaggtacgacggttccggggacccctaaacggttaaccgttaacgaaccgtcgttaaggtaccgggtaccggttaccggacgggggaacccctaaggggtacccccgg

SEQ ID NO: 183913 - DNA, 636 bp, Homo sapiens
  misc_feature: GYAE6OF02F0GRW.13.76.G10.1.454.CMB.1.raw
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (526)..(526): a, c, t, g, unknown or other
  misc_feature (526)..(526): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctgggtggagtctgggaggaggcttgatccagccgtcggggggtccctgagaccttctcctgtcgcacgcctcgtgggttccaccgtcgatccactacctacatgagcgtcgggtccncgaggcctccggaggggagggctggagtgcgtnttacttttattatagtagtggtatactactactccgcacgacctcgtgggacgggtcctagtccacactccgtaccaagacgtaacctaattaccaaagacctactcttacgtttactactaaagtcgaactagccgtagacgacgtaccgagtacgaccgtacggtccttaggtaactttcggnggtacggaccggagtacggcgggtaccgggaacccgtaaccggttaacttaaccgtacgtacgttaggtaccgggtaccgtcgggtaacgggaccggaaccggtacccgg

SEQ ID NO: 183914 - DNA, 1013 bp, Homo sapiens
  misc_feature: GYAE6OF02HG92D.13.76.G10.1.454.CMB.1.raw
tcagtcacgtactacacgaccggtgctcgatttagtcactcatacaggggggggagaggagcccagcactgggattccgaggtgttccattcggtgatcagcactgaacacagaggactccaccatggtagtttggctgagcgttgggttttccttgttgacttaagttttaaaagggtcgacccgaggtgtggaggtgcagtcgtggtggagtgtggaggaggtcttagactccgacggtccggtcggggggtccccgtaggtacgtaccgttccgttcccgtggttcgccgacgtcccgttccggttcggggttaccctacccggttacctacggtaccctaaccgtaacccttaaccgaagttcggaacgtcgggttccgggtccccgtacccggaacggtccccgtaaccggggaaacgggggtaacggggaccggtacgggtacggttccgggtaccccgtttgtttttaaccgtttttttaagttttaaggttaacggggtttaaggttacggggttttaaacggttaacccgttaacgttaaccccggtaccccggttaaccgtaacgggttaacccggttcccgggtacggggttacccggggggtacccctttaaacggtttaacccctaacccgttaacctttaccccggtaaccgtaacggtaaaaccggttaaacccttaaaaccgttttaaacccccgaaaacggttaaacccgtaaacccggttttccgtttaaccggttttaacccttaaaaccgttaaacgttaaaccgtaacccgttaaccgtaacccgtaagggtaccgtacggacccgtagtacccggaaccgtacccgggtacgtttaccgttaaacgttccgttggtaacggtcgttaacggaccggttacgggtaccccgggtaaccccgtaaccggttaaaccttaccggtaaccggtaaccgttcggtacgggtacccggttaccgggacgggtaccccgggtaacggtaacccccggg

SEQ ID NO: 183915 - DNA, 660 bp, Homo sapiens
  misc_feature: GYAE6OF02HGS7R.13.76.G10.1.454.CMB.1.raw
  modified_base (294)..(294): a, c, t, g, unknown or other
  misc_feature (294)..(294): n is a, c, g, or t
  modified_base (511)..(511): a, c, t, g, unknown or other
  misc_feature (511)..(511): n is a, c, g, or t
tcagtcacgtactacacgaccggtgctcgatttagtcactcatacaggggtgggagaggagcccagcactgggattccgaggtgtttccattcggtgatcagcactgacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctgtcggttcacggtcagtcacacctacatgagcgtcggtccncgacggcctcgaggggacgggcgtggtagtcgtctctttcttttatttagtaggttaggttaggttaacgtactaacttaccgtccgacgtacgtaccgttccgggtacggacgggggtcccgtagttaccacctacgtcctaccgagtaacgaaccttaagttaacccaaagaacctacggttccttttaagtttcctaaagtaaacttagaaccncggtacctaggacgtacgccgtaagtcgaaccggcggttacgttattaagtttcgagtcgacggagagtaccggtccgggaacccaggttaacccgttgacctacggttagtccgggttcggacgggttaccggggacgtaacccgggg

SEQ ID NO: 183916 - DNA, 747 bp, Homo sapiens
  misc_feature: GYAE6OF02FHWMA.13.76.G10.1.454.CMB.1.raw
  modified_base (315)..(315): a, c, t, g, unknown or other
  misc_feature (315)..(315): n is a, c, g, or t
tcagtcacgtactacacgaccggtgctcgatttagtcactcatacagggggggaagcctgggaacacttagccttcatgagtgtccccaccatggcctggatgatgcttctcctcggactccttgcttatggatcaggagtggatttctcagactggtggtgacccaggacgccatcgttctcagtgtctccgtgggaggacagtcacactcacttgtgcttagagagtacggctcagtctctagtacttaccacccagctgtaccaacacgacccaggccaggcctccgcgcacgctcatctacaacacaaacnctcgctctcgtcggtcctctatcgtcttctcgtcgtctcctacttccgtagggtaaccaaacgtccgtaccgttaccctttataccgtacgttaccgggacccgggggtaccccaacgggaccgtaaaggaacggtaacgttacgtaaacttaccgtagttaacttttaactttaccgtttcgttttacggtttttacttttaacggttaaggtttacgggggttacgttccgttaacccttttaaggtttttccgtacggtttccggtttagggtttccgggtttacggggaaccgggttaccggacccgggtaccccgggttccggttacccggttacccccgggtttccccggttaccgggtaacccgtacccgggtaccccggtaaccgggttcccgtaccccggtacccccgttcgtttacccccgg

SEQ ID NO: 183917 - DNA, 567 bp, Homo sapiens
  misc_feature: GYAE6OF02HJ4Z1.13.76.G10.1.454.CMB.1.raw
  modified_base (301)..(301): a, c, t, g, unknown or other
  misc_feature (301)..(301): n is a, c, g, or t
  modified_base (399)..(399): a, c, t, g, unknown or other
  misc_feature (399)..(399): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
tcagtcacgtactacacgaccggtgctcgatttagtcactcatacaggggtgggagaggagcccagcactgggattccgaggtgtttccattcggtgatcagcactgaacacagaggactcaccatggagttttggctgagcgtgggtttttccttgttgcttattttaaaaggtgcccagtgtgaggtgcagctggtggagtctggaggaggcttgatccgagccgtggggggtccctgacgactcctcctgtgcagcctcgtggttcaccgtcagcacacctacatgagcgtgggtccncgacggccaccgaggggagggctggagtgtccgttcttacttttattagtagttagtggtatacatacgtccagacactcgtggacggtcacgtcacnctcacagacactaatccgaaagacncgtacttgtttcanaatacgaancgactaggacncgccaagtcgacgacggtacttagttactcgtgacgagagagtcgggtacggacccaaggtaccgttacgactcgtacgccgggtacggtcggtacgggacctaacggg

SEQ ID NO: 183918 - DNA, 801 bp, Homo sapiens
  misc_feature: GYAE6OF02IPY6K.13.76.G10.1.454.CMB.1.raw
tcagtcacgtactacacgaccggtgctcgatttagtcactcatacaggggctgggcctcaggaagcagcatcggaggtgcctcagccatggcatggataccctctcttcctcggcgtccttgcttactgcacaggatccgtggcctcctatgagctgactcacgccaccctcagtgtcccgtcgtccccaggacagacacgaccagccaactccacctgcctctagggtaaaacttaaacgttgggacctaagtaaacgttaaaacttacgtttaaccgttacccgttaggttaacttacacggacaaggtaaacgtccgaacggaccctacgttcccccgtaggttcgtccgttacgggtctaacttccgtaacttacgaacggtaacgtaccgaccggaaaccggcccggttacccgtacggtacgggtacctacccggttaggacggtaccgttacgtttcctacggtcggtacccttaacccgtaacgttccgaacgggtaccctaccgaccgccctaccgtactaccgacgtactccggacggtacccgggaccgtacggtacctaggtacggtacgtacgggtacggtacgttacgttaaccgttactttacggttaacgggtcgtaccgggtcggggttacggaccgtacggtacgacgtacccgtacgtacccggacccgttacgttagttaccgggttacccgggtaaccggtaacggtaccgggtaacccgttaacgggtaccccgttaacccggtaccggtaaaccggttcccgaaccggtaacccccgg

SEQ ID NO: 183919 - DNA, 728 bp, Homo sapiens
  misc_feature: GYAE6OF02JW5U1.13.76.G10.1.454.CMB.1.raw
  modified_base (341)..(341): a, c, t, g, unknown or other
  misc_feature (341)..(341): n is a, c, g, or t
  modified_base (415)..(415): a, c, t, g, unknown or other
  misc_feature (415)..(415): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcgtggttcgtgtagctattaagtgcagtgtgagtgcagcgtggtggacgtcgtgggaaggcgggtcttagacttccgaggccggttcggggggtaccctggaaggtccgtccttcctggtgcctaggcccttcggttcggggtttccaaccggttccgaattcccaacttacctacaggtgacggcgttcggggtaccccncggtcggtccgtaacgggaggggtacgcgtaggtacgtcgtctttctttaatttagttagtagttcgtaaggtnaactcgactcacgacgtccggacggtcgggacgtctaacttacccgaactccgtcgtaacgaacgtaacgtaacctaacgtaaccgaaacgtacgtacggtacttacttaacgtacgtaacgaacgacgtacgacgtacgaacgtacgaccgtagaccggtaaccgtaccggttacggttacgttaaccgttcgtagtaacgagtaggtacggtacgggtacccggtaacgtaaccggttaacgtacgtaacccgttggtaacggttcggtaccgggttcgggtaacccgggtaaccggtaccggtaacccgg

SEQ ID NO: 183920 - DNA, 769 bp, Homo sapiens
  misc_feature: GYAE6OF02GWUSM.13.76.G10.1.454.CMB.1.raw
  modified_base (565)..(565): a, c, t, g, unknown or other
  misc_feature (565)..(565): n is a, c, g, or t
tcagtcacgtactacacgaccggtgctcgatttagtcactcatacagggggagaggagcccagcactgggattccgaggtgtttccattcggtgatcagcactgaacacagaggactcaccatggagttttggctgagtcgttgggtttttccttgttgtcttaattttaaaaggtgcccagtgtgaggtgcgagtcgtgggtggagtcgtgggaggaggtctgactccacggtccggttcggggggtccctagacggtactccgtccgtgtcgcgaccgtccgtcgttcgggttcctaccgtacacgtaccgaaaccctactagtggacgtcggtcgggtacccgccgacggtcccgtaccgggaagggggagggtccggagggtacggtcgtcgtttcctttacgttttagttaagttaggttaggttaggttaacgttaactacgtttaccaccggtactacggtaccgttccggcgggaccggggtaccttactacccgaccgttactccgtactaacgggaactaacgtaacctaaccggaagaaccgtactccgttttnttacctaataaactacggaaactccgtacgtacgacggtaaccgtcgtacgacggtaacccggtagggtcccgttaattcgtacgtttagggcctaagggaacgtgaccgggtacccggaaccctacgggttaaaccgtactcggtaacttaggtccgtacgggttacccggggtaggaaacccggtcggacccgttacccggg

SEQ ID NO: 183921 - DNA, 580 bp, Homo sapiens
  misc_feature: GYAE6OF02F40GJ.13.76.G10.1.454.CMB.1.raw
  modified_base (420)..(420): a, c, t, g, unknown or other
  misc_feature (420)..(420): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataatggcagaataaatatacttcctagtatcagcagaagtcaggccacgtcccctgtcgacgtggtcattctatcaagtctcgaccaagccggccctagacgggtactcccgtagacgctatttcctcgtcggctaccctaactcgtacggactcgagtccactctacgactctacgacggccggaccagcctagtcgganggacggtctagtacttagttacgtgtacggacggtacggtacggaacaggtcacgtccacgtccgtcccgtacgtagttccgttaccggtaccggtaaggtcccggaaccgtaacggttccccgtaacgttaacccgtacgtaccggaccgtaaccccgg

SEQ ID NO: 183922 - DNA, 709 bp, Homo sapiens
  misc_feature: GYAE6OF02HYOJT.13.76.G10.1.454.CMB.1.raw
  modified_base (169)..(169): a, c, t, g, unknown or other
  misc_feature (169)..(169): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (452)..(452): a, c, t, g, unknown or other
  misc_feature (452)..(452): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctctatgagctgactcagcccacctnagtcgtccgtcgtcccaggacagacncgccancactcacctgctacgtaaggtaaaacttaagttggactaagaattaaattacgttaccttccgtaggtaactacagtacaagtacgtcgaacggtcctacgtccccgttgttacgtcgttactacgttactagtacgaaagtcgtacgaccgtaacggcccgtacctacggtacggcctaccggtagacgttacgtacttcctcgtcgtctaaccgtacgtacggacggtaacctccacgtcctacgttcncgaacctgtaccgacgggacccggacctagtacctggtagcgttacggacttacggtactaacgttacgtacgacggttacgggcggtaccggtaggaacgacgtaaccggactaccgtccggtacccggtccgttagttacccgtttcggtaaccggtacccgggggtaaccgttaaccggaacccggttacggttccccggtaaacccggttaacgtacccggaaccgttaaccccgggacccctaaaccccggg

SEQ ID NO: 183923 - DNA, 899 bp, Homo sapiens
  misc_feature: GYAE6OF02IA55B.13.76.G10.1.454.CMB.1.raw
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgtgctattttaaaggtcgccagtgtgaggtgcagcgtggtggagtcgtgggaggaggtcttaggactcccgaggtccggtcggggggggttccccttaggacgtacttaccgtccgtggtacgccgacgtcccgttcggttacggggtttccaaccccggttcgtacgttaccgaacctaacccttaacacgtaggacggtccggtacggggttccccgaccgtacgggtcccgttacccgggaaggggggaacggggtcggttacggggtaacggtccggttaccggtttccgttttaccgttttttaacgtttttaaggttaacggtttaggttacgggttaacgttaaaccgtacgttaacccgtcccggtacggtaaccgttacccggttaccgggttgggggaccgggggtacctaacggtttaccccacccgtacgtttccccgtaacggtaacggaaacggtaacccttaaacgtttacccgaaaaacggttaacccacgggttacctttacggttttacttaaaccggtaaactcggtaaaccgttacgccgttaagggaacgcggtaccgaagtaaccggaccggtccggggtacctagggttttaacctacggtcggtacggtcggaaggtacgggtacgggccggggtaaaccctaccgggttaaacttccgttaaccggcgtttaagccggggtaaaccgttccgggcggggtaaccccgtaagggaccccgg

SEQ ID NO: 183924 - DNA, 704 bp, Homo sapiens
  misc_feature: GYAE6OF02HWDJJ.13.76.G10.1.454.CMB.1.raw
  modified_base (134)..(134): a, c, t, g, unknown or other
  misc_feature (134)..(134): n is a, c, g, or t
tcagtcacgtactacacgaccggtgctcgatttagtcactcatacaggggctgggcctcaggaagcagcatcggaggtgcctcagccatggcatggactccctctcttcctcggcgttccttgcttactgcacnggactccgtggcctctatgacgctgactcacgcccaccctcgagtcgtccgtacgcccgaggacacgacacgccagctactaccacccgttgaccgtcgttaaagggaaaacttaagttcgggactaaagaattaaaacttctaccttaccgtaggtactagagtcgaacgtaagtcgacgggacccacggtccccgtaggtcctacggtcgtaccaatttcactacgaagtacgtcggaaccaacggtcccggacctagggacggttaccctccgtagggactacggttacttccgtcggagtaccctacgtctaccgggttaggaaccctcacggtacctacgtactacgaacctacgtaccggaccggtccggaaccgacggtagtacgacggtaagtcggaggttccgaataccgttacgttacggtcgtacggtacggtacggtaccggtacgaacgtcgaaccggtactaccggtcgacccgttacgtacgtaccggttacggtccgtaacggtaccgaccgtaccggtaccgtacccgttacgtacgtcccgacgaaccccgg

SEQ ID NO: 183925 - DNA, 787 bp, Homo sapiens
  misc_feature: GYAE6OF02F885W.13.76.G10.1.454.CMB.1.raw
  modified_base (305)..(305): a, c, t, g, unknown or other
  misc_feature (305)..(305): n is a, c, g, or t
tcagtcacgtactacacgaccggtgctcgatttagtcactcatacaggggggaggaggagcccagcactgggattccgaggtgtttccattcggtgatcagcactgaacacagaggactcaccatggagttttggctgagctgggtttcctgttgctatttaaaagtgccagtgtgaggtgcagctggtggagtctggaggaggcttgatccagccgtgggggtaccctgacgactcgtcctgtgcgagtcctcttgggttccaccggtcaggtccacctacctacatcgagcctcggggtcccnccaaggccgttacccgaaggggtaacggggctgggtaacggtcgtcggttctttacttttaagtttagtaacggttaggttcggtaaggtacctaagtaaccgtacccgtcgtaacgtaccgtccgtaggtaacgggggccctaagttaccaccgtatacccgtaccaaggtacaacctaagtttaaccccgaaaagtaacccgtacgtaccgttagttttaccctagtaaacttacgggaaacctagggtacctaggggtaccgtaacggtacccgaacggtacggtaccccgtaaccggggaccgtttagggtaaaccttttttaacccggcggttaacgggtaccgtaagggtagtaaccgggttaccgggggaccccctaaagggttaacccggtttaaaccgaacggtaaccgtttacggtacggggttacccttacggggttacccggggtacccttaaaccgggggaacccccgg

SEQ ID NO: 183926 - DNA, 693 bp, Homo sapiens
  misc_feature: GYAE6OF02GRS9L.13.76.G10.1.454.CMB.1.raw
  modified_base (138)..(138): a, c, t, g, unknown or other
  misc_feature (138)..(138): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgccttactgcacaggntccgtggcctcctatgagctagactcagcccacctcagtcgtccgtcgtaccccaggacagacacggccagtcacttccacctgtcctcgttaggaaaattaagttcggcaagaattaaaagttctaccttaccgtggtactacgagctaagtaacgtcgaacggcccgtacgtccccgtgtcgaccgtcggtacctattctaacgtacgaaagtacttcggaaccgtaacggtcccggtaccctacgaacgggcctacccgtaagcggtcgtacttcgcgtaacgcgttaccacgtaggccgtaacctcgacgtactaccgtctcgactactacggacgccgggaaccgagtcctaagtcggtagtacggacgtctacggtactacttacggttcgacggtaggtcggtacggacgtacgacaaccgtcgttacgacccgtacccgggttctaccggttaccggttacggttaaccgggaacccgggtaggttaacccgtacgggttaccctaaacccggttcggtaaacggttcccgaacccggtaaccccgg

SEQ ID NO: 183927 - DNA, 866 bp, Homo sapiens
  misc_feature: GYAE6OF02JKSXE.13.76.G10.1.454.CMB.1.raw
  modified_base (311)..(311): a, c, t, g, unknown or other
  misc_feature (311)..(311): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagtttggctgagctgggttttccttgttgcttatttaaaggtcgcccagtgtgaggtgcagctggtggagtcgtgggagggaggtcttggactccaggtccgtcggggggtccctggacgactctcccgtgtcgcacgtccgtcgtcgggttccaccgtcagtccacctacctacgatggacncggtcggtcccgccgaggtccgtaccggaggggaacgggccgtaggagtcggtccggttctttaccgtttttaattagttacggttaggttaggtaacgtaacgttacgtaccgtaccgccgtaacgacccgttcgggtacgggaccggggtccgttacttaccgacccttacgtccttaccggaacgtaaacgtaaccctaaacgtttacccgaaacggtaaccctacgttaccgtttacgttttaccctaaacgaagttacaaccgtacggtaccctaggtacggacgtacccgtaagtaccgggaaccgacccgggttaccggttaagtttaaccctttaacgggttggtaacccggacgggtaaccgggttacgggtaaccggggtacccccggggaaaccccggttaaacggtttaaaccccgggtttaccccggtaaacccggttttaacccgttaaccgggggttaaccggggtttaaccccgggttccccggggggttaacggggggtaacccccccggggtaaaccccggggttaaccccccgggg

SEQ ID NO: 183928 - DNA, 724 bp, Homo sapiens
  misc_feature: GYAE6OF02G8MF6.13.76.G10.1.454.CMB.1.raw
  modified_base (257)..(257): a, c, t, g, unknown or other
  misc_feature (257)..(257): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagcccaccctcagtcgtccgtcgtccccaggacagacagccagcactccactgctacaggtaaataattggacaagtaataaatatacttctgtacncagacagagtcgacgcctacgtcccctgtcggcttaggtctactactagtaccaagactacgaccgtaacgccggtaccctcgaggtacctccgtagacgcgtacttctcgtcggacctacctaacgttcgtacggaaccttccgaacgtaccctacctaccgtacgtaaccgacgttaccgaccgggaccgggtaacccgacgtaccgtaggtacgggaactacggacggtctaacgtaactttaacggtttacgtaccggtacggtccgggtacgggtacgggaacctacgggtaccgaacggacccgttaacccgtcccgggtacccgtacgtttaccggttcggttaacccgggttaaccgggtaacccggtttaaccggggtaaacccgttaaacccggtttacccggtaaaccccggtttaaccggtaacccggtttacccgaacccgggaaaccccccgg

SEQ ID NO: 183929 - DNA, 682 bp, Homo sapiens
  misc_feature: GYAE6OF02IVHC7.13.76.G10.1.454.CMB.1.raw
  modified_base (482)..(482): a, c, t, g, unknown or other
  misc_feature (482)..(482): n is a, c, g, or t
  modified_base (581)..(581): a, c, t, g, unknown or other
  misc_feature (581)..(581): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagtttggctgagctgggttttccttgttgctattttaaaaggtgcccagtgtgaggtgcagctgggtggagtctggaggaggcttgatccagccgtggggggtccctgagactctcctgtcgcagcctcgtgggttcaccgtcagtcacacctacatgagtcgtcgggtccgcccgaggcctaccgacggggaagggcgtaggagtcggacggttcttcgtttttatttacgtaggttaaggttaggttacgtaactataccgtccggtctaacgtaccgtccgggtaggacgggggtccgtattccgacctactccgtaccgagacgtaactaaacttacccgaaaagtaaccncggtacctttcgttttaccttaacaaattcggaaacctcggtccgtaggacacggtaccagttacgaaccggtccggtaccgttagttacgtttaacgnggttacgacggtagacggtacggccgggtaacccctaaggtaccgtaaccgtccgacgttacgtcgggtaacgtcgggtacgggaccgaacgggtaacccg

SEQ ID NO: 183930 - DNA, 722 bp, Homo sapiens
  misc_feature: GYAE6OF02JC088.13.76.G10.1.454.CMB.1.raw
  modified_base (190)..(190): a, c, t, g, unknown or other
  misc_feature (190)..(190): n is a, c, g, or t
  modified_base (571)..(571): a, c, t, g, unknown or other
  misc_feature (571)..(571): n is a, c, g, or t
tcagtcacgtactacacgaccggtgctcgatttagtcactcatacagggctgggagaggagcccagcactgggattccgaggtgtttccattcggtgatcagcactgaacacagaggactcaccatggtagtttggctgagctgggttttccttgttgctatttaaaaggtgcccagtgtgaggtgcagngtggtggagtcgtggaggaggcttgactccgacgccggtcgggggtccctgacgtactctccgtggtgcgacgtccctcgtgggttccgtaccgtctacgtccaccaccgtacagtcgagtcgtaccgggtcccgaccgtacggccgtaccggaggggtaacgggcgtagggagtcggtccgttcttacgtttttagttagttagtacggttaggtacgttacacgtaccgtaccgacgtacgtaccgtcggtagggtacgggtaccgtactaccaccgtacttccacgaagaacgtaaccgtaactccaaacgaactccggttccttacgttttaaccgtaataaacgtacgaaccaggtacctaggaagtccgaaccgngtaccggtaccacgggttacttacggttaaacttcggtacggtaggacggtaaggacgttaacggggtaccggtaaccctaacgggttaaaccgttaccgtaacggacgttcggtacgggttaacccggttccgggtacggggtaaacccg

SEQ ID NO: 183931 - DNA, 831 bp, Homo sapiens
  misc_feature: GYAE6OF02G9SCL.13.76.G10.1.454.CMB.1.raw
tcagtcacgtactacacgaccggtgctcgatttagtcactcatacaggggtgggagaggagcccagcactgggattccgaggtgtttccattcggtgatcagcactgaacacagaggactcaccatggagttttggctgagctgggttttccttgttgctatttaaaggtgccagtgtgaggtgcagctggtggagtcgtggaggagcgttgatccgaggccgtgggggtccctgacggactcctctgtgacacgccttacgtcgggttcaccgtcgacgttacgacctaaccgtacagtgacgccggttacgggtcccaccgaaggtccgtccggaacgggggtaacgggcggtcggacggttcggtaccgttcgtttaccttttaggttaacgtaggtttacggtacggttaacgtaccaggttacccttccgggaacctacggtacctccgggtacgggtaacgggggtaccgacgtttaccgaaccctacgttacccgtaacggacgtaacggaaaccttaacgaacccgaaacgtaaaccgtaccgttacccgttttaccggttaccgtttaaacaaaacggtttacgaaaacccgtggtaacccgtaggaacccgtaacgtacccggtagttaacccggacggtacccgggttaaccggttacgttaaccggttaacgttaccggtaggaccggtaacggggttaaccggttacggggtaacccgggtaccccgttaaacggttaaaccccggtaacgttacccggtaaacggtttaccgtacgggtaaccccggttacgggtcgggggtaacccgtaaccgggg

SEQ ID NO: 183932 - DNA, 762 bp, Homo sapiens
  misc_feature: GYAE6OF02GX5S9.13.76.G10.1.454.CMB.1.raw
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagcgtggtttctgtagctaatttaaagtgccagtgtgagtcgcagtcgtggtggagtcgtggaggaggtccgttgactccgnggccggttcggggggtccctaggagcctctccgtgtgccncgtccgtcggtcgggttacctaccgttccgagttacccaacaccctagtacgtgaaccggtcgtcgggtaccccgccggacgtccgtaccgggaaggggacgggtccggtagggcgttcggcttttctttaagttttagttagttaaggtaagttgggtataaaccgtcgtaaccgtccgacctaagtacccgttcgggtacgggtccgggaccgttattaccgaaccctcgtttaccgtaccgagtaactaaaccaccgtttaaccggaaaacgccgtaacggttcttacctttaacggttaaccaaagttaccggacctacgggtactaaccggcgaaccgggtaacgacgttacggacccgtaccggtacgttagttacccgttagtccggtgacgttaaggcggtttaccggacgggtaaaccccgtaagttacccggttaaccgcgtaaacgttcgtaggtacccgtacgggtccgggtaccggtaaccggtaaccccgg

SEQ ID NO: 183933 - DNA, 680 bp, Homo sapiens
  misc_feature: GYAE6OF02F2UAV.13.76.G10.1.454.CMB.1.raw
  modified_base (302)..(302): a, c, t, g, unknown or other
  misc_feature (302)..(302): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctcagaaataattggcagataatatactcctgtatcagcagaatcgaggcctacgtcccctgtagtcgtggtcctataccgtattacgaaagnttagacccgaacgggtcccggcccttacgaacgggtaccttacccggtaggtacgccggtaactttcctcgtacggtccttaacccgaacccttacgtacggggaacttccggaagtcccgtacctacgacgtaactacgtccgaacggtccgggaacccgaggtacctaaggttcggacgtcggacgtaccgttagaaaccgttaatttcgtacggtacggcgggtacgggtaccggaaggtacgtaccaacggtccaaccgaccggtcccggttagttaccgttccggtttaaccgggtacggtaacccggttaaccggacccgttaacggtacccgtacccggttaaccgtagtaacccgacccggtaaaccccg

SEQ ID NO: 183934 - DNA, 802 bp, Homo sapiens
  misc_feature: GYAE6OF02HDQSS.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgtcgttaattttaaaaggtcgcccagtgtgaggtgcgagctgggtggagtcgtggaggaggtcttgatccgacggccggttcggggggttcccgtaggacggtacctccgtccgtgtcgcgacgtcctcgttcgggttccaccgtcacgtaccgacctacctacagtgacgtcgtcgggtcccgccgacggccgacggacggggaacggggtcgtggacggtcggtcgttctttacttttatttagttaggttacggttaggttacgtactacgtaccgtccgacgacgtacccggtcggtacgggaccggggtccgtacgttacccaaccgtacgtccgtaccgacgaacgtaaccttaaacgttaccgaaaacgtaaccgaccggttactttacgttttacctaaacgtaaacttacggtaaccgtacgtcgtaacgggacggaaccggtccgtaacgtaccgaacccgggtccgggttaacggttttacggtaaacgtttcgggtacgtacggtccggaagggtacggtacccgggtccgggaaaccccgtaaacgggttaacccgttaacccgtacgttaccggttacggttaacgggtccgtttaaccggggacggggtacccgaaccgggtacccccgg

SEQ ID NO: 183935 - DNA, 766 bp, Homo sapiens
  misc_feature: GYAE6OF02JH3AB.13.76.G10.1.454.CMB.1.raw
  modified_base (164)..(164): a, c, t, g, unknown or other
  misc_feature (164)..(164): n is a, c, g, or t
  modified_base (730)..(730): a, c, t, g, unknown or other
  misc_feature (730)..(730): n is a, c, g, or t
tcagtcacgtactacacgaccggtgctcgatttagtcactcatacaggggagaggagcccagcactgggattccgaggtgtttccattcggtgatcagcactgaacacagaggactcaccatggagtttggctgagctgggttttccttgttgctatttaaagngcccagtgtgagtgcagctggtgagtctgggaggaggcttgatccgagccggtgggggtccctgagactctcctgtgcacgtcctcgttggtctaccgtcagtcaccacctacagtcgacggcgttcggggtcccgccgtaggaccgtccggaagggggacgggtattcggggaagtcggtccgttacgtttactttttaagttaacgtaagttacggttaggttacggttaaccgtaagttaccgtccggacgtaaccgtacccgttccgggtagggtaaccgggggtaccctacgtttacccacccggtactaccgtacccgaaggtaaccgaactaaaccggttaacccccgaaagaaccctaccgggttcctttacgtttacccgttaaacaaaggttaccggtaaacgtaccggtaccgttacggaaaggttcccgggaacccgttagtacccgtaaccggccgggttacctttaacgtttacgttacgtcggttacggacgtaaacggtacgtacgggtccgggaaccctaacgggttaccgtaaccgtacgacgttacngggtaaccgttcggaccgggtacgacgggtaacccg

SEQ ID NO: 183936 - DNA, 782 bp, Homo sapiens
  misc_feature: GYAE6OF02HXCXP.13.76.G10.1.454.CMB.1.raw
  modified_base (229)..(229): a, c, t, g, unknown or other
  misc_feature (229)..(229): n is a, c, g, or t
  modified_base (341)..(341): a, c, t, g, unknown or other
  misc_feature (341)..(341): n is a, c, g, or t
  modified_base (658)..(658): a, c, t, g, unknown or other
  misc_feature (658)..(658): n is a, c, g, or t
tcagtcacgtactacacgaccggtgctcgatttagtcactcatacagggtctgggagaggagcccagcacgtgggattcccgaggtgtttccattcggtgatcagccactgacacagaggactcaccatggtagttttggactgagtccgttgggtttttacctttggttgtaccgttaagtttttaaaacgggcacccgtagttggttggaggtgcagctgggtaggngtacgtgggagcggacttgactccacgtccggttacgggggtccctaggacgacccttcctccgtgtcgacagtcccgttgtacggttcaccggtacacgtacaccacctanacgtgacgcggtcggtcccgcgacggtctaccggaagggacggtccgtggtacgtcgtaccgttacgtttcgtttttaacgtttagtaacggttcggttacgtaacgttaatacgttaccgtccgacgtaaccggtaccgtccgggtaagggtaaccggggtcccttaacgttacccgcccgttaagtttacccgaaccgtaagtaaccggtaaacttaacgttaaccgaaaagaccgtacggttccttttaacgttaaccttaacgtaaagtaccgtaaccgagtacccgtacggaacggtaccggacgttaacgnggtaacccgcggggttaccctacgtttacggttaagtacgcggacgtaggcggtaacggccccggtactaacggttaacgtaccgtaacgtacgttaggaccgggtcgtacggcggtaacccgg

SEQ ID NO: 183937 - DNA, 758 bp, Homo sapiens
  misc_feature: GYAE6OF02FN590.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggcttgactccagccgtggggggtccctgagactctcctgtgcagcctctgggttccaccgtcagtccacacctacagtgagcgtcgggtcccgccgagggcctaccggagggggaacgggggtcctaggggaggttcggtcggttctttacgtttttaagtttacgttaggttaggtagggtacgttaactagttaccgtccgacaacggtaccttcccgggtagggacgggggtaccctaacgtttacccacccgtacttccgtaccgaaggaacgtaacctaaacggttacccaaaggaaccctaccggttccgtttattttacccgtaaccgaaaattccgaaacgtacgtacccgttaaggacggaccgtacgtaagtacggtaacccgtacccgggtccggtttagttaaccgttacgtggttacgggaccgttaggacggtacgggtcccggggaaccctaacgggttaaaccgttaccgtaccggtattacggtacgggtaccggttaccgggacgggggtaacccaccgggggtaaccccg

SEQ ID NO: 183938 - DNA, 691 bp, Homo sapiens
  misc_feature: GYAE6OF02HFEF0.13.76.G10.1.454.CMB.1.raw
  modified_base (170)..(170): a, c, t, g, unknown or other
  misc_feature (170)..(170): n is a, c, g, or t
  modified_base (195)..(195): a, c, t, g, unknown or other
  misc_feature (195)..(195): n is a, c, g, or t
tcagtcacgtactacacgaccggtgctcgatttagtcactcatacagggcctgggcctcaggaagcagcatcggaggtgcctcagccatggcatggatccctctcttcctcggcgtccttgcttactgcacaggatccgtggcctcctatgagctgactcagccaccctnagtgtccgtgtccccaggacagacngccagcatcacctgctacgtaggtaaattaaatggacaagaattaaaatataccgttactaggtatacgagtacaagaacgtcacggacctacgtccccgtgtcgtcgtggtctaacgttcctaatacgaagtacgtacgacccgaacggcccggtacccctacggacgggtaccttcccggtaggacgtacgtactttcgtcgtcggtacctacctaacgtccgtacgggtaacctcgacgtacccgtaccttcgtacgaacccacgtaccgaaccggggtacccgggaccgaggtacccgtaggtagggtacgtgggaacggtcttacgtactttaaccgttcgtcggtaccgggtcggtccggggaacgaccgggtacaccggcgaccgtaccgtccgacccgttataccggtcgttccggttaccggtaacggtacgggaccgtaaccggttaccgacccgtttaccgtaacggaccgtacccggaaccccg

SEQ ID NO: 183939 - DNA, 624 bp, Homo sapiens
  misc_feature: GYAE6OF02FORH9.13.76.G10.1.454.CMB.1.raw
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
tcagtcacgtactacacgaccggtgctcgatttagtcactcatacaggggacccaaaaaccacacccctccttgggagaatcccctagatcacagctcctcaccatggactggacctggagcatccttttctggtggcagcagcaacaggtgcccactctcaggttcagctggtgcagtctggacgctgaggtgaagaagccgtggggcctcgagtgaacggtctccgtgcaaggtcttcgtggttacttcttaaccccacttaccggtactcaccgtgggtncgacgacggccctggacgaggctgaggtgagtgggntgggtcagcgctggacacgtacggacacacagtagtatcggacacgaggaacgttcgagggcagacgtccactacgaccacaacgagtacaactactacccaacgaacaagaccgtacctacgagtaggacgggtacggagcgtacgtagagtactcgtacgaaccgaccgggacgtaccgtgttaacgttaccgtggtacggtaccgtactaacgtcctaaccggttaacctaccgttaagtttacggtacgtttacgggaccggtacggggtcgtcccggttcgtaccggtacccgttccccg

SEQ ID NO: 183940 - DNA, 823 bp, Homo sapiens
  misc_feature: GYAE6OF02IOOZP.13.76.G10.1.454.CMB.1.raw
  modified_base (170)..(170): a, c, t, g, unknown or other
  misc_feature (170)..(170): n is a, c, g, or t
  modified_base (200)..(200): a, c, t, g, unknown or other
  misc_feature (200)..(200): n is a, c, g, or t
tcagtcacgtactacacgaccggtgctcgatttagtcactcatacagggctgggcctcaggaagcagcatcggaggtgcctcagccatggcatggatcctctcttcctcggcgtccttgcttactgcacaggatccgtggcctcctatgagctgactcacgcccaccctnagttcgtccgtgtaccccgaggacacgacngccagcagtccacctgctctaggaaattaatggcaagtaataaagtattacttcgtaggtactcgaggaccaagaacgcgacggtccaaccgtcccctggttcgtacgttcggtctacgtacctacgtacgaaagtacgtacgaccggtaacgtcccggaccgtacggaacgggtacctccggtaggacgtacgttaacgttccgtcgttaacggtccttaacccgtaacgttacggtaacgggtacctacgtaaccgtcctaccgttaccgtaacgaccgtaacgccgtaaccgggaccgggtaacccgtaggtaccgttacggtacgggtaacgtacgggtaaccgtacggttaaccgtttaactaaccggttttacggttacgggttaaccccgggtaggggttacccgggttacgggaaccggtaacccgtaccggtaaccggttaacgtaaccccggttacccgggacccggtttacgtttaacccgggtttccggttttaaccggtacccgggtttaaacccggggtaccgggttaaacccgtaacccggggttttaccctaacccgggtttaaaccccgtaaccgggtttaccccggacccggtaaaccccccggg

SEQ ID NO: 183941 - DNA, 853 bp, Homo sapiens
  misc_feature: GYAE6OF02GUMNV.13.76.G10.1.454.CMB.1.raw
  modified_base (350)..(350): a, c, t, g, unknown or other
  misc_feature (350)..(350): n is a, c, g, or t
tcagtcacgtactacacgaccggtgctcgatttagtcactcatacaggggggaggaggagcccagcactgggattccgaggtatttccattcggtgatcagcactgaacacagaggactcaccatggagttttggctgagctgggttttccttattacttattttaaaggtgtccagtgtgaggtgctaggttggtaggagtcgtgggaggaggtctttcggtccgacgggcccgggggggggttcccctggtacggtaccttccgttacgacgttcgggtggtcccgggtccttccgtcggggtacccttccgaaccccggttcaaaacccaccgtaaaacccgttaancgttacggaagtcccggtttgggggtcccccgaccgtaccgggtccttaccgggaaacggggaaggtacgggacccggtaggtcgggtctacgtagtttattacgttcggtcgacggtcaccacttacttcgtacgacacgtacgtccggtacgggcgggtaccggttcaccgtacgtcctaccggtaacgacgaacttaacgtacctaaaacggaccgttacgtaggttaactcgttaacgtaagtaccgtaaccgcgttacgaaccggagttccggaacgtacggaacccggtccgtacgttaacgttacgtggtacgtaacgtaacgttagcggttaacgacgggtaacgggtacccgggaccccggtttaaggggtcccggggtaccggtttagggggaccgggttttaacggggtttcccttttaacgggtcggtttaacccggttgggtaacccgggtttccgggggacccggtttaacccgggttaacccccgggg

SEQ ID NO: 183942 - DNA, 668 bp, Homo sapiens
  misc_feature: GYAE6OF02FZ6ML.13.76.G10.1.454.CMB.1.raw
  modified_base (549)..(549): a, c, t, g, unknown or other
  misc_feature (549)..(549): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctgggaggaggcttgatccagccgtgggggtccctggacgactctcctggtcgcacgcctcgtgggttccaccgtcagtccacacctacatggagtcgtcgggtcccgccgaggcctccggaggggaacggggcgtagggagtgcgtttcttacgtttttatttagtaagttggtaggttagtaactataccgtccgacgacgtaccgttccggtaggacggggacctagttccaacgtactccgtaccgaagaacgtaacctaaacgttaccaaaacgtaacccgtacgtcctttacgttttacttaacgtaaactacgaacgacgtcctagacgtacgaccgtanacgaccggacggttccgttagttacttacgtggtcgacgagtaacggtcggtacgggacccgtaaggttaaccgttacgtacggtactaggtccggtacgttacggcgggtaacccggg

SEQ ID NO: 183943 - DNA, 790 bp, Homo sapiens
  misc_feature: GYAE6OF02HENV2.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagcgttgggttttccttgttgcttaattttaaaaggtgcccagtgtgaggtgcagcgtggtggagtcgtgggaggaggtcttgactccgacgtccgggttcgggggggtcccctggaacgtacctcgtccctgtcgcgacgccttcgttcgggttccaccggtcacgtccaacctacctaacatgacgtccggtcgggtcccgaccgacggtccgtaccgggagggggaacggggtcgtaggggagtcggtcgtttcgttttactttttagtttacgtaaggttacggttaggtaaacgttactaacgttaccgtcccggtacgtaaccgttacccgtcccgggtagggtaccgggggtacccttaacgttcccaaccgtacttaccctaccggtaagaacgtaaccaaacttaccgaaaacgacctaccggtctttacgtttaacctaacaaacgttaacgaaccgttacggaccgttaacggaacggtaccggtaaccgttacgacggacccgggtaaccgggttcccgttaagggttaacctttacggtggtaccgacggtaaggtacggacgggtaccgggaaccctaacggttaaaccgtcgacgtacgtacgtcggtaccggtcggtacggggacgtacggacccg

SEQ ID NO: 183944 - DNA, 921 bp, Homo sapiens
  misc_feature: GYAE6OF02GAAR1.13.76.G10.1.454.CMB.1.raw
  modified_base (171)..(171): a, c, t, g, unknown or other
  misc_feature (171)..(171): n is a, c, g, or t
tcagtcacgtactacacgaccggtgctcgatttagtcactcatacagggggggagaggagcccagcactgggattccgaggtgtttccattcggtgatcagcactgaacacagaggactcaccatggaatttgggctgagctggtctttttctgtggctagttttaaaggngtccagtgtgaagtgcagctggtggagtcgtggggagcttggtacagccgtgggacgtccctggacgtctctccgtgtgcacgcctcgtaggactttccacccgttttagacctaaacgttatcggtaccctaattaggcgtccggttaccgggggtcccgacccgtaggggtcccgttacccggaaagggggggaaacgggggtccgttagggggtaacgggtttcgggggtacccttaacggtaaacctttaaggtttggtacgaccggtttaagggtcgggttccaccccaacccgtaactaacttaccgtaccggactaaccgggtaccttacccgggtagggtaaaaccggggtcccttaaacttacccgacccgtaacgttcccgtaacccgaaacggtaaacgtaaaccttaaaaccgttaaccccgaaaacggtaaacccgaacccggttaccgtttacgttaaccgttcgttaaccggtaaaccctaaacgttaacggaaaccgtaacggtacccgttaacgggaaacggggtaccggaaccgggtaaaccgggaacccgtaaccgggtaaccccgtttaacgtaacgttttacccgggtaggttaccgggtaaaccgggttaaaaaccgggtttaaaaccccttttaaccccgggtttaacttttaaccggttttttacggaacccgttttacccgggtaaccgggggtaccccttaacccgggggtacccgttaccggg

SEQ ID NO: 183945 - DNA, 796 bp, Homo sapiens
  misc_feature: GYAE6OF02HKR7R.13.76.G10.1.454.CMB.1.raw
  modified_base (300)..(300): a, c, t, g, unknown or other
  misc_feature (300)..(300): n is a, c, g, or t
  modified_base (336)..(336): a, c, t, g, unknown or other
  misc_feature (336)..(336): n is a, c, g, or t
  modified_base (602)..(602): a, c, t, g, unknown or other
  misc_feature (602)..(602): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagtttggctgagcttgggttttccttgttgcttatttaaaaggtcgcccagtgtgaggtgcgagcgtgggtaggagtcgtagggagggacggtcttaggactccgacggtccggtcggggggtccctaggacgtactctccgtgtcgcacgtcctcgttcggttccaccgtntactcgaacctacctacagtgacgtcgtcggtcccncgacgtcctccggaggggaacggcgtggagtccgtcggttcttacgttttagtttaacgtaggttaggtacggttaactacgtacgttaccgcccgtacgtaacgtccgtacgggtacggggccggggtaaccgtaacgttcccgaacctacgtacccgtaccgaacgggtaacgtaacctaaacgttaaccccgaaaaggtaacccgtacgtttccgtttacgggttttaacccctaaaggtaaaaactacggttaaaaccccgnggtacccctaagggaaccgtaaccccggggctttaaaacggcccgaaccgggtttcccgggaccgggtttatttaaaccgttccggtaggtacccgggcctaaaggggtactacggggtaccccggacccgttaaagttaaccgggtacaaccgtggttacgcgggacgtttcgggacgacccgaaggtacccg

SEQ ID NO: 183946 - DNA, 852 bp, Homo sapiens
  misc_feature: GYAE6OF02IJIB4.13.76.G10.1.454.CMB.1.raw
  modified_base (763)..(763): a, c, t, g, unknown or other
  misc_feature (763)..(763): n is a, c, g, or t
tcagtcacgtactacacgaccggtgctcgatttagtcactcatacaggggtctgggagaggagcccagcactgggattccgaggttgtttccattcggtgatcagcactgaacacagaggactcaccatggtagttttggctgagtcgttcggggtttttcctttgttgtcttaagtttttaaaagggtcgccctaggttggttggagggtgcgacggtcgtgggtgggacgttcggtgggaagggacggtcgtttgaacttccgacgggtcccgggttacgggggggttcccctaggacgtaaccgttccgttcccgttggtacgccgtaacggtcccttacggttcggggttacctaaccgtacgtacgtaaccaacctaacccgtagtacgtacggtacggcggttaccgggtacccgccggtaaccggtacgtaccgggaagggggaacggggtcgtcgggtaaggtccggtaccgtttacttttacgttttttaaagttaaggttacggttaggttacggtaacgtaacttaacgttacccgtacggactacggtaccgtacgggtacgggacgggtaccgtctaccgacctacgttccgtacgaaagaaccgtaactaaacgttaccgaaaaacggtaccgtacgtttctttacggttttacttaaacgtaaaacgtacgtaaaccgaccgtacgtaaggtaaccggacgttaaccggagtacggacccgtaaggttccttaaggtactttaacggnggtagacgggtaacagggtacgtaccgggaaccctaaggtaccgtttaacacggtactaggtcggtaacggtccggaacgggtaacccg

SEQ ID NO: 183947 - DNA, 782 bp, Homo sapiens
  misc_feature: GYAE6OF02HGENY.13.76.G10.1.454.CMB.1.raw
  modified_base (104)..(104): a, c, t, g, unknown or other
  misc_feature (104)..(104): n is a, c, g, or t
  modified_base (225)..(225): a, c, t, g, unknown or other
  misc_feature (225)..(225): n is a, c, g, or t
  modified_base (667)..(667): a, c, t, g, unknown or other
  misc_feature (667)..(667): n is a, c, g, or t
  modified_base (686)..(686): a, c, t, g, unknown or other
  misc_feature (686)..(686): n is a, c, g, or t
  modified_base (693)..(693): a, c, t, g, unknown or other
  misc_feature (693)..(693): n is a, c, g, or t
tcagtcacgtactacacgaccggtgctcgatttagtcactcatacaggggctgggcctcaggaagcagcatcggaggtgcctcagccatggcatggactccctntcttcctcggcgtcctgcttactgcacaggactccgtggcctcgtatcgagctgacctcacgcccaccctcgtaggtcgtccggtctacccgaggaccagaccgaggcccagtcctatccnccgtgcctactaagggtaaaattaagttggacgtaaagtaataaaacttacttaaccgttccgttaggttactaccgaagctaaaggtacgtacacgggtaccctaacggtccccgtggttcgaccgttacggtcctaacgttaagtaccgttaacgaagtaaccgtcggtaaccgaacgggtccccggtcccgttaacgggaccggtcgtacccgtagggaccgttaccgttacgtttaccgtccggttaccgaccgtttaccgtaaccgtaccggttaaccgggtaaccttccgaacccgttaccgtaccggttaaccttaccggaaccgttaacccgaccgggtaaccgggggaaccccggtaccggtaacggtttaccggtaacggttggtaacggtacggttaaaccggtcgttaacgtacgttaaccgtttaccgnggttaaccgcggtaccggnggtaacnccgacgtacgcgtccgaccgtctacgttcgtctacggtacgaccggtacgaccgttacgcgtaccgtaccgtagaccggcccgaacccg

SEQ ID NO: 183948 - DNA, 945 bp, Homo sapiens
  misc_feature: GYAE6OF02HVU2Y.13.76.G10.1.454.CMB.1.raw
tcagtcacgtactacacgaccggtgctcgatttagtcactcatacaggggggggagaggacgcccagcactgggattccgaggtgtttccattcggtgatcagcactgaacacagaggactcaccagtggtagttttggctgagcgttgggttttccttgttgcttaagttttaaaaggtcgaccctagtgtgaggtgcagcgtggtggacgtcgtagggagggagtcgttagactccgacggccggttcggggggtccctaggacggtactcgttccgtgtcgcgacgtccttcggtcgggttaccaccgttcgacgtaccaacctaccctacgtacgtaggtacgtccggtacgggtcccgaccgtacggccgtaccgggagggggtaacgggtcgtacggtacggtcggtacgtttcgttttactttttaagtttacgtaacggtttagggttaacggttaacgtaacgtaaccgttacccgccggtaacgtaaccggtacccggtaccggttacggggaccggggtaccgtaacttaccgacctacgttacccgtacggtaaaggaaccgtaaacttaaacccggttaaccgaaaacggtaaccgttccgtttaacgtttccgggtttttaaactaaacttaaaacggtaccggtaaacccgacgggtttccccgtaaagggtacccggaaccggttaccgggtaaacgttccgggaaacccggtaccgggtttaccggttacgtttaaacgtttcccgttagggaacccgggttaacggaagggttaaccggtacggggtacccccggggtaaacgttaaacccccgggtttaaggtttaccccggtaacggttaacccgtttacgggtaacggggttaacccccggttacggggggtaacccggggttaaacccgaaccccgggggtttaacccccggg

SEQ ID NO: 183949 - DNA, 795 bp, Homo sapiens
  misc_feature: GYAE6OF02IQNAF.13.76.G10.1.454.CMB.1.raw
  modified_base (649)..(649): a, c, t, g, unknown or other
  misc_feature (649)..(649): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggactgagctgggttttccttgttgcttaattttaaaggtcgcccagtgtggaggtcgacaggctgggtggagtccgtgggaggaggtcttaggactcccgaggtcccggtcggggggttcccaggacgtacctccgtccgtgcgcacggtcccgttcgtcgggttacccaccgttcgaacgtccctaaccgtaaccctaacggacttaggacgtcggttccggggttcccgaccgtaacggtcccgttaaccggggaaggggggtacggggtaccgttacggggtacgttaccggtcggtttaccttttcgtttttaagtttaagtcgggtagtagggtactacgtacgttacctccggaagtaccgtacgtccggaggggacggtaccgtacttacccaccgtatttcccgacgacgtaacgtaacccgacgttaacaaaccgtaactccggtacgtttacgtttaccgtaacctaagtaaccgtacaccgttcgacgtacgtcggaccggtanacggtacgtaccgggtacccgttagttaaccttcgtcgtaacggacgtaggttacggaccggtacccggtaccgaacccgttaggttaacccgaccgtttaacgtaggtcggtccgggttacgaccgggacggtacggtaacccgg

SEQ ID NO: 183950 - DNA, 640 bp, Homo sapiens
  misc_feature: GYAE6OF02HWU8K.13.76.G10.1.454.CMB.1.raw
  modified_base (408)..(408): a, c, t, g, unknown or other
  misc_feature (408)..(408): n is a, c, g, or t
  modified_base (480)..(480): a, c, t, g, unknown or other
  misc_feature (480)..(480): n is a, c, g, or t
tcagtcacgtactacacgaccggtgctcgatttagtcactcatacaggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtggggggtccctgagactctcctgtgcacgcctcgtcggtcaccgtcagtccacctacctacatgagtcgtcgggtccgccgtaggccgtccggaagggggaacgggcgtggtagtcgcgttcttcttttattagtagtaggtgtagtacagtacctccgcagtaccgtcgtacggacggggacctnttaccacctatcctcagacgtaactaactaccgaaacgaactcgtcgtttctttactacaaacgtcgaaacncgtaccgtgacgacgccgaagtcgaaccgtaccggggtccttagttacctttaacggcgtaagtacggagtacggtacggtccgggaaccctaaccggtaacgttaccgacgtacgttagacggtaccgtcgggtaaccggggccgaacgggtaccccgg

SEQ ID NO: 183951 - DNA, 624 bp, Homo sapiens
  misc_feature: GYAE6OF02F90NW.13.76.G10.1.454.CMB.1.raw
  modified_base (115)..(115): a, c, t, g, unknown or other
  misc_feature (115)..(115): n is a, c, g, or t
  modified_base (187)..(187): a, c, t, g, unknown or other
  misc_feature (187)..(187): n is a, c, g, or t
  modified_base (202)..(202): a, c, t, g, unknown or other
  misc_feature (202)..(202): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (409)..(409): a, c, t, g, unknown or other
  misc_feature (409)..(409): n is a, c, g, or t
  modified_base (416)..(416): a, c, t, g, unknown or other
  misc_feature (416)..(416): n is a, c, g, or t
  modified_base (452)..(452): a, c, t, g, unknown or other
  misc_feature (452)..(452): n is a, c, g, or t
tcagtcacgtactacacgaccggtgctcgatttagtcactcatacagggggtctggggagaggagcccagcactgggattccgaggtgtttccattcggtgatcagcactgaacncagaggactcaccatggagttttggctgaggcggtcggttcgtgtaggcgtattaaaggtgcagtgtgagtncagtctggtgacgtntggacggtgcttgctaccganccggtggggtcccaggacaccttnactggtagctggcctgttgggtacaccgttnacacacctancgtatgacgtgtcggcngacgcgtacggaggcggtcgtggtcgtcgtcttacttactttaagtactacggtgtacggtacttacacgtcgtcacgacgttcgtcgtaacgggcggtctacnccgtacncgtctacggactacgtaacgtactacccgataccgngtcttacgttacagaagtaccgactcgactgccgtaacggacttacggagtaacccgttcgggtctttaaccgttagttactaggtcgggacgtggtacggtacggaccggtacccgtaacgtaccgttacggtaccgtacgttacgtacggtacggtacggtacggtacgg

SEQ ID NO: 183952 - DNA, 693 bp, Homo sapiens
  misc_feature: GYAE6OF02JXAU4.13.76.G10.1.454.CMB.1.raw
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
  modified_base (529)..(529): a, c, t, g, unknown or other
  misc_feature (529)..(529): n is a, c, g, or t
  modified_base (576)..(576): a, c, t, g, unknown or other
  misc_feature (576)..(576): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagttttggctgagcgttgggttttccttgttggtcttaagtttttaaaaggtcgccctagttgtggtaggtgcagtcgtgggtggtagtcgtgggaggaggtcttgatccgaggccggttggggggtccctggacgtccttccgtccgtagtgccgtacgtccttcggtacggtccaccgtgacgtccactaacctacgagtcgacgtccggtcgggtcccgccgacggtccgaccggaaggggaacggcggtacggtaggcggtcgtttactttcgttttaatttagtaggttagttaggtaacgttacagttaccgtcgagtaacgacgttccggngggtaccgggccgtactccaccgtntccganaacgggaacactaagtacccgaaataaccgtntacgttcgtttaacctataacgaacgacacgtcgtagacgtcgaacngacgacgtcgaccgttagttactagtcggagtcgaagcgtacggtccggaacccttaaggtcgtaacgtcgaccgttaggcgtaccggtggaacccggggacgtaaccggtacccgg

SEQ ID NO: 183953 - DNA, 909 bp, Homo sapiens
  misc_feature: GYAE6OF02GVUUW.13.76.G10.1.454.CMB.1.raw
tcagtcacgtactacacgaccggtgctcgatttagtcactcatacgagggggggaagcctgggaacacttagccttcatgagtgtccccacatggcctggatgatgcttctcctcggactccgttgcttagtggatcaggagtcggattctcagtaccttggtgggtacgaccccgtagggacgtacccagttccgtttctcgtagttcgtccttacggtggggaagggacctacggttaccaacgtactccgtacgttggtcgggtactttggaagtactacgggtctactagtcctacgttaggttaccttacctacccgtacggtcgtacggtacccaacgaaccgacccgtaccggaccgacggtccgtccgacggcctaccgtcgtacctactaccgtaactaaacccaacaaacctccgtaccgtcttacgttccgtccggggtacctcgtacctcgtactacttcgtccgtacctccgtacgttaccggttacgacgtaacgtcgtaccgttacctacgtcctaacggtaccggtacccgggtaccgtaacggtaacgtaacggaacgtaacggttacgaacgtttaacggttacgttaaacgttttagtttaccggttagttttacccggttttagttttacggtttaacgggtttcgggtttaaaccggtttaccggttaacccgtttacgttttaacccgggttccgggttttacggttaccggttttacggggttacccgggggtaagggttacccgggtaaacccgggttcccggggttaaaccggttacccgggttttaccccggaaccgggttttcccgggtacccggtaaccgggtacccgttaacggggttacccgttaccccgggtaccccgtttacccgggttaccccggg

SEQ ID NO: 183954 - DNA, 747 bp, Homo sapiens
  misc_feature: GYAE6OF02IWBAF.13.76.G10.1.454.CMB.1.raw
tcagtcacgtactacacgaccggtgctcgatttagtcactcatacagggggctggggcctcagggaagcagcatcgggaggtgcctcagccatggcatggactccctctcttcctcggcgtccttgcttactgcacaggactccgtggcctcctatgagctgactcacgccaccctcagtcgtccgtcgtcccgaggacagacacgaccagcactcacgtcgctctaaggtaaaactaagttcggactaagaaattaaataacttacgttcccgttaggttaacttccgacgcgaacgaacggtcgaacggtacctaccggtccccgtggtccggtaccgttacggttacctacttacgtaacgaacgtaacgacgtaccggtaccgaaccggcccgggtaccccgtacggaaccgggtctcccggtacgacggtccgtacgtttccgttactccgggtaccttacccgtaacgttcggtaccgggtactaccgtacgaccgtccgtacgactaccgtacgtaccgtacggaccggtaccgagtactacggtcggtagtacggacgtaccgttcgtaacttacgtacgtcgggacgtacggggtcggacggacgtacggataccgggtctaccgtccggtaccgtacggttacgttcggtaccggttaaacggttacccggtaccggtaaaccggttaccggtaaccgtacccggtaacgtaaaccggtccgtaccggtaaccccgg

SEQ ID NO: 183955 - DNA, 734 bp, Homo sapiens
  misc_feature: GYAE6OF02I9XSK.13.76.G10.1.454.CMB.1.raw
  modified_base (437)..(437): a, c, t, g, unknown or other
  misc_feature (437)..(437): n is a, c, g, or t
  modified_base (481)..(481): a, c, t, g, unknown or other
  misc_feature (481)..(481): n is a, c, g, or t
tcagtcacgtactacacgaccggtgctcgatttagtcactcatacagggggggagaggagcccagcactgggattccgaggtgtttccattcggtgatcagcactgaacacagacggactcaccatcggtagttttggctgagcttgggttttcctgttgacttaagtttaaaaggtcgccctaagtgtgaggtgacagtcgtggtggagtcgtggaggaggtcttagactccgacgtccggttcgggggtccctggtacgactcctccgtgacgccacgtcctgttcggtacaccgtcacgtccaactaaccctagtactgacgtccggttcggcccgaccgaggtacctaccggggaagggggtacggtcgtggtaccggtcggtacttccttttattttaagttacgtagttaggttgtaagtaccagttaccnccgagacgtccgtcggtagggaccggtacgtaccttacgacctntacccgactagaaacgacttaacgttaaccgaaacttaaccgcgtttaccgttagtttacctaataacttggaaccacgtcgtacgacgtaccgggtaccagtacccggtacggtccgtaggtttacttattacgtgggactacggagcccgggtaggccccggaaccggttaaagttccccgttaagcccgggttaacgtcgggtaacccggttcgggtaaccggtacggggtacccgtaagggtacccccg

SEQ ID NO: 183956 - DNA, 756 bp, Homo sapiens
  misc_feature: GYAE6OF02HP3OQ.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcaaccatggagttttggctgagctgggtttccttgttgcttattttaaaaggtgcccagtgtgaggtgcagcgtggtggagtcgtggaggaggtcttgactccgagtccggttcggggggtccctggacgtacctccgtccgtgtcgaccacggtcctcggttcgggttccacccgtctagtaccaccgtacctacagttcgacgcgtcgggtacccgccgtacggtccgtaccggaagggggtaagggcggtaggtacgtcggtcgttactttcgtttttaattacgtaggttaggttaggttagtactacttaccgtccgtaacgacggtaccgtccggtaggggtaccggggtaccttacgtacctaccgtactccgtaccgaggtaaaccggaaccttaaaccgttacgaaaaccggtaacctacgttcgtttacgttttaaccctaagtaaaactacggaaactcgttaccgtaggaacgtaccgcgtaagtaccgaacgtcccggggttacttggttaaccttacggtgtaccggagtacgacggtgtacccgggaaccttaacggttaaccgttacctacggtacgttacggtacggcggtttacccgggacgggaacccgtacggtacccgg

SEQ ID NO: 183957 - DNA, 962 bp, Homo sapiens
  misc_feature: GYAE6OF02IXAE1.13.76.G10.1.454.CMB.1.raw
  modified_base (115)..(115): a, c, t, g, unknown or other
  misc_feature (115)..(115): n is a, c, g, or t
  modified_base (197)..(197): a, c, t, g, unknown or other
  misc_feature (197)..(197): n is a, c, g, or t
tcagtcacgtactacacgaccggtgctcgatttagtcactcatacaggggggggagaggagcccagcactggggattccgaggtgttttcccattcggtgatcagcactgaacanagaggactcaccatggtagttttggctggagcgtttgggttttccttgttgcttaattttaaaggtgcccagtgtgagggtncagcgtggtggtagtcgtgggaggaggtcttgacttccgagtcccgggttcgggggggttcccctaggacgtacccttccgtcccgttggtcgccgacgtcccgttcggttcggggttccacccggtctacgtacccaacctaacccctatatacggacggtccggttccggggtcccgtacccggaggtcccggtaccgggaaggggggaacgggggttcgtaggggtacgttcgggttcccgttttactttttaacgttttttaagttttaaggtaggggtttaagggtttagggttaaacgttaccgttaacgttcccgttaccccgggactaacggttacccggttacgggttacgggaccgggggtacccttaacgtttaccccgaaaccttaccgtttacccaccggtaaaggtaaaccgtaaacgtttaaaccgttaacccgaaaacggtaaaccccggttccctttaccgttttaacgttttaaccctaaagtaaaacgttacgaaaacgttacccggtacccgttaagggaaacgtaccgcccggtaaggttacccgacccgtaaccggggtttccgtaacgtttaccgtttacggttacggacggtaacggggtaaggaccgggttaaccgggtaccccggggtaaacccgttaaacccggttaaccggttttacccggaacgttaccggtttaacgggtccgggttaacccggttcggggaacccgggttaaccccgggaaccggggtccccgg

SEQ ID NO: 183958 - DNA, 716 bp, Homo sapiens
  misc_feature: GYAE6OF02JWFJ6.13.76.G10.1.454.CMB.1.raw
  modified_base (193)..(193): a, c, t, g, unknown or other
  misc_feature (193)..(193): n is a, c, g, or t
  modified_base (203)..(203): a, c, t, g, unknown or other
  misc_feature (203)..(203): n is a, c, g, or t
  modified_base (265)..(265): a, c, t, g, unknown or other
  misc_feature (265)..(265): n is a, c, g, or t
  modified_base (354)..(354): a, c, t, g, unknown or other
  misc_feature (354)..(354): n is a, c, g, or t
  modified_base (579)..(579): a, c, t, g, unknown or other
  misc_feature (579)..(579): n is a, c, g, or t
  modified_base (601)..(601): a, c, t, g, unknown or other
  misc_feature (601)..(601): n is a, c, g, or t
  modified_base (630)..(630): a, c, t, g, unknown or other
  misc_feature (630)..(630): n is a, c, g, or t
  modified_base (641)..(641): a, c, t, g, unknown or other
  misc_feature (641)..(641): n is a, c, g, or t
tcagtcacgtactacacgaccggtgctcgatttagtcactcatacaggggggaggaggagcccagcactgggattccgaggtgtttcctattcggtgatcagcactgaacacagaggactcaccatggagttttggctgagctgggttttccttgttgacttattttaaaaggtgtcccagtgtggacggtgnagcgttgggnggtagtccgtggaggaggcttgatccagccgtcggggggtaccctggaacgctaccttccgnggttcggcctacgccctcgttacggggcctaacccgtgacgtaccgaccgtacctaccgattgacgtccgtccggggttacccgaccgnggtcccgtccgaaggggtaaccgggtcgcgggtaaggtccggtcgttcccgtttattttaactttacgttaagttaacggtgggtttacggtaccgacgttacgtacccgtatacggcgtacccgtgggaaacgggggtccaacgttccgacctaacgttctcccgagacaccgtaactaccccgaaaggaccacgtccttaggtttcctaactaacttgaaacncgtcgttaagagccacgtcctnaacccgtacggtccttaacgtattaccgntcggacgtagngacggtcggtaaccgtacgtaacgtaccttcgtaacctgtaccggccgtacggtcgggacccgtaggggtacccc

SEQ ID NO: 183959 - DNA, 801 bp, Homo sapiens
  misc_feature: GYAE6OF02G0JYU.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagagactcaccatggagttttgctgagctggttttccttgttgcttaattttaaaggcgccagtggtgaggtgcagtcgtgggtagggacgtcgtagggagggacgtcgttggactcccgacggtcccgggttcggggggtaccctggtagacctccgttccgtgtcgaccgtacgtcccgtacgttcggggttacctaaccggttcacggtacccaaccctacccgtactagcgtacggtccgtcgggtaccccacgacggtccgtaccgggaagggggacggggtcgtgggtacggtaggtcccgtttaccttttacgtttttaagttacgttaaggggttaggttcggtaaacttaaccgtaccgttaaccgttcccggacttaaccggtccgtcccggggtacgggtaacggggtccttaccttaccgaaccctccgtacccgtaccgaaggtaaaccgtaaccgtaaaaccgtaccgaaaacgtaaccgtcgttaccttttacgtttactaaaccggaaattcggaaccctaggtaccaggtagaccgtccgagtaccgaccggaccgttgttaacttacgtagtcggacgcgaggacgtacggccgggtaaccctacgtaacgttccggtacctaggttccgttagggtcccggtacgggtccggaacccggtacccgtaccgg

SEQ ID NO: 183960 - DNA, 864 bp, Homo sapiens
  misc_feature: GYAE6OF02GNDF8.13.76.G10.1.454.CMB.1.raw
tcagtcacgtactacacgaccggtgctcgattttagtcactcatacaggggctgggagaggagcccagcactgggattccgaggtgtttccatttcggtgatcagcactgaacacagaggactcaccatggagttttggctgagctgggttttccttgttgcttattttaaaaggtgcccagtgtggaggtgcagcgtggtggagtcgtagggaggaggtcgttggatcccgaggtcccggttcgggggtccccttggagtaccttccttaccgtgttcgacgacgtcccgttcgttcggggttccacccgtcgactccgaaccgtacctaactacgagaccggtcgttcggggtccccgaccgtacggtcccgtaccgggtaaggggacggggtcgttggggtaacgtcggtaccgtttcgttttacgtttttattttaacggttaggttaggttacggttaacgtaacgttacgtaaccccgttccgtaacgtaacggtaccgttccgggttaagggacccggggtcgttaaccgttacccaaccgttactttaccgaccgtaacgtaaccggtaactaaccgttaaccgaaaaccgtaaacccgtacgttaacccgttttcgttttaacccgttaacgtaaaacgttaccgtaaaccgtacgttacccgaacggtaacggaccggacgtaaccggtacgtaacccggaccggttaccgttaacggttacttacgggttcgtaaccggtagaacggtaacggtccggttaacccgggaccccgttaaaccggttaaccgtttaccgtaacccggttacgtacggttaacgggtaccggttaccgggtcggggtaaaccccgg

SEQ ID NO: 183961 - DNA, 756 bp, Homo sapiens
  misc_feature: GYAE6OF02FPUUI.13.76.G10.1.454.CMB.1.raw
  modified_base (242)..(242): a, c, t, g, unknown or other
  misc_feature (242)..(242): n is a, c, g, or t
  modified_base (465)..(465): a, c, t, g, unknown or other
  misc_feature (465)..(465): n is a, c, g, or t
tcagtcacgtactacacgaccggtgctcgatttagtcactcatacaggggggggagaggagcccagcactgggattccgaggtgtttccattcggtgatcagcactgaacacagaggactcaccatggagttttggctgagcgtggtttcgtgttagctatttaaaggtgccagtgtgaggtgcagctgggtggagtgtgggaggagggcttgagtccaaggtccggtgggggggttccccnggacgactcctccgtgtcgcaacgccgtgtggggttccaccgtctagtccacacctacatgagcgtcgggtccgccgacggccgtaccgaggggaacggggtcgttgggacggtcggtacgtccttttactttttatttaagttagttacgttaggtacgtaactagtacgtccggacaggacccgtcggtacgggacgggggtacctacttaccgaaccctnttccgaccgagtaaccggaaactaaccgttacccgaaaacgaacgtaaccgtctttcgttttaacccttaataaaccgtacgaacctagtacccgtaggaacgacgtacccggtagtaccgtaccggtaccgggtaccggtttcgtttaagttccggttacgtcggtacgggaggtacggtacggttacccgggggaaccctaaaccggttaaacccgttaaccgtaccggttacgttaacggttacggggtacgtaccgggtccgggaccgggtaacgggtaaccccggg

SEQ ID NO: 183962 - DNA, 712 bp, Homo sapiens
  misc_feature: GYAE6OF02H1K8B.13.76.G10.1.454.CMB.1.raw
  modified_base (171)..(171): a, c, t, g, unknown or other
  misc_feature (171)..(171): n is a, c, g, or t
  modified_base (297)..(297): a, c, t, g, unknown or other
  misc_feature (297)..(297): n is a, c, g, or t
tcagtcacgtactacacgaccggtgctcgatttagtcactcatacaggggctgggcctcaggaagcagcatcggaggtgcctcagccatggcatggatccctctcttcctcggcgttccttgccttatgcacaggctccggtgcctcctatgagctgactcacgccacctnagttcgtccgtcgacccagacagacagccagcatccgacctgtcctcgtaagggtaaaacttaagtggaactaggtaaactaaagttcttaccgtttccgtaggttaactcgacgacaacggtaancgtaacggccctacggttcccctagtccggttacctggtacctactaccgttataaccgtaggtacctacgccgaacgtccggccctacgacgggtaccctccgaaggcgttacgtacgttccgtagtaccggtaccctaaccgtacgtccgtaacggtactcgaccctaccgtctacgaccgacctaacgcgtacccgggcgtaacccggtacgtacgttacgtaggtagtaccgggacgtacgttacgtacttacggttacgagtaccggacggtagggcggactacgggaccttacgccggtcgtaccgttccgtaaccgtcggttaccgtaccggtaacgggtaccgtacgggtaacccgttacgggttaccaacccggtttactaaccggttacccgaccgtaaccccgg

SEQ ID NO: 183963 - DNA, 752 bp, Homo sapiens
  misc_feature: GYAE6OF02IPKNX.13.76.G10.1.454.CMB.1.raw
  modified_base (268)..(268): a, c, t, g, unknown or other
  misc_feature (268)..(268): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggagttttggctgagctggttttccttgttgctattttaaaaggtgcccagtgtgaggtgcagcgtggtggagtcgtgggaggaggtcttgactccgacggtccgttcggggggtccctggacgacctctccgtgtgccncgccttcgttcggttccaccgtcacgtccacctacctacagtcgagtcgttcgggtcccgccgacgggtcctaccggagggggaacgggtcgtggagtcgtcgtttcgtttactttttattaagttagtaggttggtaactactactacgtccgcacgtaccgtcggtcggacggggccgttacttcccgaacctagttcccgaaccgaaggtaactaaccgtaaattaccccgaaaagtaacccgtcgtcctttttacgtttaccttaaacgaaaacgttacgaaacgtaccgtaccggtaggtaacggaccggtaccgttaatcccgggaacccgttacggggtacccgtttaagttcgtttaaacgtccggtgggaaccgttaaggacgggtaaccgggacccggggtaaacccctaggtttaaacccgttacgttacgccgttaggaccgggtacggtttccgggacgggtaaacccggg

SEQ ID NO: 183964 - DNA, 810 bp, Homo sapiens
  misc_feature: GYAE6OF02JVUAM.13.76.G10.1.454.CMB.1.raw
  modified_base (193)..(193): a, c, t, g, unknown or other
  misc_feature (193)..(193): n is a, c, g, or t
tcagtcacgtactacacgaccggtgctcgatttagtcactcatacagggggggagagggagcccagcactgggattccgaggtgtttccattcggtgatcagcactgaacacagaggactcaccatggagttttggctgagctgggttttccttgttgtacttaattttaaaaggtcgccctagtgtgaggtncagctgggtggagttcgtgggtaggaggtctttggatccgacggtccggtcgggggggtccctggagtacctccgttcctggttgactcgtccttcggtacggttcctaccgttcgacgtacacctaccctactagtgacgcggttccgggttcccgaccgtacgggcctaccggagggggaacggggcgtaacggtgttcggtccgtttcgttttaccttttagtttacgtaggttaggttggttaacgtacgtactaccgtccgtacgacgtaccgtcggtcggacggggtccgtaactcaccgtaccttacctacgaacggtactaactaaccgtaaccggaaactaccgtaccgttcgtttcgtttaacttaccggtaaagttagaaccgtacgtacccgtaggtaaacgaccggtacgttacgaccggtacccggtacccggttagggttcctttaaagtcggttacgtaacggtcgggtaaacggtacgggtaccggttacccgggaaccccgtttaacggtaacggtttaaccccgtaagtaccggttaacggttaccgggaaccggggtaccgggtacccggggtaaccgggaacccgggttaacccgg

SEQ ID NO: 183965 - DNA, 851 bp, Homo sapiens
  misc_feature: GYAE6OF02FS4LC.13.76.G10.1.454.CMB.1.raw
  modified_base (168)..(168): a, c, t, g, unknown or other
  misc_feature (168)..(168): n is a, c, g, or t
tcagtcacgtactacacgaccggtgctcgatttagtcactcatacaggggagaggagcccagcactgggattccgaggtgtttccattcggtgatcagcactgaacacagaggactcaccatggagttttggctgagctgggttttccttgttgctattttaaaaggngcccagtgtgaggtgcagctggtggagtcgtggaggaggcttgatccagccgtgggggtccctgagactctcctgtgcacgcctcgttcgggttacacccgtcagtccacacctactaatggacgtcgtcggggtcccgacgacgggtacctaccggaagggggtaaacgggggccgttaggggacggttacgggtaccggttaccttttaccgttttttaaagttttaattaaggggttacggttagggttaacggttaactaagttacccgtacccggccgtaaaccggtaccggtacccggtacggggtaacggggggtaccccgtaacgttttacccaacccgttaactaccccgttaaccgaacgggtaacgtaaacccgttaaacgttaaaccccgaaaacggtaaacccaaccggtttaccgtttaccgtttttacccgtaaaccgttaaaacgttaacgtaaacccgacggttacccgtaggtaacggaccggacgtaacgtacggaccgtaccgggtccggttacgttaaacgttacgtacggttacgacggtaacggtaacgtagggtaccggggtaaccccgtaacggttaacccggttacgtaacccgtacgttaacggtacgggtaaccgggttccggtacgggggtacccggtaaccggggtaacccgg

SEQ ID NO: 183966 - DNA, 877 bp, Homo sapiens
  misc_feature: GYAE6OF02GWG6B.13.76.G10.1.454.CMB.1.raw
  modified_base (228)..(228): a, c, t, g, unknown or other
  misc_feature (228)..(228): n is a, c, g, or t
  modified_base (299)..(299): a, c, t, g, unknown or other
  misc_feature (299)..(299): n is a, c, g, or t
tcagtcacgtactacacgaccggtgctcgattttagtcactcatacaggggctgggcctcaggaagcagcatcggaggtgcctcagccatggcatggatccctctcttcctcggctccttgcttactgcacaggattccggtggtccctaccttagtgacgtcttagactccacgccctaccctgagttcgtccgtccgtacccaggacgaagacacgaccagctacnccacctgactaggtaacgaaaattacgttagactaagtaacttaaagtacttactttcgagttactacganaccgtaaggactacggaccggtacctacccgttccgtggtaccgcgttcggtactcgtacgtactaacgaagtctacggacccgtacggcccgttaccgacgtaccgggtccttaccggtacgacgttaccgttacttccggttactaccgggtaccctaaccggttaccgtttacccggggtaaacgtacccgttccggaacccgtacccgtaccgttaccgtaaccgttaacccgtaccggtaccggtacccggggaaccccgggttaaccggtaacggttaccgttacggtaacggtaacggttcggtaacggttaccggtaccgtttaaagttacccgtttacgggacggtttaccggtaacccgggggtttcgaaccggggttaactaaccggaccggtaacccgttaccggtaccccgggttaacccggttcccttaaccggtttcccgggttaaccgggttaaccggttttaaacccgggtaaccggttaaccgggaacccgggtttaccgttaacccgggttaaccgttaaccgggttacccgttaacccggaccccggttaaaccccgg

SEQ ID NO: 183967 - DNA, 859 bp, Homo sapiens
  misc_feature: GYAE6OF02FTMON.13.76.G10.1.454.CMB.1.raw
  modified_base (179)..(179): a, c, t, g, unknown or other
  misc_feature (179)..(179): n is a, c, g, or t
tcagtcacgtactacacgaccggtgctcgatttagtcactcatacaggggggggagaggagcccagcactgggattccgaggttgtttccatttccggtgatcagcactgaacacagaggactcacatggtagttttggctgagctgggtttttccttatttacttaattttaaaggtntccagttgtgaggtgcgagtttgggtgttagtacgtgggagggaggtctttgggtccgagggcccgggggggttaccctggacgtacttctcatggtgccggtccgtcgttgggcctaccgtacccgtaccaaacccaaccgtaacctaaccgataggacgtgttaccggggccccaccggtacggtccgtaccgaaggggacggacggggccggtaagggtgggtcctagtagtttatttagtcgtacgggtacgggtcgtacccgtatactttacgacgcgtaacgtacccgtcggtagggacgggggtcccgttaccaacccggtactcccgtaacggacggaaccgttaacgttaaccgtttaacccggaaaacggtaaccgttaaccggggttacgtttaaacctttaccgtttaacctaaaggttaccggaaacccgttacgtacgtaacgggtcggtaaccggaaccggggacccgtaccggggtccctttaacgttaagttacccgttaggtacgggtaaagtaacggtacgtcggtacgaacggtaaccgggttaccctttacccgggtagggtccgggtaacgggtaggggttaccgttcgggttttacctttggtttaccggcgttaccgggttacgggtccgggtaccgggtaaccggggttaccccg

SEQ ID NO: 183968 - DNA, 865 bp, Homo sapiens
  misc_feature: GYAE6OF02G6T5B.13.76.G10.1.454.CMB.1.raw
  modified_base (569)..(569): a, c, t, g, unknown or other
  misc_feature (569)..(569): n is a, c, g, or t
tcagtcacgtactacacgaccggtgctcgatttagtcactcatacaggggagaggagcccagcactgggattccgaggtgtttccattcggtgatcagcactgaacacagaggactcaccatggtagttttggctggagtcgttcggggtttttcctttgttcgtcttaaagtttttaaaaagggttcggaccctaaggttggtggtaaggttcgacgaggtcgtgggtggtagtcgtgggaggacggtctttggacttcccgacggccggttcgggggggttcccctagggtaccgaccttccgttccgttcggtgaccgtacggtcccttcggttccggggtttacctaccggtacctacggtaccaaccctaaccttaactagtcggacgtcggtccgggtccggccgtacggccgtacggaacggggaacggggtcgtgggtacgtcggtccgtttagtttactttttagttagttaggtacgttaggttaactactactaccgtcgtactaacggtccctacggtcggggtacggggtaccttaactccgtaaccacgtttccnccgtaagactaaaccctacgtaaccgtaaacgaaaccgtcgttacgtttaactttacctaacgtaaaagttaccgtaacgacgtaccgttagggaacgtaccggtacgaaaccgttcggaccggttaacccggtcggttttacgttaacgttcgtacggcgggtaccgaaaggggttcggacggtacccgggggtaacccctaaagggttaaacccgtttacgtaacccggttattaacggggttccggccggtttaccgggggtacccggaacccggggtaagtaaccccccggg

SEQ ID NO: 183969 - DNA, 1059 bp, Homo sapiens
  misc_feature: GYAE6OF02FSAWD.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagtcgttgggttttttccttgttgcttaagttttaaaaggtcgccctagtgtgaggtgcagcgtgggtggagttcgtgggaggaggtcttggacttaccgacggtcccggttcggggggtcccctaggaacgtaaccgttcctaccgttggtcgtaccgacggtcccgttaccggttcgggggtttaccccaaccggttaccgtaaccggttaccccaaccgtaaccccgttaaacgtacgttacgggaccggtaccggggtttccggggggtcccccgaacccggtacgggggtacccgttaacccggggtaacggggggtaaccggggggtcgttaaggggtaaccggtttcgggtacccggttttccgtttttaaaccgttttttttaaggtttaaaccggtttaagggtttaaacggttcgggggttttaaaacgtttaacccgttaaagttttaccccgggcccgtaaccggtaacggttaccccgggtttaccgggacggggtaccgggggtttaaaccctacggttttaacccaacccgttacggtttacccctaaccgggtacgtaaaccggtaacctaaaccggtttaaacccgaaaccgttaacgaccggttttaccgttccgttttaacccgtaaacgttaaacgttaacggaacccttaccggccgggttaacggaacggttaaccggtaaccggtctaacccggggtaaaccggtccgggttaaccccgggttagttttaaccggttacttacggggcgtaacgggtacggtacgggttaacccgggtccggggtaaccccggaaaccgtttaaccgggttaaaccgtacccgttaccggttaacgttaccgggttaccggtacccgggtaacgggttaaccccggggtaacggttaacccccgggg

SEQ ID NO: 183970 - DNA, 890 bp, Homo sapiens
  misc_feature: GYAE6OF02IP9PU.13.76.G10.1.454.CMB.1.raw
  modified_base (216)..(216): a, c, t, g, unknown or other
  misc_feature (216)..(216): n is a, c, g, or t
  modified_base (795)..(795): a, c, t, g, unknown or other
  misc_feature (795)..(795): n is a, c, g, or t
tcagtcacgtactacacgaccggtgctcgattttagtcactcatacaggggggggagaggagcccagcactgggattccgaggtgtttccattcggtgatcagcactgaacacagaggactcaccatggtagttttggctgagtcgttgggttttccttgttgcttaattttaaaggtcgccagtgtgaggtgcagcgtgggtgagtcgtggaggnggcttgactccacggtccggtcgggggggttcccctggacgtaccttcctccgttaggttcgactacgtcccttcggttcgggttacctaccgacctacgtacccaaccgttaacccctactaaggttgaacggtccggttaccgggggtaccccgtaccggaccgggtaccctaccgggggaaagggggaacggggggtcggtgggtacgggtccgttaccggttttaccgtttttaccttttttaagtttttaaccgttagggtttaaggtttacgggttaacggttaacctaacctttacccggtcccgtaaccgtaaccggtacccgttcccggggttagggggtaacccgggtacccgttacccgtttaaccgaccgttaaccgttccgaacccggtaaggtaaaccctaaaccgttaaacgttacccaaaaacggtactacccggtttaactttacgtttacccttaaacctaaggttaacctacgaaccgtccggttaagaccggtactaaccgtgaccggttacaccggggttaacgttttaagtaccgttttagtggaaccgggcgtaanagggttaccgccggggtaacccctaacgggttaccgtttaccgaacgttacgtacggtgtaccgggtccggtaacgggaccgtaacgggtacccg

SEQ ID NO: 183971 - DNA, 741 bp, Homo sapiens
  misc_feature: GYAE6OF02IVE7A.13.76.G10.1.454.CMB.1.raw
  modified_base (330)..(330): a, c, t, g, unknown or other
  misc_feature (330)..(330): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatggtagttttggctgagtcgttgggttttccttgttgcttaattttaaaaggtcgccctagtgtggaggtgctagcgtgggtggagtcgtagggaggaggtcttgactccgaggtccgggtcgggggtccctggacgtaccttcctccgtgtcgcgtacgtccttcgttcgggtaccaccgtcacgtccaaccgtaaccctanagtcgacgtccggtccgggtcccgaccgtacggtccgtaccgggaagggggacgggtcgtgggagtcgtcgttcttttcgtttattagtaggtgtaggtactactactctccgagacgcgttaccggtggaccggtacctactaccgacctactttcccgacgaaggtactaaactaacgtacccgtaaaagaccgtacgttcttacgttttaccaactaacgtaacgtaaccagtacccgtggaaccgaccggtacgtacgtacgaacccggtaccgggttcggttaacgttaacgtacgtacgggtacgtaacggaggtacggtaacgggtccccggtaacccgtaacggtaaccgttctacggtactttacgggaaccgttcgggtacggggtacccggtaaaccggg

SEQ ID NO: 183972 - DNA, 715 bp, Homo sapiens
  misc_feature: GYAE6OF02GBA18.13.76.G10.1.454.CMB.1.raw
  modified_base (139)..(139): a, c, t, g, unknown or other
  misc_feature (139)..(139): n is a, c, g, or t
  modified_base (232)..(232): a, c, t, g, unknown or other
  misc_feature (232)..(232): n is a, c, g, or t
  modified_base (540)..(540): a, c, t, g, unknown or other
  misc_feature (540)..(540): n is a, c, g, or t
  modified_base (627)..(627): a, c, t, g, unknown or other
  misc_feature (627)..(627): n is a, c, g, or t
tcagtcacgtactacacgaccggtgctcgatttagtcactcatacagggggcctgggcctcaggaagcagcatcggaggtgcctcagccatggcatggatccctctcttcctcggcgtccttgctttactcgcacaggntccgtggccttcctagtggagcgtcgactcacgcccacccctgacgttcgttcccgtcgtcccccgaggaccacgacaccgccacgctttacncctacctggtaccttacgtaacggtaaaattaaacggttcggaactaaggtaaatttaaaacgttaccttaccgtttacgttacggttagtacctaacgacctaaggtaaacggtcaccgggggggggtaccctaccggttccccgtggttcgtaccggttccggtacctacgttacttacgtacgaagtacgtacgaccggacggttcccggccgtaccggtacggtaccgtacccgtaggaccggtacgttcggttacttcggtcgacctaccgtacgtcggttaccggaccgtcgcgtaccgtcncgtacacgtacgtccgacggccggacgtcgcgtagtacgtgacgcgtaccgcgttatacgtacgtacggcggacgtcggaggtaccncgcgacgcgtcgtccgccgtctggtacgttaccggacggtacgtaccggtacgtccgtaccgtgaccgtaccgtcgaccgtaacccgg

SEQ ID NO: 183973 - DNA, 738 bp, Homo sapiens
  misc_feature: GYAE6OF02JO4PO.13.76.G10.1.454.CMB.1.raw
  modified_base (215)..(215): a, c, t, g, unknown or other
  misc_feature (215)..(215): n is a, c, g, or t
  modified_base (368)..(368): a, c, t, g, unknown or other
  misc_feature (368)..(368): n is a, c, g, or t
tcagtcacgtactacacgaccggtgctcgatttagtcactcatacagggagaggagcccagcactgggattccgaggtgtttccattcggtgagtcagcactgaacacagaggactcaccatggagtttggctgagctgggtttccttgttgactatttaaaaggtgcccagtgtaggaggtgcagctgggtcggagtctggaggtaggcttganccgtacgccgtacggggggtccctcggagactcgtcctaggttcgctacggcctcgttcggggttaccgtaccgtaccgacggttcctaacctacccccgtaagtaccgtaggtaccggtcggtccggggtccccgacccggacggttccccncggtaacgggggacgggggtccgtaagggtagtcgggtccgttcggttaccgtttttatttaggtaacgttaggttggtaaacggtctactaccgtctcggtagtacccgtcggtggtacgggcgtactctacgtctgacccgagacactaacgtaccgacgtaacacgtcgttatttaccgttactaatacgtaaccacgtctacggacgacggtacgacgtcgaacgaccggtaccggtacgttaacgttaacggttcgcggtacggtaagtaccggtaggtcccgggggtaccctaacgggtaccgttaccgtaacgtccgttacgtacggtccgtacgggtccggtacggaaccgggtaacccggg

SEQ ID NO: 183974 - DNA, 959 bp, Homo sapiens
  misc_feature: GYAE6OF02GWROY.13.76.G10.1.454.CMB.1.raw
tcagtcacgtactacacgaccggtgctcgatttagtcactcatacaggggggagaggagcccagcactgggagttccgaggtgtttccattcggtgatcagcactgaacacagagactcaccatggagtttggctgagctgggttttccttgttgcttaattttaaaaggtcgcccagtgtgaggtgacgagcgtgggtggagtcgtgggacggtaggtcttggatccgtaggcccggttcgggggggtccccttggaacgtacctccgtccttggtcgacgacgtccgttcctggtaatttccattctttcgagttagagtttaatcggaccaacgttgtaccgtcgtttacgggggtacccggacgtaacggtccgtacccggtaaggggaaccgggtacccggtagggtaggggttacgggttcctaccggtaaggggtttaacgttaacgggttttacggtaaaagttacgggttaaggggtaaaccctaggttaacggtacgttaacgtcgggtacgggtaaccttcgggttagggtacggggtaaacgggtaccggttaacgtttaacccgaacccgttaaaccgttacccgtacccgttaacgggaaaccgaaacccggtaaacccggaaacccgttaaaaaccccggtaaaccccgtttaccccggttaaacggtttcgtttacccgaacggtaaaccctaaaaggtttaacgaaacccggttaaacgtaacccggttagggaaaaccgtaggtcccggtaaagggttacccgggaaacccgttagggttaaccccttttaaggttacccgtttaaccggtacgtttaacccgggaaaaaccgtttaaacccggggttaacccgtttaaaggttttaacccggccgttaaacgggttccgggttaacccgtttccccgggggttacccttttaaccccgtttaacccgggg

SEQ ID NO: 183975 - DNA, 852 bp, Homo sapiens
  misc_feature: GYAE6OF02H20D0.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagtttggctgagcgttgggtttttccttgttgtcttaagttttaaaaggtcgacccgtagtgtagtaggtgcagtcgtgggtggagttcgtgggagggagtcttgactcgcggtccggtccgggggtccctggtacgtacctcttccgtgtcgcgtcgtcctcggttacggttccaccgtcacgtcctacctaacctactagtgacggtccggtcgggtcccgaccgtacgggtccgtaccggggaacgggggagggtccgggttaggtcggttacggttcccgtttacgtttttacgttttaattttacggtaaggttacggttaggttaacgtacttacgttaccgtaccggtacacggtaccgttccggggtacgggtaccgggtaccgttaccgtacccgtaacgtccgtaccgtaacccggtaaagaacgtttaaacccctaagttaaaccccaaaggtaacccttcggtttactttacggtttaaccctaaagttaaacgtaccggttaaacccgccggttaaccgtagggaacgtaaccggtaccgttaaagtacccgggaacccggtaaccggggttccttaaggtttaccgttacggttacggagttacgggaagttacggtacggggtacccgggaaccccttaaacgggtaccttaaccgtacgacggttcgttaacggggtcgttaccggggaccggtaacgaccggtaccg

SEQ ID NO: 183976 - DNA, 794 bp, Homo sapiens
  misc_feature: GYAE6OF02H3LXO.13.76.G10.1.454.CMB.1.raw
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatgggagttttggctgagcttgggttttccttgttgcttattttaaaaggtgcccagtgtgaggtgcgagctgggtggagtcgtgggaggaggcttgatccgagccgtcggggggtccctggagactctccgtgtgcacgcctctcgggttcaccggtcagtcacaccacatgacgcgtgggtcccgcnggcctcggacggggagggacgngggagtcggtcgtcgtttagttttatttacgtagttaggtaggttagtaactagtaccgtccgacgtacgaacgttcccggtagggacggggtaccgtacgttccgaccctacgtcctaccggaagaaccgtaaactaacgttacccgaaaagaaaccgacgttacgttgttttacccgttaaactaaacgttacgaaaccgtacgtaaccctccgggaaaggaccggtacccggtaacgtaccgggtaaccccggtaccggggttaacccggtttccggtaaaagttttccggttacgggttaaacgggcccggggttaaaatacgggggtaacgggtaccccgggggggtaaccctaaaacccggttaacccgggtttaaacccgtacgggtttaaccccgttagggttaaccggggttaccgggtcccggggtttacccgggtaaaccccggggg

SEQ ID NO: 183977 - DNA, 941 bp, Homo sapiens
  misc_feature: GYAE6OF02JXXGU.13.76.G10.1.454.CMB.1.raw
  modified_base (362)..(362): a, c, t, g, unknown or other
  misc_feature (362)..(362): n is a, c, g, or t
tcagtcacgtactacacgaccggtgctcgatttagtcactcatacagggggggagaggagcccagcactgggattccgaggtgtttccattcggtgatcagcactgaacacagaggactcaccagtggtagtttggctgagtcgttgggttttccttggttgtacttaagtttttaaaaggtcgtccctagtgtggtaggtcgcgtaggtttgggtgggaggttccggtagggagggtacggtccgttcggtccgacggtcccgggttcgggggtaccctggacgtccgttcctcgtgtacgctaccgtcccgttcggttccggttacccgtaccgttcgaacgtaccaacccgtaccgtanacgtacggaccgttccgggtccgggtccccgacggtaccgttcccgaaggggaaggggtccgttggacgtggtccgtcgtttacttttaattttagtagtacgttggttagtacgtacgtaacctccgtacgacgaccgttccggtaggaccggggtcggtaacttcgtaaccgacttccgtaccgagaagtaaccgtaacgtaccaaacgtaaaccgtaaccgtacgtttaccgtttacgtttaactaaaacgttaacgaaccgttaacggccgtttaacggacggtaaccgtaccggtaacgtaacggtaccggtaacccggtaacccggtttacggttaaccgtttaacggttaccggttcggtaacccgggtaaaggttaaccggtaaaccggggttacccggggaacccccgttaaacggtttaaccccgggttaaaacggtttaccccgtaaccggtttaaacggttcggggttaaaccccggggttccccgggttaaacggggtaccccggggtaaaaccccggggttaaacccgggaccccccgggttttaaaacccgggttccccccggg

SEQ ID NO: 183978 - DNA, 705 bp, Homo sapiens
  misc_feature: GYAE6OF02FSYJ6.13.76.G10.1.454.CMB.1.raw
  modified_base (225)..(225): a, c, t, g, unknown or other
  misc_feature (225)..(225): n is a, c, g, or t
  modified_base (413)..(413): a, c, t, g, unknown or other
  misc_feature (413)..(413): n is a, c, g, or t
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (517)..(517): a, c, t, g, unknown or other
  misc_feature (517)..(517): n is a, c, g, or t
  modified_base (627)..(627): a, c, t, g, unknown or other
  misc_feature (627)..(627): n is a, c, g, or t
tcagtcacgtactacacgaccggtgctcgatttagtcactcatacaggggggagaggagcccagcactgggattccggaggtgtttccattcggttggatcagcactgaacacagaggactcaccatggagttttggctgagctgggttttccttgttgcttatttttaaaaggtgccagtgtgaggtgcgagtcgtggtggaggttctgggagggaggtcttgntcccaggcccgtgggggtcccctgacgtacgtcctccgtggtcgcacgtccttcgtgggttccgaaccgttccaggtcctacctaacctacactggagtcgcgggttcccgccctagggcccttacccggagggggaaccggggtcaggggtcgtacgggccgtcttccggtttttattttaaaccgnggttacgtggttacggttaacngtttaaccncccggataggactccgtggaccgggcgattccggacctgtctacacgagacctagtacccaagaccatccgtntttaccttacgtaacttacggtaacaacgtccgtaagacgtaccgacggtatacggaacccgtagggtaccccgtagtttcgtaaacgttcgttaaggccgaggttacgnggtcccgggaaccaacggaacccgttacttaccggacgttatccgggtacgtcgttaccggggcgtaccggaacccgg

SEQ ID NO: 183979 - DNA, 808 bp, Homo sapiens
  misc_feature: GYAE6OF02H5GEF.13.76.G10.1.454.CMB.1.raw
  modified_base (351)..(351): a, c, t, g, unknown or other
  misc_feature (351)..(351): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagcttgggttttccttgttgctatttaaaggtgcccagtgtgaggtgcagctggtggagtcgtggaggaggtcttgactccagccgtcgggggtccctgagtactctcctgtgcagtcctcgtgggttaccaccgtcacgtaccaccgtacctaccagtggacgtcgttcgggcccgccgacggccgtccgaagggggaaggggccgtagggngtcgtccggttctttacgttttaagtttagtaggttacggttaggtacgttacgactaccgttccgacgacgtaccgtcggtacggacggggtacccgtaattacccgaaccgtacgttaccgtaccgaagacgtaccgtaaaacgttccccgaaaaggtaacccgtacgttaccttcggttttaacctacgtaaagtccgaaacctacggtccctaaagggacgtaacccgccggtaagttaccggtaaccgggtaccccggggtttaccttaggtttaaaccgtttacggtacgggtacgtaccgggtaaagggaccggtttacggggtaacccgggggacccctttaaacgggtttaacccgttaacccgttacccggttaacgttacggggtttaccgggacccgtttacccgggggtaagggggtaccccccggaaaagggttccccccggg

SEQ ID NO: 183980 - DNA, 774 bp, Homo sapiens
  misc_feature: GYAE6OF02HG6E1.13.76.G10.1.454.CMB.1.raw
  modified_base (366)..(366): a, c, t, g, unknown or other
  misc_feature (366)..(366): n is a, c, g, or t
tcagtcacgtactacacgaccggtgctcgatttagtcactcatacagggggggagaggagcccagcactgggattccgaggtgtttccattcggtgatcagcactgaacacagaggactcaccatggtagtttggcctgagctgggttttccttgttgcttaagttttaaaaggtcgcccagtgtagaggtgcagctgggtcggagttcgtgggacggaggtcttggacttcccgagtcccggtcggggggtcctggacgtactcctcctgtcgcacgcctcggtggtccgccgtcacgtccaacctaacccgacagtcggacgcggtcgggtcccgacgaccgtccggaccggacggggacgggnggtggtacggtccgtcgtttctttctttttaagtagttacggtaaggttaacggtagtacctacgttacccggtaccggtaccgtacgtaacccgtccgggtaggggcccggggtaacccgttgttaccccgaacctcggttccctaaacccggaacgtaaccgaacgttaacctaaccccgtaaacgtaacccgtacgggtcctttacggtttacccttaacgtaaacgtacgtaaccgacgtaccgtacggaagtacggtacgtaaggtccgtacggtaccgttcccggtagtttaaccgttacgtgtacggacgtagacggtacgggcggtaccctaacggttaaccgttaaccttacgtaccgtacgttcgggaccggtcgggaccggacggaccgggtacccg

SEQ ID NO: 183981 - DNA, 933 bp, Homo sapiens
  misc_feature: GYAE6OF02JRDZ7.13.76.G10.1.454.CMB.1.raw
tcagtcacgtactacacgaccggtgctcgatttagtcactcatacaggggggagaggagcccagcactggattccgaggtgtttccattcggtgatcagcactgaacacagagactcaccatggagtttggctgagcttggttttccttgttgcttaagttttaaaaggtcgacccgtagtggtgaggtgcagctgggtggtacgtcgtagggaggacggtcttgacttcccgacggtcccgggttccggggggttccccttagggtaacgtaacccgttccttacccggtggttaccgccgtaccgttcccgttaccggttcgggttccccgtaccgttacccgtacggtacccaacccctaaccgtaaccgtagtaccggtaacggtcccggttcgggggtcccccgaccggtaacccggggtacccgtacccggggaaacggggggtaaaacgggggtccgttaggggtaacggttccgggtccgttttacccgttttacttttttaaagtttaaccggtaaggtttaacgttacgggttaaaacttaaccgtaaccgttccgttaccgtacctaaacggtacccgttcggggtaacgggtaaaccgggtcccgtaaaccgtccaacccggtactaccggttaccgaacgtaaaccgtaactaaaacccttaacccgaaacgtaacccgtaaaccgtccgtttaacttttaaccgttaaacttaaaccggttaacggaaaccctaggtaccgtaaggtaccgacggtaaccgtacgtaaccgacccgtaccggtaaccttaggttaacgttcgtacggttacgacgtacggtacgtacggtacccgggtaacccgaacgttaacggtaaccgttacggtaaccgtagggtcccgtacgtaccgggtacgggacccggtacgggaacccgg

SEQ ID NO: 183982 - DNA, 936 bp, Homo sapiens
  misc_feature: GYAE6OF02JEHFZ.13.76.G10.1.454.CMB.1.raw
  modified_base (567)..(567): a, c, t, g, unknown or other
  misc_feature (567)..(567): n is a, c, g, or t
tcagtcacgtactacacgaccggtgctcgatttagtcactcatacgagggggggagaggagcccagcactgggattccgaggtgtttccattcggtgatcagcactgaacacagagactcaccatggtagttttggctggagtcgttcgggtttttttcctttggtttgtctttaaagtttttaaaaacgggtcgcccctaggttggttaggtagggtgacgacgtcgtgggtgggagttcggtagggagggtagggtccttagactccgacggtccggtacgggggggtccctgacgtaccttccgttccgtgtcgacgacgtccttacggttcgggtttaccgtaccgtaccgtacgttaccaacctaccttactagttcgacggtcggttaccgggtccccgccgacgggtaccgtaccgggaggggacgggtcgtaggtacggtcgtacgtttctttctttttaagttagtaaggttacgttaggttacgtacctacgtaccgtccgacgaaccgtacgtccggtacgggtacgggtaccttaccgttaccgacccgtttacncccgtaccgaaggtaaacctaacgttaaacttaacccgaaaacgaccccgttggtttaccgtttaacggtttttacctaaacgtaaaccgttcgaaaccgacgttaacccgtaggtaaacggccgtaaccgtagtaccggtaaccggttacccggttacggtttaaccgggtttattttacccgggtaggttaaccgggtaaccgggacggttaccgggttaccggggaacccggggttaaccctaaacccgggtttaaacccggttaacccggttacgttacccgggtttaacgggttaccggggttacccggggtttacccggggtttaaacccggggacccgggtaaccccgggttaaaccccggg

SEQ ID NO: 183983 - DNA, 807 bp, Homo sapiens
  misc_feature: GYAE6OF02I5VGW.13.76.G10.1.454.CMB.1.raw
tcagtcacgtactacacgaccggtgctcgatttagtcactcatacagggggggaggaggagcccagcactgggattccgaggtgtttccattcggtgatcagcactgaacacagaggactcaccatggagttttgggctgagctgggtttttccttgttgcttaattttaaaaggtgacccagtgtgaggtgcagcgtggtggagtcgtggagggaggtcttagaactccgaggccggtcggggggtccctgacgactctcctgtgcgacgtccttcgttcgggttccgtaccgtcgacgtccacctaccgtaactagtgacgtcgtcgggtcccgccgacggtcctcggaggggacgggtcgtaggtagtcggtcgttcttacttttaagttagttaaggttaggttaggtaacgttaacgtactacccgtaccgacgaacggtaccgttaccgggtacgggacggggtaccgttacgttaacccaacccgtacttacccgtaccgaaggtaaaccggtaacctaaaccgttttacccgaaaacggaaaccttaccggtcgttttaacgtttacctaaacccgtaaaagttaaccggaaccgtacgtacccggtaagacggtacgtacccggtaagtccggaaacccgccggggttaccttagttaacgttaggtcggaaggtaccgaaggtacggtaaccggtccggggaaccctaaacggttaaccgtttaaggtacccgtaacttacgggtaccgggttaccgggtacccgggtaacggggaaccggtaacccgggtacccgg

SEQ ID NO: 183984 - DNA, 795 bp, Homo sapiens
  misc_feature: GYAE6OF02HRLUF.13.76.G10.1.454.CMB.1.raw
  modified_base (113)..(113): a, c, t, g, unknown or other
  misc_feature (113)..(113): n is a, c, g, or t
  modified_base (169)..(169): a, c, t, g, unknown or other
  misc_feature (169)..(169): n is a, c, g, or t
  modified_base (267)..(267): a, c, t, g, unknown or other
  misc_feature (267)..(267): n is a, c, g, or t
  modified_base (310)..(310): a, c, t, g, unknown or other
  misc_feature (310)..(310): n is a, c, g, or t
  modified_base (600)..(600): a, c, t, g, unknown or other
  misc_feature (600)..(600): n is a, c, g, or t
tcagtcacgtactacacgaccggtgctcgatttagtcactcatacaggggtctgggagaggagcccagcactgggattccgaggtgtttccattcggtgatcagcactgaacncagaggactcaccatggagtttggctgagtctggtttcctgtgctattttaaaggngccagtgtgaggtgcagcgtggtggagtctagggaggacggtacttgactaccgaggtccggtacgggggtcctgacgtacctctaccgtggtcgcgnggtacctcggttcggtaccgtacgtcacggtacaccaccgtanaacgtgtagccgtcggggtccaccgtaacggccgtacggaaacggggcgggtcgtaacgggtggtccgttacgttaccgtttaactttttaagtttataggtaacggttcggtactaacttaacgttaacgtccggtaacacgtaacggtccggttagggaaaccggggtctaacggtttccaaccggttactaccgaccccgtaaagggtaaccgtaaacttaaacggttaaacccaaagtaaaaccgtccgttacgtttagtttacctaaacgtaactacggtaaaancggttaccaaggacgtaacgtcccgtaagtcccggaacgttaccggtccgtttaacggtaaacgttccgtaggtacgaccggggttaggaacccgggtcggggttaacccgaacccggttaaggttaacccggttcctaacgggttaacgttaggtaacccggggtttacgtaccgggggtcccaaaacccgggg

SEQ ID NO: 183985 - DNA, 749 bp, Homo sapiens
  misc_feature: GYAE6OF02FW8AG.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggtagttttggctgagcgtgggttttccttgttgcttaattttaaaaggtgcccagtgtgaggtgcagctggtggagtcgtgggaggaggtcttggactccgaggtcccggttcgggggggttcccctaggaacggtaccctccgttcccgttggttacggtttacgttttccgtcggggtccttaccgtaccggttttggttcgtacgttccggtcgccctagtcgacctacggttcggggtccccaaccgtaaaacgtcccggaacgggggacggtccgtgggtacggttgggtcgtacggtaggttatttaggtagggaactagtaggtaaagtaacgtagggtatgggacgtactcgtggtacggaacgggtccgtagtacccaacgtacttccgtacgagtaacgtaacctaacgttaccaaaacggtacgtaccgtcttacgtttactaaaccaagttacgaaacgtcgtacgtacgaaggacgcccgtaagtcgaaccggacggtccttagtacgttgtaggtcgaggtaggcgtacggccgggtaccctaaggtaacctttccgaaggtacttacggtggccgtacggggcgggtaaccgacgggtcccgtaccgg

SEQ ID NO: 183986 - DNA, 821 bp, Homo sapiens
  misc_feature: GYAE6OF02JIPMF.13.76.G10.1.454.CMB.1.raw
tcagtcacgtactacacgaccggtgctcgatttagtcactcatacaggggggagaggagcccagcactgggattccgaggtgtttccattcggtgatcagcactgaacacagaggactcaccatggtagttttggctgagcgttgggtttttccttggttgctaattttaaaaggtcgcccagtgtgaggtgcgagcgtggtggagtcgtggaggagcttgatccagtccgtgggggtccctgagacctctccgtgtcgcagccgtcgtcgggttccaccgtcagtcacctacctacagtcgagtcgtcgggtcccgccgacggtcctccggaggggacggggcgtgggacggtcggtaccgttcgttttactttttaacgttttaagttaacgggttaggttaacgggttacgttaactaacgttaacccgtcccgtacgtaacggtacccgtacgggtacgggtacggggggtacccgttaacgtttaccccaaacccgtacgtttcccgtacccgtaacggtaaccgtaaacctaaacgttttaaccccgaaacggtaaaccgtaaccggttcctttaaccggtttttaccttaacgtaaaccgttaacggttaaaccaacgtacccgtacgtaacggacggaccgtacgtaacgggacccgtacgggtaccgtgtttaaccgtttacgtacggtacgtacgtacgggagttaccggccgggtaacccgtaccggttaaccggttaacccgttacgtaccgttaacgtacgggtaaccggttcgggtaccggggtaacccggaacgggtaaccccggg

SEQ ID NO: 183987 - DNA, 700 bp, Homo sapiens
  misc_feature: GYAE6OF02HW3EX.13.76.G10.1.454.CMB.1.raw
  modified_base (297)..(297): a, c, t, g, unknown or other
  misc_feature (297)..(297): n is a, c, g, or t
  modified_base (531)..(531): a, c, t, g, unknown or other
  misc_feature (531)..(531): n is a, c, g, or t
tcagtcacgtactacacgaccggtgctcgatttagtcactcatacagggggggagaggagcccagcactgggattccgaggtgtttccattcggtgatcagcactgaacacagaggactccaccatggagttttggctgagcgttggggtttttccttgttgacttaattttaaaaggtcgcccagtgtgaggtgcagctggtggagtcgtagggaggaggtcttgactcccgaggccggtcggggggtccctaggagtacctctccgtgtgccagtcctgttcggtcctaaccgtntacgtccaacctacctacatgacgtcgtcgggtcccgccgacggtcctacgggaacgggggaacgggcgtagggacgtcggtccgttacgttttattttactttagtagttacggtaggttaactaactactaccgtccggagtaccgtaccggtcggtacgggtacggggccttaacgttccacctctccgacctaaggaactaaacaccgttaacaaacgtaacgtaccgtnttacgtttactaacaaagtaccgaaacgtctaccgtagaacgtaccggaccgtagtacgacccgtaacccgggtcttaagttactacggtgtcgacgagagtacggcggtccaggttacgaacttacgacgtacttacggcgttaccggtcggaccggtacgtaaccgg

SEQ ID NO: 183988 - DNA, 952 bp, Homo sapiens
  misc_feature: GYAE6OF02HTQPL.13.76.G10.1.454.CMB.1.raw
tcagtcacgtactacacgaccggtgctcgatttagtcactcatacaggggagaggagcccagcactgggattccgaggtgtttccattcggtgatcagcactgaacacagaggactcacatggagttttggctgagtcgttggtttccgttgtgtcttaagttttaaaggtcgtacctaggtgtggtaggtgacgtaggttgggtggtagtcgtgggagggtacggtcgtttcgggaccggtacggggtcccggggggggtcccttaggaacggtaccgtccgtccgtagtacggtcggccggtccgttcggtcgggtccttaccaaccgtactaacccgtaaccgtaaccctaaacgtactaagtcggacggtaccggtccggggaccccgtacccgtacgggtacccgtacccggaaggggaacggtaaccggggtccggtacgggttacggttccgttacggtttaaggttttaacgtttaacggttcgggttaaccggtaccgggtaccggtaccgtaaaccgttacgtttaccggtaccggtaaccggtaacggttacccggtttacccgggtacgggtacccgggggttcccgtttaaccgtaaccttcccgttacccgtaccgaacgtaacgaaaccgtttaaccgttaacccgaaacggtaaaccggttacggttaacgttaaccgttaacgttaaccggtaaacggttaaaccggtaaccggttaaccgttacgggtaaacggacggtaacgggtaaccggaacccggaacggtttcccgtaaacgtttaaccgttacggtccgtacggtaaaccgtaaacggtacgtcgtaacggtacgaccggggtacccggtaacccggtcgggtccggtacggttacgggttaccgttacgggtttcttaacggttcggaccggttcgaccggggttcgggtaacccgg

SEQ ID NO: 183989 - DNA, 715 bp, Homo sapiens
  misc_feature: GYAE6OF02GL26S.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttattttaaaaggtgcccagtgtgaggtgcagctggtggagtctggaggaggcttgatccagccgtgggggtccctgagactctcctgtgcagcctcgtgggtccaccgtcagtcacacctacatgacgcgtcgggtcccgccgaggtccgtaccggaaggggaacggggctagggtaggtcggccgttactttacgtttttaattttaacttaggttacgttagggttaacttaacgtaacgttacctccgaccgtagtaccgtccggtagggacggggaccgtacttacctacctacgtcctaccgaaggactaacctaaactttacccgaaaacgtaacccgtacgtctttacgttttacctaactaaaatacgaaacgtacgacctagaacgacgtaccgaatacggaaccgtacgggtaccgtagttaacttgtgtacggaccgtaggtacgacgggtacggggaaccccgtaaacgtttaaccgtaaccttaccggtaactaacgggtcggtaacccggttgaccgggggtaacccgaacggggtaccccg

SEQ ID NO: 183990 - DNA, 703 bp, Homo sapiens
  misc_feature: GYAE6OF02G41K2.13.76.G10.1.454.CMB.1.raw
  modified_base (583)..(583): a, c, t, g, unknown or other
  misc_feature (583)..(583): n is a, c, g, or t
tcagtcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcacgcccaccctcagtgtccgtcgtcccaggacagacagccagcactccacctgcttcaaggtaaaattaagttggacaagtaattaaactacttaccttccttaggtactacagacaagaagtcgacggcctaccggtccctgtcgtcgttggtctaacgttctacttacgaagtctacggacccgaacggtcccggtcccgtaccggaagggtccctaccggtgtacggccttacttccgtcgtcgtacctaccgtaacttccgtaacgggacctacgaccgtcctaactcctaccgaaccttacgtacggaccggtaccgggaacccggaggttacctacgggtaggaacgttcgggtacgtaccttacgtaaccttactttaaccggttcggtaacgggaccgggtcgtaacgggtaccnggtacctacggccgtacgtcccgtccgtagttaccgtcggtttaccggtacggtaacggtccggtaacccgtacgttacccggacccttaaccggtaccgtacccggacgtaacccccgg

SEQ ID NO: 183991 - DNA, 885 bp, Homo sapiens
  misc_feature: GYAE6OF02HP0UC.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtcttaattttaaaaggtcgcccagtgtgaggtgcagctggtggagtcgtggaggaggcttgactccgagtccgtcggggggtccctgacgacctctccgtgtcgcacgccttcgtcggtcaccgtcacgtcactacctacagtgacgtcgtcgggtcccgcgacggccgtaccggaagggggaacggggtcgtgggacgtcggtccggttctttctttttaagttacgttaaggttacggttaggttaacgtaactaacgttaacccgtcccgtacgtaacggttacccgttaccgggtacggggtaaccgggggacccgttaacgtttacccaaacccgtaccgtttaccgtacccaaagggtaaccgtaaacctaaaacgtttaccccggaaaaagtaaacccgtccggttactttacggtttttaaaccctaaacgaaaaggttaccgtaaaccggtacggtcccgttaaagggaccggtaaaccggtccgggtaaacgttaccgggaaacccggttacccgggggtaccctttaagggtttaaacccttttacgggtcggttaacgggacccgtaaagggaccgggttaccggggtaacccgggggaaaccccctttaaacggggtaaacccttttacccggaaacccggttgttaaagggtcccggggttaaacccggtcccgggttaacgggggggaaccccctaaacggggggtacccccc

SEQ ID NO: 183992 - DNA, 647 bp, Homo sapiens
  misc_feature: GYAE6OF02GRJHK.13.76.G10.1.454.CMB.1.raw
  modified_base (175)..(175): a, c, t, g, unknown or other
  misc_feature (175)..(175): n is a, c, g, or t
  modified_base (352)..(352): a, c, t, g, unknown or other
  misc_feature (352)..(352): n is a, c, g, or t
  modified_base (468)..(468): a, c, t, g, unknown or other
  misc_feature (468)..(468): n is a, c, g, or t
  modified_base (513)..(513): a, c, t, g, unknown or other
  misc_feature (513)..(513): n is a, c, g, or t
  modified_base (554)..(554): a, c, t, g, unknown or other
  misc_feature (554)..(554): n is a, c, g, or t
tcagtcacgtactacacgaccggtgctcgatttagtcactcatacaggggctgggcctcaggaagcagcatcggaggtgcctcagccatggcatggactccctctcttcctcggcgtccttgcttactgcacaggactccgtggcctcctatgagctagactcacgcccaccctnagttcgtcccgtgtccccgaggacacgacacgccagcatcacctgcctcgaagaaattaatcggacaagtaataaagtactacttcctggtatcagctaagatcaggccacggtccctggtgctggtcatctagcaagatcgacaacggtccgccctacgagggcctacccgtaggngtaccgtacttcctacgtcggtacctaccctaaccgtaccgtagggtaaacccttgaaccgcctaccttccgcgaaccctagtccgacgggcccgggaacccggtagacttacggnggtactggaccgggtctacggtactttacttacgtacggttacgngggtcgggacggtacgaccgtaggacctccgacccggttcncccgtgttacgtcggttaccggtccggaacggttcggaaccggtaccgttaccgtaacccgttaccgtaacgtcccgaacggtaaccccccgg

SEQ ID NO: 183993 - DNA, 713 bp, Homo sapiens
  misc_feature: GYAE6OF02G6OSQ.13.76.G10.1.454.CMB.1.raw
  modified_base (185)..(185): a, c, t, g, unknown or other
  misc_feature (185)..(185): n is a, c, g, or t
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
  modified_base (547)..(547): a, c, t, g, unknown or other
  misc_feature (547)..(547): n is a, c, g, or t
  modified_base (552)..(552): a, c, t, g, unknown or other
  misc_feature (552)..(552): n is a, c, g, or t
  modified_base (585)..(585): a, c, t, g, unknown or other
  misc_feature (585)..(585): n is a, c, g, or t
tcagtcacgtactacacgaccggtgctcgatttagtcactcatacaggggggagaggagcccagcactgggattccgaggtgtttccattcggtgatcagcactgaacacagagactcaccatggagttttggctgagcttgggttttcctgttgcttaagtttaaaggtgcccagtgtgaggtncagctggtggagtcnggaggagtctgatccagcggtcggggcctgacgactcgtctcgtcncacgtcctacgtcggtactaccgtcagaccactaccgtacagtagacgcgtacggccgtccgaacggtccgaccggaaggggaacgggccgtgggtagtccggtcgttctttacgttttaagtttacgtaagttaggtagttaacgttaactacgtaccgtaccgtacgacgtacccgtacggtcgggaggtacccggtacttaccgaaccgtctcgtaccgagacaactaacgtaaccaacgaccgtacgtcgtcgttttaccaacgttaacgtacgtaaccgtacacgtacaagtaccncgtanaacccgtcgaccgtcgttacgtttatacggttntaccgtagacgtaacgtcggtaaccgggtaacccgaacggtttaaccgttaaccgtaccgtaacccggttaacggtcggttaacccggtacgggtttacccgggaaccgggaccggtaaacccccggg

SEQ ID NO: 183994 - DNA, 773 bp, Homo sapiens
  misc_feature: GYAE6OF02GFF9U.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatcggagttttggcctgagctgggttttccttgttgcttaattttaaaaggtgcccagtggtgaggtgcagctgggtggagtcgtggaggaggtcttgatccgagtccggtgggggggtccctggacgactctacattggtcgccggtcctcggtcggggccttccgacccgtacaaaccaccaaactacatggagtcgtcgggtcccgaccgacggtcctaccggaaggggaacggacgggaccgggtaggttcgggtctacgtagtttacgtttagtcggtacggtacgggtcgacccgtactactttacgaccggtacgtacggtaaccgttcccgggtagggtaacccgggggggttcccgttaacccgacccggttaaccttccccgttaccgaacggtaaacgggtaaccctaaacgttaacccgaaaaacggtacccgtaacgggttacgtttaaccgttacctaaaccgtaaagttaccggtaaaccgtaccgttagggacggtaacggtacggaacggtaccggaccggtccgttacttaacttccgtgaccggaagtaagagtcagaggtaccggaccggacccggtaaggtccgggtcgtgggtacggtacggtttccttagttcggagtcggtccggg

SEQ ID NO: 183995 - DNA, 855 bp, Homo sapiens
  misc_feature: GYAE6OF02JLSA5.13.76.G10.1.454.CMB.1.raw
  modified_base (637)..(637): a, c, t, g, unknown or other
  misc_feature (637)..(637): n is a, c, g, or t
tcagtcacgtactacacgaccggtgctcgatttagtcactcatacgagggggggagaggagcccagcactgggatttccgaggtgtttccattcggtgatcagcactgaacacagaggacctcaccatggtagttttggcttggacgcgttcggggttttttccgtttggtttgtctttaaagtttttaaaaacgggttcggtcccctaaggttggttggtagggttggccgtaggtcgtggggtgggtagtcggttgggagggtacggtccgttttgaacttcccgtacggtcccggttcggggggttccccttacggtacggtaccgttccgttccgttcggttcgtaccgtaccgtcccgttcgttacgggttcccacccgttaccgacgtacctaaccgtaacctacctaagttcgacggtcggtacgggttccccgaccgtaccgggtcccgtaccggtaacgggggaaccgggtcggtaacgggtacggttcggtcccgtttaccgttttacgtttttaagtttaggttacgttaggttagttacgtaacgtacgtacctacgcgtacgacgttcggaggtcggacgttactacgactctacacgaagactaacgtactaaccgaagaccncgtgttccgttactaactaagtacacgcgtccgtagtaacacgtaccgaaggttaccgaaccggttcgttagttcttaaccggtgtacggacggtagtaaggtccggtaccgggtaaccctaacccggtttaacgttacgtaaccggtaccggttagttaaccgggtccggtaccgggtttaaccgggaacccggttaaccgggtaacccgtacccgg

SEQ ID NO: 183996 - DNA, 795 bp, Homo sapiens
  misc_feature: GYAE6OF02FO2N5.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtcgtggaggaggtcttgatccagccgtggggggtccctggacgactctcctgtcgcacgtcctcgtcggggttccaccggtactacgtaccaaccaaccttacagtcgagtcgtcggggtcccgaccggacggtccgtacccggaaggggaacggggtcgtcggggaacggttcggtccgttctttacgtttttaacttttagttaaggttaggtacgggttaacgttactaacgttaaccgtccggtaccgtaacggtacccgttccgggtacgggtacgggggtaccccgtaacttacccgtaacccgttaaccttacccgttacccgtaaggtaaccgaacgttaaacttaccccgaaaaggtaaaccctaaccggtccgtttacgtttttaccaacttaaaacggttagaaacccagggttaccctagggaactccgacggtaacgtccgaccgtaccgggtcgttacgttaacgttacgtcgacggtaccgtaagacgtaacggtccggggaacccctaacggttaaaccgttcgaaccgttcgtagttccgggaccggttcgggaccgggtacccgtaaggggtacccccg

SEQ ID NO: 183997 - DNA, 767 bp, Homo sapiens
  misc_feature: GYAE6OF02JOCCE.13.76.G10.1.454.CMB.1.raw
  modified_base (128)..(128): a, c, t, g, unknown or other
  misc_feature (128)..(128): n is a, c, g, or t
  modified_base (488)..(488): a, c, t, g, unknown or other
  misc_feature (488)..(488): n is a, c, g, or t
tcagtcacgtactacacgaccggtgctcgatttagtcactcatacaggggctggggagaggagcccagcactgggattccgaggtgtttccattcggtgatcagcactgaacacagaggactcaccanggagtttgctgagtcgtgggttttccttgttgtctaatttaaaaggtcgccctagtgtgaggtgcgagtcgtggtggtagtcgtagggaggtaggcttgatcccaggtcccggttcggggggtcccttggacgtacctccgtccgtggtcgccgtacgccttcggtcgggtttaccgaccccggttcgaacgttaccaacctacccgtactagttggaacgtccggttcggggttccccgaccgtcgggcccgttaccggaaggggggtaacggggtcgtggggtagtccggttccgtcgttttacgtttttaatttagttaggttaggttacggttagtaacctagttacctccggtanaccggtaacgtccgggtagggacgggacccgtatccacgactccgtacgaggactaactaaccttacgaagtaaccgtctcgttcgttttacctaacgtaaatcgtaaaccgtacgtcggtacggacgaggttaacccggataaccggcggaaccggttcccgttaagttactttaacggtcgtacgacgtaaggtcgggaacggttcggggaccccaaacggttacttaaccggtacgtacgttaggtcccgggtagttccggggtaccggtaaccgg

SEQ ID NO: 183998 - DNA, 784 bp, Homo sapiens
  misc_feature: GYAE6OF02JI64K.13.76.G10.1.454.CMB.1.raw
  modified_base (584)..(584): a, c, t, g, unknown or other
  misc_feature (584)..(584): n is a, c, g, or t
  modified_base (589)..(589): a, c, t, g, unknown or other
  misc_feature (589)..(589): n is a, c, g, or t
  modified_base (638)..(638): a, c, t, g, unknown or other
  misc_feature (638)..(638): n is a, c, g, or t
tcagtcacgtactacacgaccggtgctcgatttagtcactcatacaggggctgggagaggagcccagcactgggattccgaggtgtttccattcggtgatcagcactgaacacagaggactcaccatggtagttttgctgagtcgttgggtttttccttgttgtcttaagttttaaaaggtcgccctagtgtggaggtgcagcgttgggtggagttcgtgggagggaggtcgtttagactccgacggtccgggttcggggggtccctggaacgccttccgttccgtggtcgcgtacgtccgttcgttcgggttccaccgtacacgtaccaccgtaccttacgaatcggacgtcggttacccgggtacccgggaccgtacgggtcccgtaccgggaagggggtaaccggggtcgtaggggacggttcggtccgtttacttttacgtttttaggtttaagttaggttacggttaggttaactaacgttacgtaccgtccgacgtacgtccgttcggtacgggaccgggtctacgtacctactacgttccctacgaggtaactactaacgttacgaaaacgtaaccncgttntttaacgttactaacgaaagtacgtaacgtccgtcttaagggaccgtanaccggtaataccgggtaccacggggttcctagttcgtaagtcggtacgacggaagttacggccgggttaaccggacccttaaccgggtaaccttaacgcggttaacgtccggtacgggaccgggtttacgccggggtaaacccggg

SEQ ID NO: 183999 - DNA, 970 bp, Homo sapiens
  misc_feature: GYAE6OF02IRWS0.13.76.G10.1.454.CMB.1.raw
tcagtcacgtactacacgaccggtgctcgatttagtcactcatacaggggggagaggagcccaggcactgggattccgaggtgtttccattcggtgatcagcactgaacacagaggactcaccatggtagtttggctgagcgttgggttttccttgttgtacgttaagttttaaaaggtcgtccctagtgtgaggtgcagcgtggtggagtcgtggaggaggtcttgactccgaggtccggtcgggggtcccctactacgaccttccgtccgtcggtcgacctaaccgttcgtacggtacgtttccttatttttccgtaccgttacggaccgttccgttgggtttacgacggtccggttccggggtaccccggtacccggtaaccggggtccccgggtaaccccgggggggaaacggggtccggttagggggtaacggggtttcgggggtttaccgggtaaccggttttaaaaggtttaaaaacgggtaaacggtaaacggtaaccgtaacggttacggggttaaccggaaaccgtaaaacgtaacgtaaaccgttaacgtaacggtttacccggtttaacccgggtaaggtaaacggtaccgtaacggttaacttaaccgtaaccgttaaccgtttaccgtaacgtaaaaggtacgtaaacggttaacgtaaacccgttaaaacggaaaaaacgttaaactaaggttaaacttaaacgttaacgttaaccgtaaacgtaaaacttaaaacgttaaaccggtaaaacccttaaaacggtaaacgggtaaaacggaaccggaaacgggaaacccgtaaacgggtaaccgggttaccgtttaaagttaaccgtttaaacgtaaccggtaaaccctaacggtacggtaacgtccggggaaactaaggtaacgtacggaaacgtaacggtccggaaccggtaccggtaacgtacggttaccggaccgtacgggg

SEQ ID NO: 184000 - DNA, 829 bp, Homo sapiens
  misc_feature: GYAE6OF02GOPQR.13.76.G10.1.454.CMB.1.raw
  modified_base (111)..(111): a, c, t, g, unknown or other
  misc_feature (111)..(111): n is a, c, g, or t
  modified_base (129)..(129): a, c, t, g, unknown or other
  misc_feature (129)..(129): n is a, c, g, or t
  modified_base (199)..(199): a, c, t, g, unknown or other
  misc_feature (199)..(199): n is a, c, g, or t
  modified_base (236)..(236): a, c, t, g, unknown or other
  misc_feature (236)..(236): n is a, c, g, or t
tcagtcacgtactacacgaccggtgctcgatttagtcactcatacagggggggagaggagcccagcactgggattccgaggtgtttccattcggtgatcagcactgaaacnccgaggactcaccatggnggttttggtctgagcttgggttttccgtttgttgtcttaatttttaaaaggtgcccagttgtgaggtcgnagcgttggtgggtagtctgggagggaggtcgttgacnccgacgtccggtcggggggttccctgaagtaccttcccttccgtgtcgcaccgtcctcgttcggttacccgtaccgtcgacgtcaaccgtaaccctactaatagacgtccgtcgggtccccgcgtaaccggccggtaccgagggggaaggggtccgttgggacggtgtccgttccttttacgttttttaacttagttaggttaggttggttaagttaccctagttacctaccgtaccgtacgtaaccgttccggttagggaccgggggtacccgttacttaccgaaccgtattcccgtaaccgagaacgtaaccgtaaacctaccgaaacgtaaccgtacctacgtttacgttttcctaactaaagtaacgtaacgaccgtacgtagaacgacgtaccggtataaccggaccgaacggtcccgttaagttacgtttacgttggaacggttacgggagtaacggttaccgggaccgggtaccccgtaaacggttaaacccggtttacctaacccggtacgttaacggttaccgggttaacccggtcggggtaaccccggggtaacccgaacccggggttaccccgaacccgggg

SEQ ID NO: 184001 - DNA, 724 bp, Homo sapiens
  misc_feature: GYAE6OF02GO5BW.13.76.G10.1.454.CMB.1.raw
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgcttaattttaaaaggtgcccagtgtgaggtgcagctgggtggagtcgtggaggaggtcttgactccacgcccggttcgggggggtccctggagacctcctccgtgtcgcacgtccttcgtcggttccacccgtcacgtcaccacctacatgagcgtcgggtcccgccgacggtccgtaccggaagggggaacgggggtcgtagggacgtcggtccgttacttttctttttaatttacgttaggttaggttaggttacgtaactacttaccgtcccgcgtacgaccgtccggtacggggacggggtaccgtacgttaccacctacttccgtaccgaagaacgtaacctaacttaacccgaaacgaaccgtaccgtcgtttacgttttaccttacgtaaaacgttacgaaccgacgtccgtagaccggtacgaccgagtaccgaccggacggtccgtagttacttacgtggtacggacgaggagtcggtcgggtacccgaaccggttacgtaaccgtacgtaccgttacgtcggtaccggtacggacgggtaccggaacggtaacccgg

SEQ ID NO: 184002 - DNA, 771 bp, Homo sapiens
  misc_feature: GYAE6OF02JV0XS.13.76.G10.1.454.CMB.1.raw
tcagtcacgtactacacgaccggtgctcgatttagtcactcatacaggggtctgggagaggagcccagcactgggattccgaggtgtttccattcggtgatcagcactgaacacagaggactcaccagtggtagtttggctgtagcgttcgggttttccttggttgtcttaattttaaaaagggtcgtacccgtagtgtaggtacgggtgacgtagtcgttgggtacggtagttcgttagggacggaggtccgttacgactccgtacgtccggttcgggggtccctggacgtcgtccgtcgtgtcgacgtacgtcccgttcgttcggtaccgtaccgtcgacgtaccaccgtaccttacagtcggtaacgtcggttcggtcccgcgtacggtaccgtacggacggggtaacgggtcgtaggcgtcgtcgttcgtttacgtttagttacttaggtacggttagtaacgtaccgtaatacccgtccgtactaacggtacgttacgggtccggtcggggtacctacgtaccgtaacctcgttaccaccggtaacgtagtaaaccctaacgtaaccaaacgtaccgtacgttccgttacgttacaaacgtaacggttacgaaccctgtactaaggtgaacccggttcgacgtaccggccgtaccgggtacttcggttaactccggtgtaacgtccgtaggtacggtaccgggtcgtaaccgtaccgttaaccgtagtacggtctaaccgttggaccggtcggtacggtacccggg

SEQ ID NO: 184003 - DNA, 796 bp, Homo sapiens
  misc_feature: GYAE6OF02I0EMV.13.76.G10.1.454.CMB.1.raw
  modified_base (667)..(667): a, c, t, g, unknown or other
  misc_feature (667)..(667): n is a, c, g, or t
  modified_base (717)..(717): a, c, t, g, unknown or other
  misc_feature (717)..(717): n is a, c, g, or t
tcagtcacgtactacacgaccggtgctcgatttagtcactcatacaggggtctgggagaggagcccagcactcgggattccgaggtgtttccattcggtgatcagcactgaacacagaggacctcaccatggtagtttggctcgagtccgttgggttttccttaggttgtcttaaagttttaaaaggtcgccctagtggtgtaggtgcagtcgtggtggagtcgtcgggaggacggtcgttagacgtaccgacggtccgggtccgggggtaccctacggacgtaccgtccgttccgtggtacgtaccgtcgtcccgttacgtccgggttaccctaccggtaccgtacgtccgtaaccgtaccccgtatacggtacgtacggtccgttaccgggcccgaccgtaaccggtccgtaaccggaacgggggtaacgggtccggttacgggaggttaccggtcccgtttacgtttaccgtttttaagttaacggttaagtttacgggttcgggtaaaccttaccgttacgttaacccggttacgccgtaaacggtaccgttcccgggtaggtaccgggtacctagttaacccgactaaccgtcgtacccgaggtaaccgactaccgtacgtaacgacgtatacgttacttacgtaactaacgacgtaaccgngtcaggtacacggacctagacggtacgacccgtacggttactacgtacgngtaccgtgaactcggacgtacgggtaccaaccggttactcgaccttaacggcgtacggtaccgtcggttagaacccggg

SEQ ID NO: 184004 - DNA, 890 bp, Homo sapiens
  misc_feature: GYAE6OF02I3FA6.13.76.G10.1.454.CMB.1.raw
tcagtcacgtactacacgaccggtgctcgatttagtcactcatacagggctgggcctcaggaagcagcatcggaggtgcctcagccatggcatggactccctctccttcctcggcgttccttgcttactgcacaggactccgtggcctcctatgagctgactcacgcccaccctcagttcgtccgtcgtccccaggacagacacgccagcatccacctgcctactaggaaaataagttcggacaagtaattaaactaacttaccttaccgtaggttaactcgtagacaaggtaagtcgaacggtccaccgtccccgtggtacggtctaggtctacttctaacttacgaaagtactaccggtacccgaaacggccccggtacccctacggtaaccgggtacctcccgtaacgggaacggtaccgttacttttccgtacccgggttaccggacccttaacccgtaaccgtttaccgggtaacccgggtaaaccttaccccgggtaccgtaaccccgtaacccgttacccggtaacgtaaaacccccgtacgtaaccccggaacccgggggtaccccgggaaacccggtaacgggtaccttaacgggttaacggggtacgttaacggggtaaccggttaccggttaaccgttaaaccttttaacgtttacccggttaaacgggttccgggtacgggggtaccggtaacggggttaaccacgggaaccgtacggtaacccgtaccggttaccggacccctttaggttaaccggttaaccggttcgggttaaccccgggttaaaccggggtacccggttaaacccggtaccggttaacccggttaaccccgggttaccgtaaacccggttaccccgaaccccgggtaacccccgg

SEQ ID NO: 184005 - DNA, 764 bp, Homo sapiens
  misc_feature: GYAE6OF02JSJGP.13.76.G10.1.454.CMB.1.raw
  modified_base (225)..(225): a, c, t, g, unknown or other
  misc_feature (225)..(225): n is a, c, g, or t
  modified_base (731)..(731): a, c, t, g, unknown or other
  misc_feature (731)..(731): n is a, c, g, or t
tcagtcacgtactacacgaccggtgctcgatttagtcactcatacaggggtctgggagaggagcccagcactgggattccgaggtgtttccattcggtgatcagcactgaacacagaggactcaccatgggagttttggctgagcttgggttttccttggttgctaattttaaaaggtcgccctagtgtggagggtcgcagtcgtgggtggtagtcgtgggaggnggtcgttgactcgacggtccgggtacgggggtccctggacgtactcgtccgtggtgcacgtccgtcgttcggggttcaccggtcacgtcaccgacctgacgtgacgtcgttacgggtcccgaccgtggcctccggaacggggaaggggtccgtgggtacggttcgtcccggtttacctttcgttttttaacttagtacggttaggtaggtataccgtataccgtccgagaacgtccgtcggtaacgggtcgggacctactctaaccctagtcccgtacgaggtaactaaccgtaaacgtttaaccgaaacggtaaacctacccggttgttttacccgtttaggttaaacctaaaaaccggttctaaaccgtacggtacccggtaagtaacggtacccggaccgtaagtaccgtaccggaacggttcccggtttaacgttacgttaacgtggacgtgaaggacggtacggaccgggtacccctaacggtacccgttaagtacccgtntagggtaccgtaccggtcggtagggaacccggg

SEQ ID NO: 184006 - DNA, 705 bp, Homo sapiens
  misc_feature: GYAE6OF02FYU9F.13.76.G10.1.454.CMB.1.raw
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (590)..(590): a, c, t, g, unknown or other
  misc_feature (590)..(590): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctaattttaaaaggtgcccagtgtgaggtgcagcgtggtggagtctggaggaggcttgatccagtccggtggggggtccctgagtacctctcctgtcncacgcctcgtgggtcaccgtcagtccacctacctanatgacgcgtcgggtccgccgaggcctaccggagggggaacggggcgtagggagtcggtcgttcttactttttaagttagttaggttagtaggttataactatacctccggctacgtaccgtccggtagggtacggggccgtacttaccgaaccctataccgtaccgaaggtaactaacctaacttaacccgaaagaaacctcggtactttacgtttactaactaattacggaactacgccgtaggaacgtacgacccgtagtacggacccgtacggggtaccttagtaaccgtttacgnggaacggtacgaacggtaggaccgggtacccggggaacccctaaacggttaccgttaaccgacgtacgttaaggtccggtaccggtccggtacggggaccgtaaccgggtacccg

SEQ ID NO: 184007 - DNA, 753 bp, Homo sapiens
  misc_feature: GYAE6OF02JJ0M0.13.76.G10.1.454.CMB.1.raw
  modified_base (218)..(218): a, c, t, g, unknown or other
  misc_feature (218)..(218): n is a, c, g, or t
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgtctattttaaaggtgcccagtgtgaggtcgcagcgtggtgggagttcgtcggagggaggtnttgatccagtcgtggggggtccctggaggactcgtcctgtgcacgccgtcgttcgggtccaccgtcgtagtccaacacctanacgttcgacgtcggtcggtcccggctcgggcctaccgggaggggaacggggtcgngggtagccggtacggtttcttacgtttttaacgttattaacggttaggttacggtaacgttaacgtattacccgttcgacgtacgtccgtaccggtggtacggggacccgtatacccgaccgtacttctaccgtaagcgtaaactaacgttaaacccgaagtaacaccgtcgttacgtttactaacgtaacgtacgtaacacggttcgcgtaacggtacggacccgtaaggtaccggacgtacggttaccccggttagttaacgttccggtaggtaccgggagtaacggtacggtacgggtacccgtaacggaacccggttaacgtaccggttaccgttaggtaaccgttccgggacggttacgggaccccgggtaacgggtaacccggtaccccggg

SEQ ID NO: 184008 - DNA, 723 bp, Homo sapiens
  misc_feature: GYAE6OF02FZHGA.13.76.G10.1.454.CMB.1.raw
  modified_base (638)..(638): a, c, t, g, unknown or other
  misc_feature (638)..(638): n is a, c, g, or t
tcagtcacgtactacacgaccggtgctcgatttagtcactcatacagggggggagaggagcccagcactgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagccgtgggggtccctgagactctcctgtgcagcctcgtggttcaccgtcagtccacacctacatgagcgtcgggtcccgccgaggccgtaccggaggggaacggggcgtgggagtcggtcgttcctttcgttttttaagtttacgttaaggttacggtttagggttaacgttaaccgtaagttacccgttcccggtacgaaccgtaacccgttccgggtagggaacgggggtcccgttaacttacccgaacccgtactttccctacccgaaggtaaaccgtaactaaacgttttaaccccgaaagtaaaccctaccggtctttacggttttccctaacgtaaacgtacgaaaccgtacggtacccttaggaacgtacggaccgtagtacgaccgtaccgggtccttagttaacgtttacnggtcgagtagagtacggcgggtacccaacggtaaccgttacgacgtctacgtcgggtacgtcggacgggacccgaagggtacccg

SEQ ID NO: 184009 - DNA, 945 bp, Homo sapiens
  misc_feature: GYAE6OF02GA8T9.13.76.G10.1.454.CMB.1.raw
  modified_base (225)..(225): a, c, t, g, unknown or other
  misc_feature (225)..(225): n is a, c, g, or t
tcagtcacgtactacacgaccggtgctcgatttagtcactcatacaggggcgtgggagaggagcccagcactgggattccgaggtgtttccattcggtgatcagcactgaacacagaggactcaccatggtagtttggctgagtcttgggttttccttgttgtacttaagttttaaaaggtcgcctagtgtggaggtgcagcgtggtggagtcgtggaggaggtnttgactccgacggtccggtcggggggtcccctggacgtaccttcgtcctagtcgcgacgtccgttcgtcggtcctaccgtacctacgtactaccaacctaactacgtacgacgtacggtaccgggtccgggtaccgtaccggccggttaccgggacgggggaacgggggtacggtacgggtacggtacgggttccgttacgtttttaacgtttttatttaacgttttaagggttaacggtttaacggtacggttaacctaacgttaacggtaccggttaaccgtacggttacccggtccgggtaacggggtaacccggggtccggttaaccttaacccgttaacctaaccgttacccccgtaacggaaacggttaaaccgtaaccgttaaacgtaaacccgttaaaacgaaaccggttaccgttaaccgtttttaccttttaaaccgtttaaaaccgtaaacgtttaaaccgaaaccgttaaccggttaccggttaaacggaaccgtaacgggtaacccgttacggtactaaaccgggttaccgggtaaccgtttaccggtttaaacttaacgggtttaaccgtaacggtaaaccgttaccgttaaacggttttaagttaaccggttaaacggggtcggtaaccgggtttcgttaaccccgtttcggtttaaccccgttttaccggttaaccgttacccgggtaacccgggttaccgggg

SEQ ID NO: 184010 - DNA, 151 bp, Homo sapiens
  misc_feature: GYAE6OF01BCGFO.34.78.H01.1.454.CMB.1.raw
  modified_base (151)..(151): a, c, t, g, unknown or other
  misc_feature (151)..(151): n is a, c, g, or t
tcagtacacgtgatcacgaccggtgctcgatttagtgtgagtagttgggttgggaagaggaagactgacggtcctagcacagcggccctgggctgcctggtcaaggactacttccatcacgtgtactgagcgggctggcaaggcgcatagn

SEQ ID NO: 184011 - DNA, 178 bp, Homo sapiens
  misc_feature: GYAE6OF01CFO4Q.34.78.H01.1.454.CMB.1.raw
  modified_base (178)..(178): a, c, t, g, unknown or other
  misc_feature (178)..(178): n is a, c, g, or t
tcagtacacgtgatcacgaccggtgctcgatttagtgtgagtagtttgggtttgggaacctatgaacattctgtagggaccaccgtctccgtcctaggtcagcccaaggccaacccactgtcactctgttcccgccctcctcatcacgtgtactgagcgggctggcaaggcgcatagn

SEQ ID NO: 184012 - DNA, 179 bp, Homo sapiens
  misc_feature: GYAE6OF01DAUKM.34.78.H01.1.454.CMB.1.raw
  modified_base (179)..(179): a, c, t, g, unknown or other
  misc_feature (179)..(179): n is a, c, g, or t
tcagtacacgtgatcacgaccggtgctcgatttagtgtgagtagtttgggtttgggaacctatgaacattctgtagggaccaccgtctccgtcctaggtcagcccaaggccaaccccactgtcactctgttcccaccctcctcatcacgtgtactgagcgggctggcaaggcgcatagn

SEQ ID NO: 184013 - DNA, 197 bp, Homo sapiens
  misc_feature: GYAE6OF01CBWLS.34.78.H01.1.454.CMB.1.raw
  modified_base (178)..(197): a, c, t, g, unknown or other
  misc_feature (178)..(197): n is a, c, g, or t
tcagtacacgtgatcacgaccggtgctcgatttagtgtgagtagtttgggtttgggaacctatgaacattctgtagggaccaccgtctccgtcctaggtcagcccaaggccaacccactgtcactctgttcccaccctcctcatcacgtgtactgagcgggctggcaaggcgcatagnnnnnnnnnnnnnnnnnnnn

SEQ ID NO: 184014 - DNA, 338 bp, Homo sapiens
  misc_feature: GYAE6OF01B7YVA.34.78.H01.1.454.CMB.1.raw
  modified_base (335)..(338): a, c, t, g, unknown or other
  misc_feature (335)..(338): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttcccctggcgccctgctccaggagcacctccgagagcacagcggccctgggctgcctggtcaaggactacttccatcacgtgtactgagcgggctggcaaggcgcatagnnnn

SEQ ID NO: 184015 - DNA, 213 bp, Homo sapiens
  misc_feature: GYAE6OF01DEESV.34.78.H01.1.454.CMB.1.raw
  modified_base (182)..(182): a, c, t, g, unknown or other
  misc_feature (182)..(182): n is a, c, g, or t
  modified_base (184)..(213): a, c, t, g, unknown or other
  misc_feature (184)..(213): n is a, c, g, or t
tcagtacacgtgatcacgaccggtgctcgatttagtgtgagtagtttgggtttgggaacctatgaacattctgtagggaccaccgtctccgtcctaggtcagcccaaggcccaacccactgtcactctgttcccgccctcctcatcacgtgtactgagcgggctggcaaggcgacaatagcntnnnnnnnnnnnnnnnnnnnnnnnnnnnnnn

SEQ ID NO: 184016 - DNA, 620 bp, Homo sapiens
  misc_feature: GYAE6OF01BF12S.34.78.H01.1.454.CMB.1.raw
  modified_base (264)..(264): a, c, t, g, unknown or other
  misc_feature (264)..(264): n is a, c, g, or t
  modified_base (328)..(328): a, c, t, g, unknown or other
  misc_feature (328)..(328): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtnctgatgagcgctacagtccatctctgaagaccaggctcaccatcacgacggacaccccaaaacnggtgatcctgacactgaccaagttggaccctgtgacacacgccactattattgtcgacaacaaccctaaaaccgaccggtccccggtggggaccggggtaacttaccgtttacgaaccttacggtcgggggaccgtaccggggacccttcggtaccacccgttcctccctacgacgccctaccaccgaacggcccagtccgtcccttccccgtggcccgtccctgcctaccgaggcgcccgtacccgccggacgcgccacgacggcccggcccggtcggccgtcggtcccgg

SEQ ID NO: 184017 - DNA, 551 bp, Homo sapiens
  misc_feature: GYAE6OF01DIKR6.34.78.H01.1.454.CMB.1.raw
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
  modified_base (425)..(425): a, c, t, g, unknown or other
  misc_feature (425)..(425): n is a, c, g, or t
  modified_base (491)..(491): a, c, t, g, unknown or other
  misc_feature (491)..(491): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagccccccaggaaagggcctggagttcctagcgctcgtttattggggtgctgatgagcgctacagtccatctctgaagaccaggctcaccatcacgacggacacccccaaaaccnggtgatcctgacactgaccaagttggaccctgtggacncagccacctattatgtgcacacctaaacngcccgtggcgggactacttgactacgnggggcacggggaccctggtccaccgtctcctcacgcctccaccagggcccagtccgtcttccccgngcgccctgctccgagcgccacctccgagacgcaccgaggccggcccctgggctggtcccg

SEQ ID NO: 184018 - DNA, 340 bp, Homo sapiens
  misc_feature: GYAE6OF01CK4EM.34.78.H01.1.454.CMB.1.raw
  modified_base (330)..(330): a, c, t, g, unknown or other
  misc_feature (330)..(330): n is a, c, g, or t
  modified_base (336)..(340): a, c, t, g, unknown or other
  misc_feature (336)..(340): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcctgtggcggggactactttgactactgggggccaggggaccctggtcaccgtctcctcagcctccaccaagggcccatcggtcttcccctggcgccctgctccaggagcacctccgagagcacagcggccctgggctgcctggtcaaggactacttccatcacgtgtactgagcgggctggcaaggcncatagnnnnn

SEQ ID NO: 184019 - DNA, 590 bp, Homo sapiens
  misc_feature: GYAE6OF01A8OA5.34.78.H01.1.454.CMB.1.raw
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
  modified_base (399)..(399): a, c, t, g, unknown or other
  misc_feature (399)..(399): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttatgcaagctggtaccaacagaagccaggacaggcccctgaacttgtcatgtttggtgaaaacgngcggccctcgagggatctctgaccgtattttcnggctccgaggtccgaaacncggcttccctgaccatcacgtgggctcgtggcggaagntgaggctgacttattattgactaagttcccgggatagtcacgtacggtaaccatcctcgtcttacgggacggttcgggaccctaccggttctcccggtccgtacggtccaacggccccgaaacgggccccaaacccccgcgttccgtaccaccgttcccttcggttacccccgccccttcccgtcctaccg

SEQ ID NO: 184020 - DNA, 340 bp, Homo sapiens
  misc_feature: GYAE6OF01AM6Q2.34.78.H01.1.454.CMB.1.raw
  modified_base (338)..(340): a, c, t, g, unknown or other
  misc_feature (338)..(340): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtccttccccctggccgccctgctccaggacgcacctccgagagcacagcggccctgggctgcctggtcaaggctacttcatcacgtgtactggagcgggctggcaaggcgcatagnnn

SEQ ID NO: 184021 - DNA, 363 bp, Homo sapiens
  misc_feature: GYAE6OF01C02X4.34.78.H01.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (325)..(325): a, c, t, g, unknown or other
  misc_feature (325)..(325): n is a, c, g, or t
  modified_base (331)..(363): a, c, t, g, unknown or other
  misc_feature (331)..(363): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctcaccaagggcccatcggtcttccccnggcnccctgctccaggancacctcgagagcacagcggcctgggctgcctggtcaaggctacttccatcacgtgtactgagcgggctggcaaggcncatagnnnnnnnnnnnnnnnnnnnnnnnnnnnnnnnnn

SEQ ID NO: 184022 - DNA, 627 bp, Homo sapiens
  misc_feature: GYAE6OF01EFW6N.34.78.H01.1.454.CMB.1.raw
  modified_base (401)..(401): a, c, t, g, unknown or other
  misc_feature (401)..(401): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccaggaaagggcctggagttcctagcgctcgtttattggggtgctgatgagcgctacagtccatctctgaagaccaggctcaccatcacgacggaccacccccaaaacaggtgatcctgacactgaccaagttcggaccctgtggacacagcccactattatgtgcacaacctaaaccncgcccggtggccgggacttacgttgactacgtgggccaggggaccctggtccaccgtctcctcacgccctaccaccgaacgggccccacgtcccggttcccttcccccgtgggcccgtccccgtcggtccctcccgaacgggaccgcccgtaacccgtcccggaacggaccgacccaaccggaccgggccccgggtacccccgtgggggcccttcgggtccccggg

SEQ ID NO: 184023 - DNA, 659 bp, Homo sapiens
  misc_feature: GYAE6OF01BR3PL.34.78.H01.1.454.CMB.1.raw
  modified_base (397)..(397): a, c, t, g, unknown or other
  misc_feature (397)..(397): n is a, c, g, or t
  modified_base (649)..(649): a, c, t, g, unknown or other
  misc_feature (649)..(649): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgctggtacgaaaacccaaacagaccctcacgctgacctgcaccttctctggtttctcactcaccagtgaagaagaggctgtggccgtgggtccgtcacgccccgaaggaaacggcctggacgttcctagcgtctcgtttagtggggtgctgatgagcgctacagtccatctctgaagaccaggcctacaccataccaacgaaccggaacccaaaccccaaaaacgnggtacgaactccagaccacgtacgaaccgtaagttcggaccctggtacggacaacgacgaccctaacttattacttcggcaccaaccaaaccctaaaacgcgccggtggaccgggtactacgtttagaaccttacggtacggggaccacgggtaccctagggtccctacccggttcctaccctaccgaccgtaccccgtacccgaaccgaaccgggtcccctaacggttcccgggttcccctttccccccgngggtcccccg

SEQ ID NO: 184024 - DNA, 533 bp, Homo sapiens
  misc_feature: GYAE6OF01DUEV9.34.78.H01.1.454.CMB.1.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (394)..(394): a, c, t, g, unknown or other
  misc_feature (394)..(394): n is a, c, g, or t
  modified_base (504)..(504): a, c, t, g, unknown or other
  misc_feature (504)..(504): n is a, c, g, or t
  modified_base (523)..(523): a, c, t, g, unknown or other
  misc_feature (523)..(523): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttangcaagctggtaccaacagaagccaggacaggcccctgaacttgtcatgttgtagaaaacgngcggcctgaggatctctgaccgtattttcnggctccgaggtccgaaacncggtcttcctgaccatcacgtgggctcgtggcgaagntgagctgactattatgactaagttcccggatatcaactgtaaccatctcgtcgttcggaggtcggaccctacgtctccgtcctagtccaacgcccgaacggcccaacccnctcgcctactctcgtcccnccctctcacg

SEQ ID NO: 184025 - DNA, 579 bp, Homo sapiens
  misc_feature: GYAE6OF01ENTT3.34.78.H01.1.454.CMB.1.raw
  modified_base (401)..(401): a, c, t, g, unknown or other
  misc_feature (401)..(401): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccagggaaagggcctggagttcctagcgctcgtttattggggtgctgatgagcgctacagtccatctctgaagaccaggctcaccatcacgacggacacccccaaaaccaggtgatcctgacactgaccaagttcggaccctttggacacagccacctattatgtgcacacctaaaaccngcccgtggcgggactacttgactacgtgggccaggggaccctgggtccaccgtctcctcacgccctccaccgaacgggcccacgtccggtccttcccccgtggcccgccctcgcctcccgaggacgccgacccgtccgagacgccacgacggccggcccgtgggcctggccctacggg

SEQ ID NO: 184026 - DNA, 560 bp, Homo sapiens
  misc_feature: GYAE6OF01BCUPM.34.78.H01.1.454.CMB.1.raw
  modified_base (331)..(331): a, c, t, g, unknown or other
  misc_feature (331)..(331): n is a, c, g, or t
  modified_base (335)..(335): a, c, t, g, unknown or other
  misc_feature (335)..(335): n is a, c, g, or t
  modified_base (397)..(397): a, c, t, g, unknown or other
  misc_feature (397)..(397): n is a, c, g, or t
  modified_base (458)..(458): a, c, t, g, unknown or other
  misc_feature (458)..(458): n is a, c, g, or t
  modified_base (498)..(498): a, c, t, g, unknown or other
  misc_feature (498)..(498): n is a, c, g, or t
  modified_base (521)..(521): a, c, t, g, unknown or other
  misc_feature (521)..(521): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcacgatcggaccaaccccaaaacnggtnatcctagacactgaccaagttcgacctgtgacacagccactattatgtgcacacctaaaccncgcccgtggcgggactacgtttgactacgtcgggccaggggaccctggtccaccgtctccncacgccctccaccgacggccctagtccggtccttccccgnggcccgccctgcctcccgaggcnccaccgtccgagcgcacgacgccggccctgggcctccgg

SEQ ID NO: 184027 - DNA, 612 bp, Homo sapiens
  misc_feature: GYAE6OF01D1HKW.34.78.H01.1.454.CMB.1.raw
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccgaggaaagggcctggagttcctagcgcttcgtttagttggggtgctgatgagcgctacagtcatctctgaagaccaggctcaccatcacgacgacaaccccaaaacngtnatcngacactgacaagtcgacctgtgacacacgccacctattatgtcgacaacaacctaaaaccgcgcccgtagggaccgggtactacgtttcgacgtacgcggggtccgacggggtaccctggtaccaccgtcctcctcgacgccctaccgaaccgaacgggccctacgtcccggtcccttccccgtcggcccgccctcgccctccgacggtacgcccgtacccgtccggaacgacgacaccgacggcccggacccgtcggggcctcgggtacccgg

SEQ ID NO: 184028 - DNA, 664 bp, Homo sapiens
  misc_feature: GYAE6OF01AGT7S.34.78.H01.1.454.CMB.1.raw
  modified_base (500)..(500): a, c, t, g, unknown or other
  misc_feature (500)..(500): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacattttgcgctcaactgtcttgtcccagatcaccttgaaggagtctggtccgacgctggtgaaacccaaacagaccctcacgctgacctgcaccttctctggtttctcactcacagtgaagaagaggctgtggcctggggtccgtcacgcccccgaggaaacgggccgtggagttcctagccgcttcgtttagttgggtgctgatgagcgctacagtccatctctagaacgaccaggctccacactacgacgacgaacccaacccccaaaaacgacggtacgactcctacgacactacgaccgtaaggttcggacccgtggtacggaaccaacgacgaccctaaccttatttacgttgacgaccaacctaaccctaaaaccnccggacccgtacggggaccgggtacttacgtttcggaccttacggtcggggaccgaccggggtaccctcgggtacccaccgttccgtccctcgaccggtcccctaccccgaaccgaaccgggtcccctaacgttcccggttccccttcccccgtgggtcccccg

SEQ ID NO: 184029 - DNA, 770 bp, Homo sapiens
  misc_feature: GYAE6OF01DV4UP.34.78.H01.1.454.CMB.1.raw
  modified_base (242)..(242): a, c, t, g, unknown or other
  misc_feature (242)..(242): n is a, c, g, or t
  modified_base (320)..(320): a, c, t, g, unknown or other
  misc_feature (320)..(320): n is a, c, g, or t
  modified_base (406)..(406): a, c, t, g, unknown or other
  misc_feature (406)..(406): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctgtttctcactcaccagtgaagaagnggctgtcggcctgggtccgtcacgcccccgaaggaaacgggcctggacgttcctagcgcgttcgtttagttgggggtncgtgagtgagcgtctacgagtccatctcgtagaacgaccgaggcctacgaccatccgaacgaccggaacccaaacccccgaaaacncggtacactacctacggaaccacgttacgaacctaacggttacggacccctggtacggaactacgacgtaccctaacgtttagttacgttcgacgtaccaaccgtaaacccctaaaacgaccggtaccccggtggtaaccgaacgggtacctttaaccgttacgggaacccgttaaccgggttccggggaaccccgtaacgggggtacccccgttacgggtaccccgtaacccgggttccccgttacccgtacccggtacccggtaccccccgttaaccccggaaaccccggtaaacccgggggtaccccccttaacggttttccccccgggttacccccgtttccccccccgttacccggggg

SEQ ID NO: 184030 - DNA, 601 bp, Homo sapiens
  misc_feature: GYAE6OF01CCODN.34.78.H01.1.454.CMB.1.raw
  modified_base (226)..(226): a, c, t, g, unknown or other
  misc_feature (226)..(226): n is a, c, g, or t
  modified_base (382)..(382): a, c, t, g, unknown or other
  misc_feature (382)..(382): n is a, c, g, or t
  modified_base (591)..(591): a, c, t, g, unknown or other
  misc_feature (591)..(591): n is a, c, g, or t
tcagtacacgtgatcacgaccggtgctcgatttagtgtgagtagtttgggtttggggggaagaggaagactgacggtcctgccgcaggtggtgctgggcacggtgggcactcgacacaacatttgcgctcaactgtcttgtcccagatcaccttgaaggagtctggtccgacgctggtgaaaacccaaacagaccctcacgctgacctgcaccttctctggtttcncactcaccagtgaagaagaggctgtggcctggggtccgtcacgcccccaaggaaacgggcctggagttcctagcgctcgtttagttgggggtgctgatgagcgctacagtccatctctgaagaccaggctcacatcacgacggacaccccaaaacngtgatctgacactgaaccaagttcggacctgtaggacacagccaccttatattgtgaccaacaaccctaaaaccacgtcccgtgggaccggggtacttacgtttgaaccttacgtcggggaccacggggaccccttgggtccaccgtcctccgtcacggtccctacccgaaccgaacgggccccaagttcccgggtacccttcccccgngggtcccccg

SEQ ID NO: 184031 - DNA, 623 bp, Homo sapiens
  misc_feature: GYAE6OF01EMLDZ.34.78.H01.1.454.CMB.1.raw
  modified_base (264)..(264): a, c, t, g, unknown or other
  misc_feature (264)..(264): n is a, c, g, or t
  modified_base (330)..(330): a, c, t, g, unknown or other
  misc_feature (330)..(330): n is a, c, g, or t
  modified_base (334)..(334): a, c, t, g, unknown or other
  misc_feature (334)..(334): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtnctgatgagcgctacagtccatctctgaagaccaggctcaccatcacgacggaccaaccccaaaacnggtnactcctgacactgaccagttcgaccctgtcgacacacgccacctattattgtcgacaaccaacctaaaaccgcgtcccggtgggcccggggtaacttacgtttcgaacctacggtcggggaccgacggggtacccctgggtcccacccgttcctcccgtcgacgccctaccaacccgaacgggcccacgtcccggttccttcccccgtggcccgccctcgcctcccgaggaccgccgtacccgtccggacgacgccaccgacggcccggcccgtgggcctcggtcccgg

SEQ ID NO: 184032 - DNA, 690 bp, Homo sapiens
  misc_feature: GYAE6OF01D7SGA.34.78.H01.1.454.CMB.1.raw
  modified_base (191)..(191): a, c, t, g, unknown or other
  misc_feature (191)..(191): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtagaaacccaaacngaccctcacgctgacctgcaccttctctggtttctcactcaccagtagaagaagaggctggtcggccgtggggtccctcacgcccccgagggaaacgggcctggacgttcctagcgtctcgtttattggggtgctgagtgagcgctacagtccatctctgaacgaccaggctcaccatccaacggaccgaacccaaaccccccaaaaaccgaggtacgactaccgtacgaacactacggtaacctaaggttccggaacccgttggtacggacaacgaacgaccctaaccgttaactttagtttacgtacgaccaaccaaccctaaaacccgacgtcccggtcgggaccggggtacttaacgtttcgtaaccgttacggtcggggacccgaacgggggtacccgtcggtaccgtacccgttcgtcccctacgaccgtcccctacccgacccgaacccgggccctacggttacccgttcccgttcccccgtggtcccccgg

SEQ ID NO: 184033 - DNA, 739 bp, Homo sapiens
  misc_feature: GYAE6OF01AFBTK.34.78.H01.1.454.CMB.1.raw
  modified_base (252)..(252): a, c, t, g, unknown or other
  misc_feature (252)..(252): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggacccgttgtgtctgtggccttgggacacacagtcacgatcacatgccgagggacgacacgcctacggtaaaccttttancgacaagcctacggtacccaacgacgaacgccgaacggacgacggcccctagtaaccttcgtccagttggtttaggtagaaaaccggcggcccgggacccgtcgacggggtacttccgtcgtacggtaccgttatttttccgcggtactccggaacgggtacccgaaaccgtccggtccttcccgtcgacctacgtaccgtacggtcgggtctcggtacgggacgtaagtagtggacgtctagtacttattacgtagacgttaccgtaccggactactaccgtacgtacgtaaccctacgttccgttaccggttccggttacggggtaccggttaccgggacccgttacccggttccgtaccccgggttaccgttacgggtacccgaccggtaaccccgtaaccggacccctaaaccccgcgttacccgggtacctacccgttcccgttaccccggttaccccctccccgttcccttcccgtaaccg

SEQ ID NO: 184034 - DNA, 620 bp, Homo sapiens
  misc_feature: GYAE6OF01B9N9T.34.78.H01.1.454.CMB.1.raw
  modified_base (264)..(264): a, c, t, g, unknown or other
  misc_feature (264)..(264): n is a, c, g, or t
  modified_base (329)..(329): a, c, t, g, unknown or other
  misc_feature (329)..(329): n is a, c, g, or t
  modified_base (401)..(401): a, c, t, g, unknown or other
  misc_feature (401)..(401): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtnctgatgagcgctacagtccatctctgaagaccaggctcaccatcacgacggacaaccccaaaacnggtgatcctgacactgaccaagttcggacctgtcggacacagccacctattattgtagcacaacctaaaccncgcccgtggcgggtactacgtttgacgtacgtcggggaccgaggggaccctggtaccacccggttctcctacgtacgccctaccgaaccgaacgggcccctaagtcccggttaccttcccccgtagggcccgccccttcgccctcccgaacggtaccgccgtaccccgtcgacggacgaccaccgaccggcccgggaccgtcggggcctggtaccccgg

SEQ ID NO: 184035 - DNA, 618 bp, Homo sapiens
  misc_feature: GYAE6OF01CRYJY.34.78.H01.1.454.CMB.1.raw
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctggggtccgtcacgcccccaggaaacgggcctggagttcctagcgcttcgtttagttggggtgctgatgagcgctacagtccatctctgaagaccaggctcaccatcacgacgaccaaccccaaaacngtnatcngacactcgaccaagtcggacctgtacggacacgagacccaccttattattgtgaccaaccaaccctaaaccacggcccggtacgggaccggggtacttacgtttcgaccgttaccggtcggggacccacggggtaccctcggtcctacccgtccgtccctcgacgtcccctacccgaacccgaaccgggcccctacgttcccggttccccttcccccggtcggtccccg

SEQ ID NO: 184036 - DNA, 590 bp, Homo sapiens
  misc_feature: GYAE6OF01CFYDF.34.78.H01.1.454.CMB.1.raw
  modified_base (247)..(247): a, c, t, g, unknown or other
  misc_feature (247)..(247): n is a, c, g, or t
  modified_base (308)..(308): a, c, t, g, unknown or other
  misc_feature (308)..(308): n is a, c, g, or t
  modified_base (341)..(341): a, c, t, g, unknown or other
  misc_feature (341)..(341): n is a, c, g, or t
  modified_base (367)..(367): a, c, t, g, unknown or other
  misc_feature (367)..(367): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttangcaagctggtaccaacagaagccaggacaggcccctgaacttgcatgtttggagaaaacgngcggccctcgagggatctctgaccgtattttcngctccgaggtccgaaacacgcttccngaccatcgacgtcgggctcgtcgggacgaagatggagctagacttattatgactaacgttcccgggactactccgacgttacggtaaaccctattccgtcgttccgttcgggtaggttcgggaccctaccggtcctccgtccgtacggtccgacgaccccgaacggccccaaaccccgcttaccgtccacctccttccgttacccccaccccttcctcctacc

SEQ ID NO: 184037 - DNA, 590 bp, Homo sapiens
  misc_feature: GYAE6OF01DP82P.34.78.H01.1.454.CMB.1.raw
  modified_base (330)..(330): a, c, t, g, unknown or other
  misc_feature (330)..(330): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgcttcgtttagtggggtgctgatgagcgctacagtccatctctgaacgacaggctcaccatcacgacgaccaaccccaaaacngtagactcctgacactgaccaagttcggacctgtacgacacagccacctattatgtcgacacaacctaaacncgcccgngggcgggacttacgttgactacgtcggggaccgagggaccctggcctacccgtctccctcacgccctaccacccgaacggcccctagtccggtcccttccccgtcggccgtccctgcctcccgaggaccgcccaccgtcccggagacgccaacgcggaccggcccgtgggcctcggtcccg

SEQ ID NO: 184038 - DNA, 693 bp, Homo sapiens
  misc_feature: GYAE6OF01C7DB7.34.78.H01.1.454.CMB.1.raw
  modified_base (275)..(275): a, c, t, g, unknown or other
  misc_feature (275)..(275): n is a, c, g, or t
  modified_base (346)..(346): a, c, t, g, unknown or other
  misc_feature (346)..(346): n is a, c, g, or t
  modified_base (662)..(662): a, c, t, g, unknown or other
  misc_feature (662)..(662): n is a, c, g, or t
  modified_base (670)..(670): a, c, t, g, unknown or other
  misc_feature (670)..(670): n is a, c, g, or t
  modified_base (680)..(680): a, c, t, g, unknown or other
  misc_feature (680)..(680): n is a, c, g, or t
tcagtacacgtgatcacgaccggtgctcgatttagtgtgagtagtttgggtttgggtttcaccagcgtcggaccatcccttcatgggtcttgtcccaggatcaccttgaaggagtctggtccgacgctggtgaaacccaacagaccctcacgctgacctgcaccttctctggtttctcactcaccagtgaagaagaggctgtggccgtgggtccgtcgacgcccccgagggaaagggcctgggacgttccctagcgtctcgttttagttggggtnctgatgagcgctacagttcccatctctagaagaccaggctcaccatccacgacggaccacccccaaaaacnggtcgatcctgacactgacccaagttcggacccctgtcggacaccgacgccctaaccttattagtttcgacgacctaaaccaacccctaaaaacccgcgggtcccccggtaggggtacccgggggtaccttaaccgttttcggaaccgttaccgggtacgggggcccgaaccgggggtaccccttggggtccctacccgggtcccttcccgtacgaccggcccctacccgaaccgaacggggtcccctacgttcccggttcccttcccccgtggccctcccgtgaccctccgaggtcgcctacccgtccggagacncgtaaccncggccgccgnggtctcgtaccgg

SEQ ID NO: 184039 - DNA, 775 bp, Homo sapiens
  misc_feature: GYAE6OF01E1BRS.34.78.H01.1.454.CMB.1.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (353)..(353): a, c, t, g, unknown or other
  misc_feature (353)..(353): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccgaagggaaacgggcctgggacgttcctagcgtcttcgtttagttggggtnctgagtgagcgctacncgtccatctctagaacgaccaggctccaccatccgacgaccggaaccccaaccccgaaaacgnggtacactccagactacgacgaccgtaagttcggaccctgacggacacacgtccgtaaccttattacgtcgttacgaccaaaccgaaacccttaaaaccgacccggtacccggtacggggaccggggtaaccttacgtttacggaaccgttaccgggtcggggacccgggtacggggaccccgttcggtaccctacccggttcctacccgtcgaacccgtcccctaacccggaacccgaaccggggtccctaccggttcccggttaccccttacccccgggtggtccccgtaccccgttcggacccttacccgggaacgggaccgtaccccaacccgggttcccggaaaccggtaccggaacccaaccgggtccgggtaccccggtaccccgggttacgggccccgttccgggtaaccccgg

SEQ ID NO: 184040 - DNA, 595 bp, Homo sapiens
  misc_feature: GYAE6OF01ESW4F.34.78.H01.1.454.CMB.1.raw
  modified_base (333)..(333): a, c, t, g, unknown or other
  misc_feature (333)..(333): n is a, c, g, or t
  modified_base (389)..(389): a, c, t, g, unknown or other
  misc_feature (389)..(389): n is a, c, g, or t
  modified_base (404)..(404): a, c, t, g, unknown or other
  misc_feature (404)..(404): n is a, c, g, or t
  modified_base (509)..(509): a, c, t, g, unknown or other
  misc_feature (509)..(509): n is a, c, g, or t
  modified_base (515)..(515): a, c, t, g, unknown or other
  misc_feature (515)..(515): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccagggaaagggcctggagttcctagcgcttcgtttagttggggtgctgatgagcgctacagtccatctctgaagaccaggctcaccatcacgacggacacccccaaaacnggtgatcctgacactgaccaagttcggaccctgtggacacagccacctattattgngcacaacctaaaccncgcccgtgggccggggactactttcgactacgtggggcacggggaccctggtccaccgtctcctcacgccctccaccgaacggcccagtccggtccttcccccgnggcccncccctcctacccacgacgccgtaccctcggcggggcaccgacggcccggtcccgtcgggcctcggcccgtggtaacccgg

SEQ ID NO: 184041 - DNA, 772 bp, Homo sapiens
  misc_feature: GYAE6OF01AEYZ3.34.78.H01.1.454.CMB.1.raw
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccaggaaacgggcctggagttcctagcgtctcgtttagtggggtgctgatgagcgctacacgtcatctctagaacgaccaggctcacatcacgaccgaccaaccccaaacaggtcactcctgacacgtcgaaccaaggttcgaacctggtacgacaacacgaccctaccttattactcgtcgacaacctaaccctaaaaccgacggtccccgggtaggggacccggggtaacttaaccggtttacggaacccgtttaccgggtcgggggtaaccccgtacgggggtaccccgttcgggtacccgtacccggtccttccccgtacggacccgtaccccgttaacccaaccccgggtaaaccgggccccctaacgggttccccggttacccccgttcccccggtccgggtaccccgtccccgttaccggtaccccgttaccggaaccgggtacccggtcccgtaacccccggttacccggaacggaaccgccctaaaccgggcccggtaccccggggaccccgttcggggaccccgttggttaacccccggg

SEQ ID NO: 184042 - DNA, 632 bp, Homo sapiens
  misc_feature: GYAE6OF01EK3D7.34.78.H01.1.454.CMB.1.raw
  modified_base (191)..(191): a, c, t, g, unknown or other
  misc_feature (191)..(191): n is a, c, g, or t
  modified_base (404)..(404): a, c, t, g, unknown or other
  misc_feature (404)..(404): n is a, c, g, or t
  modified_base (467)..(467): a, c, t, g, unknown or other
  misc_feature (467)..(467): n is a, c, g, or t
  modified_base (490)..(490): a, c, t, g, unknown or other
  misc_feature (490)..(490): n is a, c, g, or t
  modified_base (624)..(624): a, c, t, g, unknown or other
  misc_feature (624)..(624): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacattttgcgctcaactgtcttgtcccagatcaccttgaaggagtctggtccgacgctggtgaaacccaaacngaccctcacgctgacctgcaccttctctggtttctcactcaccagtgaagagaggctgtcggcctgggtcctcacgcccccgaaggaaacgggcctggacgttcctagcgctacggttttagttgggggtgctgatggacgcgctacagtccatctctcgaacgtccaggctacacctactacaaccggaccgaacccaaccccaaaaaccgnggtacgactccgtgaccactcgaacctaaggttcgaccctgtacgacaacagacctactattntcgcgtaccacaaccctaaaccncggcccggtagggaccgggtacctacgtttcgacggttacgcgggacgacggggccctcggtccgtacccggttcctccgtccgacgtccctaccgacccgacgggcccctagttccccggtcccttcccccgnggtccccg

SEQ ID NO: 184043 - DNA, 685 bp, Homo sapiens
  misc_feature: GYAE6OF01DAQ1V.34.78.H01.1.454.CMB.1.raw
  modified_base (346)..(346): a, c, t, g, unknown or other
  misc_feature (346)..(346): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccagggaaacgggcctggacgttcctagcgtctcgtttagttggggtgctgatgagcgctacagtccatctcgtagaacgaccaggctcaccataccacgaccggaaccaacccccgaaaacgnggtacgactcctagacacgtacgacctaaggttcggaccctggtacggaacacgacgacctaccttattactgtacgacaacctaaaccctaaaccgcggtacccggtgggaccggggtaccttacgttacgaaccgttacgggtcggggaccgtacggggtaccctgggtaccctacccgtcctacccgtcgaccgtccctacccgaaccgtacgggcccctagttcccggtcccttcccccgtggcccgtcccgtcgccctacccggaggaccgccctacccgtcggacgacggaccaccggaccggacccggcccggtcgggccgtccgtacccgg

SEQ ID NO: 184044 - DNA, 618 bp, Homo sapiens
  misc_feature: GYAE6OF01A1L30.34.78.H01.1.454.CMB.1.raw
  modified_base (234)..(234): a, c, t, g, unknown or other
  misc_feature (234)..(234): n is a, c, g, or t
  modified_base (331)..(331): a, c, t, g, unknown or other
  misc_feature (331)..(331): n is a, c, g, or t
  modified_base (348)..(348): a, c, t, g, unknown or other
  misc_feature (348)..(348): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (401)..(401): a, c, t, g, unknown or other
  misc_feature (401)..(401): n is a, c, g, or t
  modified_base (411)..(411): a, c, t, g, unknown or other
  misc_feature (411)..(411): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtcccgacgctgggtacgaaaacccaaacacgaccctcacgctgacctgcctaccttctcttggtttcncactccaccgagtacgaagaagaggctggtcggcctggggtcctcacgccccgaaggaacgggcctggacgttcctagcgtcttcgtttagtgggtncgtgatggagcgctacncgtcntctntagaacnccgagctcacactcgacgacgacaccaacccaaacgngtacactcanacactcgaaccgtagtcgacctggacgacacgacgacctacttagttacgtcgacgacctaacctaacctaaaaccgcggtccggtaagggtccgggtaacttacgttacgtaccgtacggcgggaccgacgggtccctcggtaccaccgtctccacgtccaccctcccgacgtacgggtccctagttcccgtcccgtcccggccgg

SEQ ID NO: 184045 - DNA, 677 bp, Homo sapiens
  misc_feature: GYAE6OF01D1V0D.34.78.H01.1.454.CMB.1.raw
  modified_base (337)..(337): a, c, t, g, unknown or other
  misc_feature (337)..(337): n is a, c, g, or t
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctggggtcctcacgcccccaagggaaacgggcctgggacgttcctagcgtcttcgtttagttggggtgctgatggagcgctacngtccatctctagaacgaccgaggcctcaaccataccaaccggaaccggaacccaaaccccccaaaaacgnggtacgactcctagaccacgtcgaacctaaggttcggaccctggtacggaacacgacgcccaaccttattattgtcgaccaaccaaccctaaaaccncggtcccggtagggaccggggtaccttacgtttcgaacgttaccggtcggggacccgacgggggtacccttcgggtccctacccggttcctcccgtaccgacggtccccctacccgaacccggaaccgggtcccctacggttcccggttccccttcccccggtgggtcccccg

SEQ ID NO: 184046 - DNA, 757 bp, Homo sapiens
  misc_feature: GYAE6OF01C73YD.34.78.H01.1.454.CMB.1.raw
  modified_base (746)..(746): a, c, t, g, unknown or other
  misc_feature (746)..(746): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgctggtagaaaacccaaacagaccctcaacgctgacctgacctaccttctctggtttactcactcaccagtagaagaagagctggtcggccgtgggtccgtacgacgccccgaaggaaacgggcctaggtacgttcctaggccgtcttacggtttaggttcggggtgtcgtgagtgacgccgtactacgacgtcctattcctacgtagaaacgaccgacggcctaccaaccactaccgaaccggaacccggaaaccccaaaaccccccgaaaaacgtacggtacgaaccttaccgtacgaacctaaccgtacgaaaccgttaacgggttaccgtacccgtaggtaacggaaccaaccgacgtacccttaaccttaattagtacgtacaccaaacctaaaccctaaaccgcggtcccggtagggtaccgggtactttaacgttacgaccgtacgggtacgggaccggtacgggtacccgttggaccccgtaccgtcccgtacccgaccgtacccgccccgtaccccgaaccggacccgggtaccctacggttcccccggtttccccttcccccggnggtaccccccg

SEQ ID NO: 184047 - DNA, 761 bp, Homo sapiens
  misc_feature: GYAE6OF01CSHO6.34.78.H01.1.454.CMB.1.raw
  modified_base (357)..(357): a, c, t, g, unknown or other
  misc_feature (357)..(357): n is a, c, g, or t
tcagtacacgtgatcacgaccggtgctcgatttagtgtgagtagttttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctggtggccgtgggtccgtcacgccccccgagggaaacgggcctggacgttcctagcgtcttcgtttagttggggtgctgagtgagcgctacacgtccatctactagaacgaccaggcctacaccatccaacgaccggaacccaaacccccaaaaccnggtacgactccgtacgaacacgtacgaaccgtaaggttccggacccttggtacggaaccaacgtacgaccctaaccttatttagttggtacgaccaaccctaaacccgtaaacccgcggacccggtacggggacgggttacctttacgtttacggaccttacgggtacggggacccggtacggggtaccccgttcggtccgtacccgttccgtccctaccgaccgtacccgtacccgacccggtaaccgggcccctacgttcccggttaccccgttcccccgtcggccccgtacccgtccgaccccgtacccgagggacccgtacccgtacccgtaccggacgaccggaccgaccggtcccgggtccccggtcccggtacggggtcccgttccgggtaccccgg

SEQ ID NO: 184048 - DNA, 759 bp, Homo sapiens
  misc_feature: GYAE6OF01C0MVA.34.78.H01.1.454.CMB.1.raw
  modified_base (269)..(269): a, c, t, g, unknown or other
  misc_feature (269)..(269): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacacgacctcacgctgacctgcaccttctctggttctcactcacagtgaagaagaggctgtggccgtgggtccgtcacgcccccagggaaacggcctggacgttccgtagcgcgttacgtttagtgggtnctgatgagcgctacgagtccatctactagaacgaccaggcctacaccgtataccgaaccggaccggaacccaaaacccccaaaaacgacggtactacggaacctcctacggaacctaacgtaccggtaacgtaaacggttccggtacccctagggtaccggaaacctacgtaaccgaccccgttaaaccgttaatttacgttacgggtaccgtaaccctaaacccgtaaacccgttaaaaccgcggtaccccggtacggggtaccggtaaccgtttacgttacgtaaccgtacggtacggggacccgtacgggtacccgtggtacccgaccgttccgtacctacgacctacccgttcccgaaccgtacccggtcctaccgtccggttccctccccgtcggtcccgtcccgtcgccctaccggaccggtcacccgtacccgccggtagacccgtccgaacgacgggcccgtccggtaccggcgtacccggg

SEQ ID NO: 184049 - DNA, 738 bp, Homo sapiens
  misc_feature: GYAE6OF01DJVY5.34.78.H01.1.454.CMB.1.raw
  modified_base (271)..(271): a, c, t, g, unknown or other
  misc_feature (271)..(271): n is a, c, g, or t
  modified_base (350)..(350): a, c, t, g, unknown or other
  misc_feature (350)..(350): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccagggaaacgggcctggacgttcctagcgtcttcgtttagttggggtnctgatgagcgctacagtccatcctcgtgaacgaccaggcctcaccatccaacgaccggaaccaaaccccccaaaaacgngggtacgactacctagaacctacgtacgaacccgtaaaggttcggaccccttggacggaaccaacgacgaccctaaccttaatttacgtgtcgacctaaccaaaccctaaaaccgcgtccccggtagggaccggggtaaccttacgtttacggaaccgttacggtacgggggaacccgtaccgggggtacccgttcgggtacccgtacccgttccctcccgtacgtaccgtacccttaccccgaacccggtaacgggccccctaacggttcccggttaccccttcccccgtcgggccctcccgtccgtccctccggtaggccggtcctaaccgtcgggtcggggaccacgaccgggcccggtacccggtggccgtcggcccgtacggg

SEQ ID NO: 184050 - DNA, 624 bp, Homo sapiens
  misc_feature: GYAE6OF01C3QWF.34.78.H01.1.454.CMB.1.raw
  modified_base (225)..(225): a, c, t, g, unknown or other
  misc_feature (225)..(225): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (404)..(404): a, c, t, g, unknown or other
  misc_feature (404)..(404): n is a, c, g, or t
tcagtacacgtgatcacgaccggtgctcgatttagtgtgagtagtttgggtttgggggggaagaggaagactgacggtcctgccacaggtggtgctgggcacggtgggcactcgacacaacatttgcgctcaactgtcttgtcccagatcaccttgaaggagtctgggtccgacgctggtgaaacccaaacagacctcacgctgacctgcaccttctctgtttcncactcaccagtgaaagaaagcgtgtggtccgtcggtccgtcacgaccccgacggaaagggaccgtcggtagtcctacgcgctcgtttagttgggtgctcgtangtacgcgcgtactacgtccactactctacgacgaaccgnggctcacactcacgacggaccaacccaaaaccaggtnactctcgaacactacgtacgaacgtcggacccgtagtgacacacgacacttatagttatcgacaccaaccttaaaccgacgtcccggtacgggcgggtaccgttactttacgacgtacgtacgggccggacgggtaccgtccggtccgaccgtcctccgtacaccgcccacccgacccgacggcccgtactcccggttccctaccccgtgtcccgtcccg

SEQ ID NO: 184051 - DNA, 754 bp, Homo sapiens
  misc_feature: GYAE6OF01CRKN4.34.78.H01.1.454.CMB.1.raw
  modified_base (237)..(237): a, c, t, g, unknown or other
  misc_feature (237)..(237): n is a, c, g, or t
  modified_base (253)..(253): a, c, t, g, unknown or other
  misc_feature (253)..(253): n is a, c, g, or t
  modified_base (693)..(693): a, c, t, g, unknown or other
  misc_feature (693)..(693): n is a, c, g, or t
tcagtacacgtgatcacgaccggtgctcgatttagtgtgagtagtttgggtttgggggaagaggaagactgacggtcctgccacaggtggtgctgggcacgggtgggcactcgacacaacatttgcgctcaactgtcttgtccagatcaccttgaaggagtcgtcggtccgacgctgggacaaacccaaacacgaccctcacgctcgacctgctaccttctcgttggtttccacacncgacagtagaagaagngctggtcggccgtcgggtaccgcgaccgacccgaagggaacggtccgtaggtacgttccgtacggcgtacgtttcggtttaggttggggtcgtcgtagtaggtaggacgccgtacgttaaccacggtacctactccttacgagaaccgacgacggcctacgaaccgtacaccgaaccggaacccggaaaccctaaaacccccgaaaggtacgtacgtacgtaccgacgactaccgaacgtaacccgtaagtaccggtaccgtagacggaacaccgtacgtaccctaactttagttacgttacggaccgaaacctaaccgaaaccgttaaaccggcccgtcgggtacggggtaaccgggtacctttaacgtccggtaaacgttcggggaaccgggaccggaaccgggttccgtaccgggtaccctaccggtcctacccganacccgtccccacggtaccccgaacggtccctacggttcccgttaccccgtccgcgggtccc

SEQ ID NO: 184052 - DNA, 790 bp, Homo sapiens
  misc_feature: GYAE6OF01AP4VX.34.78.H01.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
  modified_base (199)..(199): a, c, t, g, unknown or other
  misc_feature (199)..(199): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (351)..(351): a, c, t, g, unknown or other
  misc_feature (351)..(351): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtagaaacccaaacacgaccctcacgctgacctgcaccttctctggttcncactcaccagtgaagagnggntcgtggccgtggtccgtcacgccccaagggaacgggcctgggacttccgtagcgtcttcgtttagttgggggncgtgagtgagcnctacngtccatctntagaacgtacgacgctacaccatccgacggaccggaaccaacccccaaaacgnggtcgactccgacacactcgaaccgtaggttaccgaccgtgtacgactaaccgcgtaccctaacgttagtttacgttagacgtaccaacccgtaaaaccctaaaccggaccgggtcccgggttacgggaacccggggtttaacctttacccggttttacgggaacccgtttaccggggaccgggggtaacccgtaccgggggtaccccttcgggtaaccccgtcccgttacgtcccctacgtacccgaccccttaacccggaaccggtacccgggtaccccgtacggtttcccccggtccccgtttacccccgtcgggtcccccgtcccgtccggtacccggaccgtaccggggaccgttaccccgaacccgcggtaaaccggcccggacctaaccgggccggtccccgggccggtacgggtccgtacccggtcccggg

SEQ ID NO: 184053 - DNA, 758 bp, Homo sapiens
  misc_feature: GYAE6OF01EVJ48.34.78.H01.1.454.CMB.1.raw
  modified_base (327)..(327): a, c, t, g, unknown or other
  misc_feature (327)..(327): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctggtcggccgtggggtccgtcacgcccccgaagggaaacgggccgtggacgttcctagcgtcttcggtttagttggggtncgtgagtggacgcgacctacgacgtccatctactaggaacgaccgaggcctaccaaccactaccgaaccggaacccggaaccccaaaaccccccgaaaaaacgcgggtacgaccgttacccgtacgaacctacgtacgaaccgtaacggttccggacccgtggtacggaccaaccgacgtaccctaaccttagtttacgttcgtacgaccaacccgtaaaccctaaaaccgccggacccgggtagggacccggggtaacctttacgttacggtaccgttaccgggtaccggggacccggaaccgggggtacccttcgggtaccccacccggttccctacccgtacccgacccggtcccctaccccgaaacccgggaacccgggtccccctacggttccccggttcccccgtttcccccggcgggtcccccg

SEQ ID NO: 184054 - DNA, 820 bp, Homo sapiens
  misc_feature: GYAE6OF01CR63I.34.78.H01.1.454.CMB.1.raw
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtacgaaacccaaacacgaccctcacgctgacctgcaccttctctcgttctcactcacagtagaagaagagctggtcggccgtcgggtccgtcaccgaccccgaagggaaacggccgtaggtacgttccgtaggccgtcgtttacgtttaggtggggtcgcgttaggataggacgcgtactacgtacgtcctaatcgttaccgtagaacgaccgtacggtcctaccaaccctaacgaccgaaccggaacccggaaaccccaaaacccccgaaaaacggacggtactaaccttaccgtaacgaacctactaaccggaacccgtaacggttaccggacccgttaaggaccggaaaccaccgtaacgacccctaacgtttaattacgttacgtaccgaacccaaacgtaaaaccccgtaaaccgaccggtaccggtccgggtaacggggttactttaccgttacggaaccgttaccgggaccggggtaccggtaaccggggtcccggttacggtaccctacccgttccgtacccgttacgaccgtaccccgtacgaacccggtaccggtacccgtaccgtcccgtttacccctccccggtccggcccgtcccgtacgtcccgtaccgacgtacccgaccgtacccgacggacgtacgacgaccggccgtacccggccgtcggcggtcgtacccgg

SEQ ID NO: 184055 - DNA, 779 bp, Homo sapiens
  misc_feature: GYAE6OF01CKW49.34.78.H01.1.454.CMB.1.raw
  modified_base (189)..(189): a, c, t, g, unknown or other
  misc_feature (189)..(189): n is a, c, g, or t
  modified_base (241)..(241): a, c, t, g, unknown or other
  misc_feature (241)..(241): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtccagatcaccttgaaggagtctggtccgacgctggtgaaacccaaacngaccctcacgctgacctgcaccttctctggttctcactcacagtgaagaagnggctggtcggccgtgggtcctacacgccccgaagggaacgggcctaggacgttcctagcgtcttacgtttagtggggtcgctggatggacgtcgtacctacgacgtccacgttctactacggaacgacccgaagggtcctactaaccacttaccgaaccggaccggaaacccctaaacccccgaaaaacgcgggtacgaaccttccgtacgtaaccgaccgtacgaaccgtaacggttaccggtacccgttggtaaccgggaacaaccgtacgtacccctaagtttacgttacgttacgtccgaaacctaacccgtaaaccccttaaacggacccggtacccgggttacgggggtaacccggggttaactttaccgggttacggtaaccgttaccgggtaccggggacccgtaaccggggtacccgttccggtaaccgtacccgtaccgttcccgtacgaccggtccccttacccgaaccggaacccggggtccctaccggttccccgggtccccttaccccgggtggtaccccccgg

SEQ ID NO: 184056 - DNA, 505 bp, Homo sapiens
  misc_feature: GYAE6OF01D9D34.34.78.H01.1.454.CMB.1.raw
  modified_base (128)..(128): a, c, t, g, unknown or other
  misc_feature (128)..(128): n is a, c, g, or t
  modified_base (452)..(505): a, c, t, g, unknown or other
  misc_feature (452)..(505): n is a, c, g, or t
tcagtacacgtgatcacgaccggtgctcgatttagtgtgagtagtttgggtttgggggggaagaggaagactgacggtcctgacactgaccaagttggaccctgtggacacagccacctattattgtncacacctaaaaaccagcccggtggcggggactactttgactacgtggggccaggggaccctggtccaccgtctcctcacgccctccaccaacgggcccagtccggtccttccccccgtggaccgccctgcctccgaagggacgcctaaccgtccggaagacgccaacgacggtccgggccccgtgggggtcctcggtcccgttggggttaaccaaaaggggtaaccccttaacttttcccgaaattccgtaaaccgggtagtaaaccctggaaacgggtccggggtccttagggacgaaaaggggcctacggaattaaggcagnnnnnnnnnnnnnnnnnnnnnnnnnnnnnnnnnnnnnnnnnnnnnnnnnnnnnn

SEQ ID NO: 184057 - DNA, 676 bp, Homo sapiens
  misc_feature: GYAE6OF01C88TL.34.78.H01.1.454.CMB.1.raw
  modified_base (261)..(261): a, c, t, g, unknown or other
  misc_feature (261)..(261): n is a, c, g, or t
  modified_base (441)..(441): a, c, t, g, unknown or other
  misc_feature (441)..(441): n is a, c, g, or t
  modified_base (664)..(664): a, c, t, g, unknown or other
  misc_feature (664)..(664): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggtagttttcttctggagctgactcgacggtaccccgttgtgtctggtggtccgttgggacacacagtcacgatcacatcgaccgaggagacacgccttacgtaaacctttangactaagtcgtacggtaaccaagaggaacgaccgaaggaccgacggcccctagtacttgtacagtttggtttaggacgaaacgtcggcgtcctaggacggtctcgacgtcgtaccttacgttttcgcggtacctaccggacgggtaccgaaacgtccgggtaccttcccgtacgtaaccncgtacgacggtcgggtacgtacggtacgggacggtaagtacggtacgaggttacctagttactaagtttagtcgacgttaccggtaccgtaactacgtacctacgtacgtaacctcgtcgttacgtcggtaccgggtacgtacggacctccgttccaccggttaccgtgaccgaccgaccgaaccgcccaaccggtcttcgccttacgtcccttccgtacccncctcgtctaccg

SEQ ID NO: 184058 - DNA, 744 bp, Homo sapiens
  misc_feature: GYAE6OF01AF5QV.34.78.H01.1.454.CMB.1.raw
  modified_base (283)..(283): a, c, t, g, unknown or other
  misc_feature (283)..(283): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtacgaaacccaaacacgaccctcacgctgacctgctaccttctctgtttctcactcaccagtgaagaagaggctgtcggccgtgggtccgtcacgccccgaagggaaacgggcctgggacgttcctaggccgtcttacggtttagttgggggtntcgtgagtgagccgtacacacgtccatctacgtacgaacgacgacgcctaccaacctacaccgaacgaacccggaacccaaaacccccgaaaacgacggtacacttccgacgacctacggtactaaccgtaggtaccgaccgtgacggacacgacgtaccctacttattagtcgtacgacctaaaccaaacccgtaaaccgaccgggtccgggtacgggacgggtaacttacggttcgacttacgggcggggtacccggacgggacccttggaccctcccggttcctacccgtcgaccgcccccgtaaccgacccggtaaccgggtccccttacgttccccggttccccttaccccggcgccccgtactcggacccgtaccgacggaccgtccccgaccaccggacgtaacccgccgaaaccggtccgggtccccggtccgcgggtaccctcggtacccgg

SEQ ID NO: 184059 - DNA, 715 bp, Homo sapiens
  misc_feature: GYAE6OF01EL2V6.34.78.H01.1.454.CMB.1.raw
  modified_base (359)..(359): a, c, t, g, unknown or other
  misc_feature (359)..(359): n is a, c, g, or t
  modified_base (480)..(480): a, c, t, g, unknown or other
  misc_feature (480)..(480): n is a, c, g, or t
  modified_base (622)..(622): a, c, t, g, unknown or other
  misc_feature (622)..(622): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggccgtgggtccgtcacgcccccgaggaaacgggcctggtacgttcctaggccgtcgttcgttttagttgggggtgctgatgagcgctacacgtccatctctagaacgaccgacggcctcaccatccgaaccgaccggaaccaacccccaaaaacgnggtacgactcctacgaacctacgtacgaacctaaggttcggaaccctggtacggacctaccgacgccctaaccttaattacttgcgccaaacctaaaccctaaaaccgaccggtccccggngggtaccggggtaccttacgtttagacccgttacgggtcgggacccggacgggtacccgttcggtaccgtacccgttcctcccgtctaccgccctaccgaacccgtaccgggcccctacgttcccggtccctttcccccggnggtccctcccgtcgcctaccgacggaccgtcccgtaccgtccgaacgacgcccaaccgtccgggtcccgacccggtcgggcctccggtacccg

SEQ ID NO: 184060 - DNA, 781 bp, Homo sapiens
  misc_feature: GYAE6OF01AS7UY.34.78.H01.1.454.CMB.1.raw
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaacagaccctcacgctgacctgcaccttctctggtttctcactcaccagtgaagaagaggctgtggcctgggtccgtcacgcccccgagggaaacgggcctggacgttcctagcgtcttcggtttagttggggtgctgatggacgcgctacagtccatctctgaacgaccaggcctcaccatccacgaccggaaccaaaccccgaaaaccgacggtcgactccgtacgaacctactacgaaccgtaaggttcggaccctgtacggacacgacgtacccaccttagttacttgtacgaccaaacctaaacccgtaaaaccgacggtccccggtagggaccggggtaactttacgtttacgaacccgttacggtccgggggacccgtaaccggggtacccgtcgggttaccgacccgttccgtaccctccgacgtaccccgtacccgaacccgtaacggggccccctaacggttccccggttaccccgtttccccccggtccggggtccccgtaccccggttcccgtcccgtacccggaaccgggtaccggccccgtaacccccggtaccgggtaaccgaccggtaacccgacggtaaccccgtcccggggaccccggtttcggggcccgtcccgggtacccgggg

SEQ ID NO: 184061 - DNA, 518 bp, Homo sapiens
  misc_feature: GYAE6OF01BOEFK.34.78.H01.1.454.CMB.1.raw
  modified_base (266)..(266): a, c, t, g, unknown or other
  misc_feature (266)..(266): n is a, c, g, or t
  modified_base (353)..(353): a, c, t, g, unknown or other
  misc_feature (353)..(353): n is a, c, g, or t
  modified_base (359)..(361): a, c, t, g, unknown or other
  misc_feature (359)..(361): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (386)..(386): a, c, t, g, unknown or other
  misc_feature (386)..(386): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (431)..(431): a, c, t, g, unknown or other
  misc_feature (431)..(431): n is a, c, g, or t
  modified_base (433)..(433): a, c, t, g, unknown or other
  misc_feature (433)..(433): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactgggccaggggaccctggtcaccgtctcctcagcctccaccaagggcccatcggtcttccccctggccgcctgcttccaggagccacctccgagagcanagcgccctgggctgccgtggtcaaggctactttccatccaacgtgtaactggacgcgggtctagggcaagggccgactaagtacggntcatcnnngctnagctnacngctaggnacacgntacatagancatagnagacangcacgngtacgncanacagngngngngacacgtcacncncgctacgacnncncgacacgacgcgagacgtgacactcgacgtacgacgtacacacctcgtacgtacggtcg

SEQ ID NO: 184062 - DNA, 665 bp, Homo sapiens
  misc_feature: GYAE6OF01BDR7R.34.78.H01.1.454.CMB.1.raw
  modified_base (225)..(225): a, c, t, g, unknown or other
  misc_feature (225)..(225): n is a, c, g, or t
  modified_base (385)..(385): a, c, t, g, unknown or other
  misc_feature (385)..(385): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttcncactcaccagtgaagaagaggctggtggcctggggtccgtcacgcccccaggaaacgggcctgggacgttcctagcgctcgtttagttggggtgctggatgagcgctacagtccatctctgaagccaggctcacatcacgacggaccaaccccaaaacgnggtacgactcctgacacgtcgacctaagttcggacctggtcgaccacgacgcctaaccttattacgttcgtacgaccaaccaaccctaaaaccgccggtaccccggtacgggaccggggtaccttacgtttacggaaccgttacggtcggggacccaaccggggtaccccgttgggtaccctacccgggttccttaccccgtctaacccggcccctacccgaacccgaacggggtcccccaggttaccccgggttcccttccccccggtgggtccccccg

SEQ ID NO: 184063 - DNA, 798 bp, Homo sapiens
  misc_feature: GYAE6OF01EUARI.34.78.H01.1.454.CMB.1.raw
  modified_base (142)..(142): a, c, t, g, unknown or other
  misc_feature (142)..(142): n is a, c, g, or t
  modified_base (283)..(283): a, c, t, g, unknown or other
  misc_feature (283)..(283): n is a, c, g, or t
  modified_base (363)..(363): a, c, t, g, unknown or other
  misc_feature (363)..(363): n is a, c, g, or t
  modified_base (472)..(472): a, c, t, g, unknown or other
  misc_feature (472)..(472): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtacgaaacccaanacgaccctcacgctgacctgctaccttctctggtttctcactcacagtgaagagagctgtggccgtcgggtcctcaccgcccggaagggaacggtccgtaggtacgttccgtagtccgtcgtttcgtttaggttcggggtnctggtaagtcggtacgccgtactacgtacggtccctaagttcctacgtacggaaacggaccgtacgtaccgtaccaaccncgtaaccggaacccggaaccggaaaccccctaaaaccccgaaaaacggtcggtacgtacctaccgtacgaacctactacgaccgtagtaccgctaggacgacacgtacncctacttagttattcgacgtaccaacctaaaccgtaaaccgccggtccggtacgggtaccggtaccttacggtttaacgtacggtaccgtaccgggaccggtaccgggtaccgtcgtaacccgtccgtacccgtctaccctaccgtcctaacccggaacccgtaaccggtcccgtaacccggttcccgtttcccggttacccccgccgggtaccccgtccccgtacgtcccgtacccggtaggaacccgggtcccacccgttaacggcgtaaacccgcccgacggtacccggacccggtccgggtaccgtccggtaccgtacccgg

SEQ ID NO: 184064 - DNA, 818 bp, Homo sapiens
  misc_feature: GYAE6OF01AJX3P.34.78.H01.1.454.CMB.1.raw
  modified_base (121)..(121): a, c, t, g, unknown or other
  misc_feature (121)..(121): n is a, c, g, or t
  modified_base (161)..(161): a, c, t, g, unknown or other
  misc_feature (161)..(161): n is a, c, g, or t
  modified_base (193)..(193): a, c, t, g, unknown or other
  misc_feature (193)..(193): n is a, c, g, or t
  modified_base (201)..(201): a, c, t, g, unknown or other
  misc_feature (201)..(201): n is a, c, g, or t
  modified_base (237)..(237): a, c, t, g, unknown or other
  misc_feature (237)..(237): n is a, c, g, or t
  modified_base (352)..(352): a, c, t, g, unknown or other
  misc_feature (352)..(352): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacntttgcgctcaactgtcttgtcccagactcaccttgaaggngtctggtccgacgctgggtacaaaacccaaancgaccctnacggctgacctgcctaccttcgtcttggttttaccnctaaccgtccacagtgaaagaagcgtctggtggccgttagggtccctcgaccgccccgaaggaacgggtcctggtaacgttccgtaaggccgtcttacggtttaggtgggggtcncgttaggacgttcggacgcggtacctaagtccgtacctgtcctagtacgaagtaccgacggtacctaccaccgttacgcccgaacccggaaccggttaaacccccaaaaaccccgtaaaaggcggtataccgttcccgagtaaacctccgggtaacgaaacccgttacggtaaccggtccgtacggtaaccggaacctacgaacccggtaccttaaaccttagtttacgttgaacctaccccaaactaacccgtaaaccgcggtaacccgggtcgggtaacccgggttaccttaacggtttccgaaacccggtttcggggcccgggtaaacccgggtcccggggtaccttccggggtaaccctacccgggttccctaccggtacccgtacgaccccgttacccgggaaacgtaaccccggggttccttaaccgggtccctttcccccgtccgggttaccggccccg

SEQ ID NO: 184065 - DNA, 948 bp, Homo sapiens
  misc_feature: GYAE6OF01B6GJW.34.78.H01.1.454.CMB.1.raw
tcagtacacgtgatcacgaccggtgctcgatttagtgtgagtagtttgggtttggggggaagaggaagactgacggtcctgccacaggtggtgctgggcacgggtgggcactcgacacaacatttgcgctcaactgtcttgtcccagatcaccttgaaggagtctggtccgacgctggtagaaaaccccaaacagacccctcacgctgacctgcctaccttctctgtttctcactcaccagtagaacgaagaggctggtcggccgtggggtcccgtcgacgcccccgaagggaaacgggccgtggtacgttccgtagccggtccgttcggtttaggttcgggggtgtcgttaggtagttcggacggtccggtacctaaccgtacggttacccagttccttacgtacggaaacgaacccgacgggtcctaccaacctactacccgaaccggaaacccggtaaacccccaaaaaccccccggaaaaaaccgtacgggtacgaaccgtacccgtacgaaccgtaaccgtacggtaaacccgtaaggtttaccgggtaaccccgtggtacggaaccaacgaccgtacccttaacttacgtttacttcggtaccgaccctaaaccctaaaacccccgtaaaaccggtacccgggtaccccggggtaacgggggttaacccggggttaaacccttttaacggtttaaccggtaacccggtttaacggggtacccgggggggtaccccggtaaaccccgggggggtaccccgtttcggggttacccccgtaaccccggttttcccgtaaccccggttacccgaccccgggttaaccccccgttaacccccgggtaaaccccgggaaaccccgggggtaccccccctttaaccgggtttacccccccgggtttcccccccttttaccccccccggggtcggggtaccccccccggg

SEQ ID NO: 184066 - DNA, 776 bp, Homo sapiens
  misc_feature: GYAE6OF01CKB66.34.78.H01.1.454.CMB.1.raw
  modified_base (177)..(177): a, c, t, g, unknown or other
  misc_feature (177)..(177): n is a, c, g, or t
  modified_base (279)..(279): a, c, t, g, unknown or other
  misc_feature (279)..(279): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttcncactcaccagtgaagaagaggctggtggcctgggtccgtcacgcccccgaagggaaacgggcctggtacgttcctagccgtcttcggtttagttgggggtcnctggatgagcgtctactacgtccacttctacgagaaacgaccgaggctaccaccataccgaccggacgaaccccaaacccccaaaaacgtggtacgactcctagacctactacgaaccgtacggtcgacccgttggtaccggacaccacgaccctaactatttacgtgtcgacaaaccaacccgtaaaccgtcgggacccggtaggggaccgggtaactttacgttacggtaaccgttacgggtaccggggaccggtaaccgggggtcccttacgggtacccgtacccgttccgtaccctaccgaaccgtccccctacccggaaccggtaaacccggggtcccccagggttaccccggttcccctttacccccggcgggtcccccacccggtccgtcccgacccggacggaccggaccctaccccgggtaccggtaacgccggacccgacggtcccgggacccgggtccccgtacggggtcccgtcggtaccccggg

SEQ ID NO: 184067 - DNA, 835 bp, Homo sapiens
  misc_feature: GYAE6OF01E4VI5.34.78.H01.1.454.CMB.1.raw
  modified_base (159)..(159): a, c, t, g, unknown or other
  misc_feature (159)..(159): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcacttgaaggngtctggtccgacgctggtagaaacccaacagaccctcacgctgacctgcaccttntcctggttcncactcaccagtgaagaagacggctagtcggccgtgggtccgtcacgcccccaagggaaacgggcctaggacgttccgtagccgtccttcggttttagtcgggggtacgtccgtggtactggacggccgtaccgtaaccgacgttacccgtaacttccgtaccgtaggtaaaccggacccgaacgggtccttaccgaaccctagtacccgaaccggaacccgggtaaccccaaaccccccgtaaaaaacgtacgggttacaacgttccctacggaacctaccgttacgaaccgtaacggttccggtacccgttaggtacgggactaaccgaccgtcccttaaaccgttagtttacgttcgtaccgaacctaacccgtaaaccccttaaaacccggacggttaccccgggtacggggtacccgggggtaactttaccggtttaccggtaaccgttaccgggtacgggggtacccggtaaccgggggtacccgtaccgggttacccaacccggttcccgttcccgttacccgacggtccccttaacccgaacccggaacccggggtcccctaacgttaccccggtttccccgttcccccggtcgggtcccccgg

SEQ ID NO: 184068 - DNA, 1070 bp, Homo sapiens
  misc_feature: GYAE6OF01DXAMF.34.78.H01.1.454.CMB.1.raw
  modified_base (187)..(187): a, c, t, g, unknown or other
  misc_feature (187)..(187): n is a, c, g, or t
  modified_base (1055)..(1055): a, c, t, g, unknown or other
  misc_feature (1055)..(1055): n is a, c, g, or t
tcagtacacgtgatcacgaccggtgctcgatttagtgtgagtagtttgggtttgggtttcaccagcgtcggaccatcccttcatgggtcttgtcccagatcaccgttgaaggagtctggtccgacgcgtggtacgaaacccaaacacgaccctcacgctcgacctgcctaccttctcgttcgtttcncactcaccgtagtagaagaaggcggtcgtggtcggccgttcgggtcccgtacgaccggacccccggaaagggaacggtccgtagggttaccgttaccgtaggtccgtcgttttacggttttaggttggggtgtacgtgtaacgtggacggtccgtacgttacaccgtcctaacgttctacgtaggaaaaccgtccacggtacctacctaaccgtacgttacccggaaccgggaaccccgaaaacccccaaaaaccccccgaaaacggttcggtaccgtaacccttccgtaaccgtaaccgtaacgtaaccggtaaacccgtttaagggttaaccccggtacccgttacgggaaccggtaacaacccggtaacctaacccctttaaacggttttacgtttaacgtttccgggaacccgttaaaacccaaaccccgttaaaaaccccggttaaaccccgggacccggggttaccccgggtccggggggtttaaaccccgtttaaccggttttaacccggtttaaccgggtaacccccggtttccggggtaaccccggggggaacccggtaaccccgggttacccgggttaacccgggttcccccgttaacccgttttccccgaccccgtttacccgggaaccgttaccccccgtaaacccgggtaacccgaacccccggggttcccttaccccggtttcccccggttttacccccggcccccgttaccgggcccccgtttacccgtccgggttaccctaccccggggtaaagtcccctacccccggttaacccggggtacccaacggggccccttaaaccccgggacccggtaccgggggtacccccttccggggggccttaaccccggngggtttaacccccgg

SEQ ID NO: 184069 - DNA, 815 bp, Homo sapiens
  misc_feature: GYAE6OF01BJ13R.34.78.H01.1.454.CMB.1.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (251)..(251): a, c, t, g, unknown or other
  misc_feature (251)..(251): n is a, c, g, or t
tcagtacacgtgatcacgaccggtgctcgatttagtgtgagtagtttgggtttgggggggaagaggaagactgacggtcctgccacaggtggtgctgggcacgggtgggcactcgacacaacatttgcgctcaactgtcttgtcccagatcaccttgaaggagtcgtggtccgacgctaggtacgaaaacccaaacacgaccctcacgctgacctgctaccttntctgttcncactcacagtagaaagagnggtctggcggtccgtcgggtcctcgaccgaccccggaagggaacggtccgtaggtacgttaccgtagtccggtccgtttacggtttaggttcgggggtctacggtggacgttcggacggtaccgtaccgtaaccgtacgttacccgtagtccttacggtaacggaacggtaaccgacggtacctaccaaccgtacgtacccggaacccggaaccgaaaccccctaaaacccccgaaaaggtacggtacgaccgttaccgtacgaaccgtacgtaccgtaaccgttaacgggttccggtacccgttaggtaccgaacaaccgaccgtaccctaagtttaacgttcgttacgtaccgaaccctaaacctaaaccccgtaaaccgccgggtacccggtacgggtacccggtaactttaccggttacggaccggtaacgggtccggggtaacccgtcggggtaccctcggtacccgtacccggttctcccgttaaccgccgtaccccgacccggaaccggtccggtacccttaccgggtcccgtttccccgttcccgccggtccccgg

SEQ ID NO: 184070 - DNA, 683 bp, Homo sapiens
  misc_feature: GYAE6OF01ERR6J.34.78.H01.1.454.CMB.1.raw
  modified_base (197)..(197): a, c, t, g, unknown or other
  misc_feature (197)..(197): n is a, c, g, or t
tcagtacacgtgatcacgaccggtgctcgatttagtgtgagtagtttgggtttgggctgggagaggagcccagcactagaggtcggcggtgtttccattcggtgatcagcactgaacacagaggactcaccatggagtttgggctgagcttgggtttttcctcgttgcttcttttaagaggtgtccagtgtcaggtncagctggtggagtcggtgggggagcgtcggcccagccgtgggaccttcccgtgacgtacctctcctggtcgcaggtccgtcgtaggtactttccaccctttacgacggttaacgtctaagttcgggcattcggaccgacggttccgggtcccgcccgaggtccctccggagggtccggaaaggggtccgttagggacggttggggtcggtacgtaggtttaataggttaggtagtagagttagggtaaagtatacgtaaagttacgtatgacgtaacgtcgtacggtacggacggaccgtacgttaccgtaccgtcgtaccgaagaacgaacctaacctacccgaagaaccgtacgacttagtactcgagtaacaagtcccgaacgtacgacgtaggacgaccgacggaacgtaccgacggtacgtaacgtagttacgttacgtaggtacgacggtaacggtacgaacgaaccgcgcccgtaacgg

SEQ ID NO: 184071 - DNA, 695 bp, Homo sapiens
  misc_feature: GYAE6OF01EV0HT.34.78.H01.1.454.CMB.1.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcacagatcacttgaaggagtctggtccgacgctggtacgaaaacccaaaacacgacccctcacgctcgacctgctaccttctcttggtttcncactcaccagtagaagaagngctggtcggccgtgggtccgtcaccgaccccaagggaaacggccgtggtacgttccagcgtcgttcgtttagttggggtgtctggagtggagcgactacacgtaccattctacgtagaacgtaccgacgctacaccgataccgaaccgaaccggaaacccaaaccccgaaaaacgtcgggtactactcccgtacgaactaccgtacgaacccgtaaggtccgaccgtagtacggtaacaacactaacccgttacttaagtttacgtacgtacgaccaaaccgtaaacctaaaccgccgtaccgggacggggtaccggtactttaccgttagaaccgttacgggacgggtaccgacgggtaccctcggtacctaccgtcctaccaccgtcgccctaccgaaccggaaccggtacctacgttcccggttcccgttcccggtccg

SEQ ID NO: 184072 - DNA, 762 bp, Homo sapiens
  misc_feature: GYAE6OF01AXDCE.34.78.H01.1.454.CMB.1.raw
  modified_base (234)..(234): a, c, t, g, unknown or other
  misc_feature (234)..(234): n is a, c, g, or t
  modified_base (256)..(256): a, c, t, g, unknown or other
  misc_feature (256)..(256): n is a, c, g, or t
  modified_base (308)..(308): a, c, t, g, unknown or other
  misc_feature (308)..(308): n is a, c, g, or t
  modified_base (422)..(422): a, c, t, g, unknown or other
  misc_feature (422)..(422): n is a, c, g, or t
tcagtacacgtgatcacgaccggtgctcgatttagtgtgagtagtttgggtttggggagctgtgggctcagaagcagagttctggggtgtctcccaccatggcctggacccctctctggctcactctcctcactctttgcataggttctggagtttcttctgagctgactcaggaccccgttgtgtctggtcggtccttgggacacacgagtcacgtatcacatgccgaggganacacgtcctacgtaacttttanagcaagctaggtaccaacagaacgccgaggaccgacggcccctagtaacttntacgtagttggtttacgtaacggaaaacgcggccggtcccgtacggtacgggtactccgtccgttacggtaccgttattttccgtcggccgtaccgtaccggtaccggtaaccnccggtaccttcccgtacgtacctacgtccgtaccggtgggtaccgttcggtacgggacggtaagtaggtcgggtaacggtccttaggttaaaccgttacgtttacgtttacggaacccgttaaccggttacccggacttaccgtaccgtaacggttaccggtaacccttacgtccgtttaccggttaccggtacggggtacgggtacccggacccgttacccggtacccttccggtaccgttacgcccgaccgtaccccgacggtaccccccaaccgtcgtacccgttacccgtaccgtttacccgtccccgttacccccgcccttccgtaccgtacccg

SEQ ID NO: 184073 - DNA, 1034 bp, Homo sapiens
  misc_feature: GYAE6OF01E26VH.34.78.H01.1.454.CMB.1.raw
  modified_base (112)..(112): a, c, t, g, unknown or other
  misc_feature (112)..(112): n is a, c, g, or t
  modified_base (176)..(176): a, c, t, g, unknown or other
  misc_feature (176)..(176): n is a, c, g, or t
  modified_base (904)..(904): a, c, t, g, unknown or other
  misc_feature (904)..(904): n is a, c, g, or t
  modified_base (997)..(997): a, c, t, g, unknown or other
  misc_feature (997)..(997): n is a, c, g, or t
tcagtacacgtgatcacgaccggtgctcgatttagtgtgagtagtttgggtttgggtttcaccagcgtcggaccatcccttcatgggtcttgtcccagatcaccttgaaggngtctggtccgacgctggtgaaacccaaacagaccctcacgctgacctgcaccttctctggttcncactcaccagtgaagaagaggctggtggccgtgggtccgtcacgcccccgaagggaaacgggtcctagggtacgtttcctacggccggtccgtttacgttttaggtttcgggggtagtccgtaggtaagtggtacggccgcgttaaccacggttacccacgttccgttaccgtaaggaaacgaccccggtacggtacccttaaccccgaacccttaacgtaccgaaaccccggggaaaccggtaaaacccccccgaaaaaccccccccgtaaaaaaacccggtaaggggttacctaaccgtttcccccgtaaggtaaaccctaaccggtacggtaaacccgttaaaccgggtttccggtaaaccccggttaggggttaccggaaacctaaccggaaccggtacccccgttaacccgtttaagttttagtttacggtaccggtaacccaacccgttaaaaaccccgtaaacccgtaccggggtttacccccgggtacggggtaaccccgggggttaacctttaacgggttaccggtacccggtttaaacccggggtccggggggaaccccgacccggggttacccttcccgggttaaccttacccggttcccttaccccggtcccgaaccccgtaccccgtaaccccgggaaccccgaaccccggggtaccccgttaccgttttacccccggtttccccccgttaccccccgggttacggggtaccccncccccgtttcccgaccggttaaccccccgggaggtaccccggtacccctaacccgggtaccccggaaacggtcccgacgaaccccggggtacnccccggggtacccgtccgggtccctcgggtacccggg

SEQ ID NO: 184074 - DNA, 177 bp, Homo sapiens
  misc_feature: GYAE6OF02IN3E6.34.78.H01.1.454.CMB.1.raw
  modified_base (177)..(177): a, c, t, g, unknown or other
  misc_feature (177)..(177): n is a, c, g, or t
tcagtacacgtgatcacgaccggtgctcgatttagtgtgagtagtttgggtttgggaacctatgaacattctgtagggaccaccgtctccgtcctaggtcagcccaaggccaacccactgtcactctgtttccgcctcctcatcacgtgtactgagcgggctggcaaggcgcatagn

SEQ ID NO: 184075 - DNA, 338 bp, Homo sapiens; identical to SEQ ID NO: 184014
  misc_feature: GYAE6OF02JE4L5.34.78.H01.1.454.CMB.1.raw
  modified_base (335)..(338): a, c, t, g, unknown or other
  misc_feature (335)..(338): n is a, c, g, or t

SEQ ID NO: 184076 - DNA, 155 bp, Homo sapiens
  misc_feature: GYAE6OF02GKJT2.34.78.H01.1.454.CMB.1.raw
  modified_base (155)..(155): a, c, t, g, unknown or other
  misc_feature (155)..(155): n is a, c, g, or t
tcagtacacgtgatcacgaccggtgctcgatttagtgtgagtagtttgggtttgggggaagaggaagactgacggtcctagcacagcggccctgggctgcctggtcaaggactacttccatcacgtgtactgagcgggctggcaaggcgcatagn

SEQ ID NO: 184077 - DNA, 556 bp, Homo sapiens
  misc_feature: GYAE6OF02GXFVM.34.78.H01.1.454.CMB.1.raw
  modified_base (342)..(342): a, c, t, g, unknown or other
  misc_feature (342)..(342): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttatgcaagctggtaccaacagaagccaggacaggcccctgaacttgtcatgttggtagaaaacgagcggccctcgagggatctctgaccgtattttcnggcttccgaggtccggaaacaccggcttccctgaccatcacgtggggctcgtggcgaagagtgaggctgactatattgactaacgttcccgggacatcactggtaaccatcgtcgttcgttcggaggtcggaccaccgtctccgtcgtagtcacgcccgaacggcccaaccccacgtcgtcacctcctccgttccccgcccttccctactaccg

SEQ ID NO: 184078 - DNA, 576 bp, Homo sapiens
  misc_feature: GYAE6OF02GM8JJ.34.78.H01.1.454.CMB.1.raw
  modified_base (399)..(399): a, c, t, g, unknown or other
  misc_feature (399)..(399): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcacgacggacacccccaaaaccaggtgatcctgacactgaccaagttcggaccctgtggacacagccactattattgtgcacacctaaaccngcccgtggcgggactactttgactacgtggggccacggggaccctggtcacccgtctccctcacgccctccaccgaacgggcccacgtccggtccttcccccgtggcccgccctgcctccgacggacgccaccgtcccggacgacgccacgacggccggccctggggcctgtcccgg

SEQ ID NO: 184079 - DNA, 532 bp, Homo sapiens
  misc_feature: GYAE6OF02FK6AC.34.78.H01.1.454.CMB.1.raw
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
  modified_base (528)..(528): a, c, t, g, unknown or other
  misc_feature (528)..(528): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttangcaagctggtaccaacagaagccaggacaggcccctgaacttgtcatgttggtgaaaacgagcggccctcgagggatctctgaccgtattttcnggctccaggtccggaaacacggcttcctgaccatcacgtggggctcgtggcggaagatgaggctgactattatgctaagttcccgggacatcactggtaaccatctcgtcttcggaggtcggaccaccgtctccgtcctaggtcacgcccgaaggcccaacccactgtcactctcgtcccaccctcnctac

SEQ ID NO: 184080 - DNA, 355 bp, Homo sapiens
  misc_feature: GYAE6OF02JPU6M.34.78.H01.1.454.CMB.1.raw
  modified_base (337)..(355): a, c, t, g, unknown or other
  misc_feature (337)..(355): n is a, c, g, or t
tcagtacacgtgatcacgaccggtgctcgatttagtgtgagtagtttgggtttggggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcgggctggcaaggcgcatagnnnnnnnnnnnnnnnnnnn

SEQ ID NO: 184081 - DNA, 338 bp, Homo sapiens
  misc_feature: GYAE6OF02IGABF.34.78.H01.1.454.CMB.1.raw
  modified_base (336)..(338): a, c, t, g, unknown or other
  misc_feature (336)..(338): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcgggctggcaaggcgcatagnnn

SEQ ID NO: 184082 - DNA, 575 bp, Homo sapiens
  misc_feature: GYAE6OF02HZR0R.34.78.H01.1.454.CMB.1.raw
  modified_base (330)..(330): a, c, t, g, unknown or other
  misc_feature (330)..(330): n is a, c, g, or t
  modified_base (504)..(504): a, c, t, g, unknown or other
  misc_feature (504)..(504): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcacgacggacaccccaaaaaccngtgatcctgacactgaccaagtggaccctgtggacacagccacctattatgtgcacaacctaaaccagcccgtggcgggacttactttgactacgtggggccaggggaccctggtccaccgtctcctcacgcctccaaccgaacgggcccagtccggtccttcccccgtggccnccccgtgcccttccgacggacgccaccctccggacgacgccaacgcggccggacccgtcgggcctgcccgg

SEQ ID NO: 184083 - DNA, 339 bp, Homo sapiens
  misc_feature: GYAE6OF02F4146.34.78.H01.1.454.CMB.1.raw
  modified_base (336)..(339): a, c, t, g, unknown or other
  misc_feature (336)..(339): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcctgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcgggctggcaaggcgcatagnnnn

SEQ ID NO: 184084 - DNA, 603 bp, Homo sapiens
  misc_feature: GYAE6OF02HU5UW.34.78.H01.1.454.CMB.1.raw
  modified_base (310)..(310): a, c, t, g, unknown or other
  misc_feature (310)..(310): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctacgaaaccttttatgcaagctggtaccaaacagaagccaggacaggcccctgaacttgtcatgttggtgaaaacgngcggccctcagggatctctgaccgtattttctggtcctcgacggtaccgaaacgacggtccttccagacctatccacgtggggctcgtcgggacgaagatggaggctgactattatcgactaagttcccgggaatactaccgtacgtacggtaaccattccgtacgttcgtacgggtacggtacggacctaccgtctccgttccgtaggtcaccggcccgtaacggacccctaaccccgattccgtacctacgtttcccgtaccgtttccccccgccttcccctacgtacccg

SEQ ID NO: 184085 - DNA, 559 bp, Homo sapiens
  misc_feature: GYAE6OF02GD19R.34.78.H01.1.454.CMB.1.raw
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccatgctcaccatcacgacggacacccccaaaacaggtgatcctgacactgaccaagttcggaccctgtggacacagccacctattattgtgcacacctaaaaccagcccgtggcggggactacttgactactggggccaggggaccctggtcaccgtctcctcacgcctccaccaacgggcccagtccggtccttccccgtcggccgccctgcctccgacggcgccacccgtccgagacgcacgcgccggcccgtgggcctcgg

SEQ ID NO: 184086 - DNA, 343 bp, Homo sapiens
  misc_feature: GYAE6OF02F8YJN.34.78.H01.1.454.CMB.1.raw
  modified_base (335)..(343): a, c, t, g, unknown or other
  misc_feature (335)..(343): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcggctggcaaggcgcatagnnnnnnnnn

SEQ ID NO: 184087 - DNA, 339 bp, Homo sapiens
  misc_feature: GYAE6OF02FX8F9.34.78.H01.1.454.CMB.1.raw
  modified_base (336)..(339): a, c, t, g, unknown or other
  misc_feature (336)..(339): n is a, c, g, or t
tcagtacacgtgatcacgaccggtgctcgatttagtgtgagtagtttgggtttgggggaagaggaagactgacgttcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcgggctggcaaggcgcatagnnnn

SEQ ID NO: 184088 - DNA, 548 bp, Homo sapiens
  misc_feature: GYAE6OF02FZJCY.34.78.H01.1.454.CMB.1.raw
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgttattggggtgctgatgagcgctacagtccatctctgaagaccaggctcaccatcacgacggacaccccaaaaaccaggtgatcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttcccctggcgccctgctccaggagcacctccgagacgcaccagccggcccgtcgggctgtcccg

SEQ ID NO: 184089 - DNA, 571 bp, Homo sapiens
  misc_feature: GYAE6OF02F7BRU.34.78.H01.1.454.CMB.1.raw
  modified_base (333)..(333): a, c, t, g, unknown or other
  misc_feature (333)..(333): n is a, c, g, or t
  modified_base (398)..(398): a, c, t, g, unknown or other
  misc_feature (398)..(398): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccaggaaagggcctggagttcctagcgctcgtttattggggtgctgatgagcgctacagtccatctctgaagaccaggctcaccatcacgacgaccaccccaaaacaggtnatcctgacactgaccaagttcggaccctgtggacacagccactatattgtgcacacctaaaaccngcccgtggcgggactacgtttgactacgtggggccaggggaccctggtcaccgtctcctcacgccctccaccgaacgggcccacgtccggtccttccccgtggccgccctcgcctccgaggacgccaccctccgacgcgaccaccgacggccggcccgtcgggcctggtcccg

SEQ ID NO: 184090 - DNA, 601 bp, Homo sapiens
  misc_feature: GYAE6OF02JGL7Q.34.78.H01.1.454.CMB.1.raw
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttangcaagctggtaccaacagaagccaggacaggcccctgaacttgtcatgtttggtagaaaacgagcggcctcagggatctctgaccgtattttcnggctcaggtccggaaacacggcttaccctgaccatccactcggggctcgtggacggaagatggaggctgaacttattattgactaacgttcccgggacacgtcaacgtacggtaaccatccttacgttcgtttagggacggtcgggaaccctaccgttccgttaccgttccgttacgggtccacgacccgtaacgggacccaaccccgtacgtcgtaccaccttccgttacgttacccccgtacccttccctacgtaacc

SEQ ID NO: 184091 - DNA, 583 bp, Homo sapiens
  misc_feature: GYAE6OF02H756E.34.78.H01.1.454.CMB.1.raw
  modified_base (332)..(332): a, c, t, g, unknown or other
  misc_feature (332)..(332): n is a, c, g, or t
  modified_base (398)..(398): a, c, t, g, unknown or other
  misc_feature (398)..(398): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttatggggtgctgatgagcgctacagtccatctctgaagaccaggctcacatcacgacggacaacccccaaaacaggtnactcctgacactgaccaagttggaccctgtggacacagccactattatgtgcacaacctaaaaccngcccgtgggacgggtactacgtttgactacgcgggccaggggacctggtcaccgtctcctcacgccctccaccgaacgggccccacgttccggtccctttcccccgtagggcccgaccccgtgcctcccgacgggacgccacccgtccgagacgccacgacggccggccccgtgggcctgtcccg

SEQ ID NO: 184092 - DNA, 155 bp, Homo sapiens; identical to SEQ ID NO: 184076
  misc_feature: GYAE6OF02GUGSC.34.78.H01.1.454.CMB.1.raw
  modified_base (155)..(155): a, c, t, g, unknown or other
  misc_feature (155)..(155): n is a, c, g, or t

SEQ ID NO: 184093 - DNA, 569 bp, Homo sapiens
  misc_feature: GYAE6OF02IA0DA.34.78.H01.1.454.CMB.1.raw
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
  modified_base (357)..(357): a, c, t, g, unknown or other
  misc_feature (357)..(357): n is a, c, g, or t
  modified_base (539)..(539): a, c, t, g, unknown or other
  misc_feature (539)..(539): n is a, c, g, or t
tcagtacacgtgatcacgaccggtgctcgatttagtgtgagtagtttgggtttggggctgggagaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggacttcaccttcagtagnatggcatgcacgtcggggtccnccaggcctccgaggcgaaggggctgggagtgggngctagttanacgtggtagngagtggaagtagtcaagtactagtgacacgtactcggtaggaacgggtcctagttccgaccgttactaccgaaagacgaacctaacgtacccgaaagaaccgacgtctacgtatcgtagactaagtcgaccagacctagaacgacgccggagaccgacggtatagtacgttacttacgtcgngtacgaagacgaagacgtaccgcctaacgg

SEQ ID NO: 184094 - DNA, 550 bp, Homo sapiens
  misc_feature: GYAE6OF02GIQLT.34.78.H01.1.454.CMB.1.raw
  modified_base (247)..(247): a, c, t, g, unknown or other
  misc_feature (247)..(247): n is a, c, g, or t
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
  modified_base (461)..(461): a, c, t, g, unknown or other
  misc_feature (461)..(461): n is a, c, g, or t
  modified_base (475)..(475): a, c, t, g, unknown or other
  misc_feature (475)..(475): n is a, c, g, or t
  modified_base (522)..(522): a, c, t, g, unknown or other
  misc_feature (522)..(522): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttangcaagctggtaccaacagaagccaggacaggcccctgaacttgtcatgtttggtagaaaacgngcggcctcgagggatctctgaccgtattttctggctccgacggtaccggaaacacggccttccctcgacctatcacgtggggcctcgtgggcggaagngtgacggtctgacttattatcgactaagttcccgggactactcactgtaaccntcgtcgtcttcggngtcggaccacgtcctccgtctaggtcacgcccgaacggcccaacccnctcgcactctccgtcccncctccnctac

SEQ ID NO: 184095 - DNA, 556 bp, Homo sapiens
  misc_feature: GYAE6OF02I7SBZ.34.78.H01.1.454.CMB.1.raw
  modified_base (306)..(306): a, c, t, g, unknown or other
  misc_feature (306)..(306): n is a, c, g, or t
  modified_base (373)..(373): a, c, t, g, unknown or other
  misc_feature (373)..(373): n is a, c, g, or t
  modified_base (448)..(448): a, c, t, g, unknown or other
  misc_feature (448)..(448): n is a, c, g, or t
  modified_base (506)..(506): a, c, t, g, unknown or other
  misc_feature (506)..(506): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctgggtcctcacgccccaggaaaggcctggagttcctagcgctcgttatgggtnctgatgagcgctacagtccatctctgaagaccaggctcaccatcacgaccggacaaccccaaaaacnggtagactccgtgacactgaccaagttcgaccctgtcgacacgacgaccacgtattatgtcgcaacactaaaccngcccgtaggcgggactacttgactactgggaccagggacctggtcaccgtctcctacncgtccctaccgacccgaaggcccagttccggtaccttccccgtggtcccg

SEQ ID NO: 184096 - DNA, 603 bp, Homo sapiens
  misc_feature: GYAE6OF02F8VH8.34.78.H01.1.454.CMB.1.raw
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (387)..(387): a, c, t, g, unknown or other
  misc_feature (387)..(387): n is a, c, g, or t
  modified_base (454)..(454): a, c, t, g, unknown or other
  misc_feature (454)..(454): n is a, c, g, or t
  modified_base (594)..(594): a, c, t, g, unknown or other
  misc_feature (594)..(594): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctggggtccgtcacgcccccaggaaagggcctggagttcctagcgctcgtttatggggtgctgatgagcgctacagtccatctctgaagccaggctcaccatcacgacggaccaccccaaaacnggtnactccngacactcgaacctaagttcggaccctgtgacacacgccactattattgtgccacaaccctaaaaccncgcccgtgggaccgggtacttaccgtttgaaccttacggtcggggcccgtaacggggaccctggtacctacccggtcctcccgtcacggtccctacccgaacccgaacgggcccctaagtcccggttcccgttcccccgnggtcccccg

SEQ ID NO: 184097 - DNA, 740 bp, Homo sapiens
  misc_feature: GYAE6OF02I6JWW.34.78.H01.1.454.CMB.1.raw
  modified_base (263)..(263): a, c, t, g, unknown or other
  misc_feature (263)..(263): n is a, c, g, or t
  modified_base (331)..(331): a, c, t, g, unknown or other
  misc_feature (331)..(331): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccaggaaagggcctggagttcctagcgctcgttatggggtnctgatgagcgctacagtccatctctagaagaccaggctcaccatccacgacggaccaaccccaaaacnggtacgactcctgacactcgaaccgtaaagttcggaccctgtacggacacacgccaacctattattgtgaccaacctaacctaaaaccgcggtcccgtacgggtaccggggaacttaccgtttacgaaccttaaccggtcggggaccgaaccggggtaccccgttggttaccctacccggttcctcccgtacgtaaccggtccccttacccgaaacccggtaacggggtaccccctaacgttacccgggtttccccctttacccccggtcgggtccccgtaccccgttcgtccccgttaccccggaacgggtaccggccccgtaaaccccgttcccgggaagtacccggacccgaaccggtaccgggccccgggtccccggttcggggacccgttaccggtaccccggg

SEQ ID NO: 184098 - DNA, 391 bp, Homo sapiens
  misc_feature: GYAE6OF02ITQ0X.34.78.H01.1.454.CMB.1.raw
  modified_base (315)..(315): a, c, t, g, unknown or other
  misc_feature (315)..(315): n is a, c, g, or t
  modified_base (387)..(391): a, c, t, g, unknown or other
  misc_feature (387)..(391): n is a, c, g, or t
tcagtacacgtgatcacgaccggtgctcgatttagtgtgagtagtttgggtttggggtgctgatgagcgctacagtccatctctgaagaccaggctcaccatcacgacggacaccccccaaaaaccaggtgatcctgacactgaccaagttggaccctgtggacacagccacctattattgtgcacacctaaaaccagcccgtggcggggactactttgactactggggccaggggaccctggtcaccgtctcctcagcctccaccaaggcccatcggtcttcccctggcgccctgctccagagcacctccgagngcacagcggccctgggctgcctggcaaggactactccatcacgtgtactgagcgggctggcaagcgcatagnnnnn

SEQ ID NO: 184099 - DNA, 540 bp, Homo sapiens
  misc_feature: GYAE6OF02I0D9Y.34.78.H01.1.454.CMB.1.raw
  modified_base (335)..(335): a, c, t, g, unknown or other
  misc_feature (335)..(335): n is a, c, g, or t
  modified_base (438)..(438): a, c, t, g, unknown or other
  misc_feature (438)..(438): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttatgcaagctggtaccaacagaagccaggacaggcccctgaacttgtcatgttgtgaaacgagcgcctcagggatctctgaccgtatttcnggctccaggtccgaaacacggcttcctgaccatcacgtggggctcgtggcggaagatgaggctgactattattgctaagttcccgggacatcactggtaaccntctcgtcgttcggaggtcggaccaccgtctccgtctacgtcacgcccgaaggcccaacccgcgtcgtacaccttcgtcgttccccgcccttccgtactaccg

SEQ ID NO: 184100 - DNA, 594 bp, Homo sapiens
  misc_feature: GYAE6OF02F7ZNC.34.78.H01.1.454.CMB.1.raw
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacattttgcgctcaactgtcttgtcccagatcaccttgaaggagtctggtccgacgctggtgaaacccaaacagaccctcacgctgacctgcaccttctctggtttctcactcaccagtgaagaagaggctggtggccctgggtcccgtcacgcccccaggaaacgggcctggacgttcctagcgctcgtttattggggtgctgatgagcgctacagtccatctctgaagaccaggctcaccatcacgacggaccaaccccaaaacnggtacactccagaccacgtacgaccaagttcggaccctgtcgacacacgaccactattattgtcgcacacctaaaccncgccgtggcgggtacttacgttgactacgtcgggaccgacggggtccctggtccaccgtcctcctcgaccgtccctacccgaccgaaccgggccctaacggttcccggtaccccttcccccgtggtccccg

SEQ ID NO: 184101 - DNA, 339 bp, Homo sapiens
  misc_feature: GYAE6OF02IY4N1.34.78.H01.1.454.CMB.1.raw
  modified_base (336)..(339): a, c, t, g, unknown or other
  misc_feature (336)..(339): n is a, c, g, or t
tcagtacacgtgatcacgaccggtgctcgatttagtgtgagtagtttgggtttgggggaagaggaagactgacggtcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttccccctggcgccctgctccaggagcacctccgagagcacagcggccctgggctgcctggtcaaggactacttccatcacgtgtactgagcgggctggcaaggcgcatagnnnn

SEQ ID NO: 184102 - DNA, 416 bp, Homo sapiens
  misc_feature: GYAE6OF02HKQIU.34.78.H01.1.454.CMB.1.raw
  modified_base (406)..(416): a, c, t, g, unknown or other
  misc_feature (406)..(416): n is a, c, g, or t
tcagtacacgtgatcacgaccggtgctcgatttagtgtgagtagtttgggtttggggtgctgatgagcgctacagtccatctctgaagaccaggctcaccatcacgacggacacccccaaaaaccaggtgatcctgacactgaccaagttggaccctgtggacacagccacctattattgtgcacacctaaaaccagcccgtggcggggactactttgactactgggccaggggaccctggtcaccgtctcctcagcctccaccaagggcccatcggtccttcccctggccgccctgcctccgaggagccacctccgagacgcacaggccggccctgggcctcgcctgggtaccaaggtactactccatccacgtgtactgacgcgggctggcaaggcgcagtagnnnnnnnnnnn

SEQ ID NO: 184103 - DNA, 717 bp, Homo sapiens
  misc_feature: GYAE6OF02IHIJ9.34.78.H01.1.454.CMB.1.raw
  modified_base (318)..(318): a, c, t, g, unknown or other
  misc_feature (318)..(318): n is a, c, g, or t
  modified_base (334)..(334): a, c, t, g, unknown or other
  misc_feature (334)..(334): n is a, c, g, or t
  modified_base (706)..(706): a, c, t, g, unknown or other
  misc_feature (706)..(706): n is a, c, g, or t
tcagtacacgtgatcacgaccggtgctcgatttagtgtgagtagtttgggtttgggggggaagaggaagactgacggtcctgccacaggtggtgctgggcacggtgggcactcgacacaacatttgcgctcaactgtcttgtcccagatcaccttgaaggagtctggtccgacgctggtagaaacccaaacagaccctcacgctgacctgcaccttctctggtttctcactcacagtgaagagaggctgtggcctgggtccgtcacgcccccaaggaaacgggcctggacgttcctagcgcttcgttttagtggggtnctgatggagcgctacncgtccatctctaggaacgccaggctccacctataccgaccggaccggaacccaaaaccccccgaaaaacgagggtacgactcccgtaggaacctacgtacgtaaacctaacgggtttccggaaccccgttggtaaccggaccaacgaccgtaaccctaacctttatttacggttcgtacaccaaaccttaaaccccgaaaacgaccggtcccgggtagggacccgggttaacttaccgtttacggaccgttacggtccggggacccggtaaggggtccccttagggaccctaccgttccgtcccgtccgaaccgtccccaccgtaaacccggacccggtacctaccggttccccggtccctttacccccggnggtacccccgg

SEQ ID NO: 184104 - DNA, 211 bp, Homo sapiens
  misc_feature: GYAE6OF02HIWXC.34.78.H01.1.454.CMB.1.raw
  modified_base (175)..(175): a, c, t, g, unknown or other
  misc_feature (175)..(175): n is a, c, g, or t
  modified_base (182)..(211): a, c, t, g, unknown or other
  misc_feature (182)..(211): n is a, c, g, or t
tcagtacacgtgatcacgaccggtgctcgatttagtgtgagtagtttgggtttgggaacctatgaacattctgtagggaccaccgtctccgtcctaggtcagcccaaggccaaccccactgtcacgtctgttcccacctcctcatcacgtgtactgagcgggctggacaaggccnctatagnnnnnnnnnnnnnnnnnnnnnnnnnnnnnn

SEQ ID NO: 184105 - DNA, 679 bp, Homo sapiens
  misc_feature: GYAE6OF02HYN8K.34.78.H01.1.454.CMB.1.raw
  modified_base (262)..(262): a, c, t, g, unknown or other
  misc_feature (262)..(262): n is a, c, g, or t
  modified_base (285)..(285): a, c, t, g, unknown or other
  misc_feature (285)..(285): n is a, c, g, or t
  modified_base (334)..(334): a, c, t, g, unknown or other
  misc_feature (334)..(334): n is a, c, g, or t
  modified_base (430)..(430): a, c, t, g, unknown or other
  misc_feature (430)..(430): n is a, c, g, or t
  modified_base (536)..(536): a, c, t, g, unknown or other
  misc_feature (536)..(536): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagagaggctgtggcctgggtccgtcacgcccccaggaaagggcctggagttcctagcgctcgtttatgggtnctgatgagcgctacagtccatcnctgaagaccaggctacaccatcgacgaccggacaaccccccgaaaaacnggtgactcctgaaccactggaaccaagtttcggaccctagtggaacacacggaccctaacctatttagttcgtacgacaaccgaacctaaaacccncggtacccggtgggaccgggggtacttaaccgttttggaaccttacgtcgggggtcccgaacgggggtacccgttcgggtttaccgaacccggttcttaccccgtnaaccgcccctaccgaacccgaacggggccctaacgtcccggttacctttcccccgcgggccgaccccttcgaccttcccgagggtccaaccgtccgtaccggacgacgccaacgcggaccgccccggtggccggacgtcccgg

SEQ ID NO: 184106 - DNA, 582 bp, Homo sapiens
  misc_feature: GYAE6OF02HEV7O.34.78.H01.1.454.CMB.1.raw
  modified_base (401)..(401): a, c, t, g, unknown or other
  misc_feature (401)..(401): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttcgtctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcaccgacggaccaacccccaaaaaccaggtgatcctgacactgaccaagttggaccctgtgacacagccactattatgtgcacacctaaaccncgcccgtggcgggactacgtttgacttacgtggggccgacgggcccgtggtcaccgtctcctcacgccctccgaccacgggcccacgtccggtccttcccccgtgggccgcccgtcgccgtccgaggcgccgtacctccggacgacgccgacgacggccggcccgtcgggcgtcgtcccgg

SEQ ID NO: 184107 - DNA, 759 bp, Homo sapiens
  misc_feature: GYAE6OF02ITVDE.34.78.H01.1.454.CMB.1.raw
  modified_base (141)..(141): a, c, t, g, unknown or other
  misc_feature (141)..(141): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (351)..(351): a, c, t, g, unknown or other
  misc_feature (351)..(351): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaanagaccctcacgctgacctgcaccttctctggtttctcactcaccagtgaagaagaggctgtggcctgggtcccgtcacgcccccagggaaagggcctggagtttcctagcgcttcgtttattggggtnctgatgagcgctacngtccatctactgaacgaccaggctaccaacccagtccaccggacggaacccaacccccgaaaaaccnggtacgactcctagacactcgaccgtaagttcggaccctgacgacacacgacctaccttatttagttcgcgacaacctaacccctaaaaacgcggtacccgggtcggggtacccgggggtaactttaccgtttacggtaaccgttacggtacgggggggcccgtacgggggtaccccttggggtaccctacccgggttcccttacccgttccctacggaccccttacccgaaccgtaacccggggccctacggttcccggttccctttaccccccggtcgggtacccggtaccccgtccggaccttacccgggaacgggtaccggcccctaacccgtccgggaaccgacggtaacccaccggacccgggtcccggacccccgtcgggggtaccctcggttaccccggg

SEQ ID NO: 184108 - DNA, 633 bp, Homo sapiens
  misc_feature: GYAE6OF02H08Z3.34.78.H01.1.454.CMB.1.raw
  modified_base (177)..(177): a, c, t, g, unknown or other
  misc_feature (177)..(177): n is a, c, g, or t
  modified_base (310)..(310): a, c, t, g, unknown or other
  misc_feature (310)..(310): n is a, c, g, or t
  modified_base (361)..(361): a, c, t, g, unknown or other
  misc_feature (361)..(361): n is a, c, g, or t
tcagtacacgtgatcacgaccggtgctcgatttagtgtgagtagtttgggtttggggctgggagaggagcccagcactagaggtcggcggtgtttccattcggtgatcagcactgaacacagaggactcaccatggagtttgggctgagctgggttttcctcgttgctcttttaagnggtgtccagtgtcaggtgcagctggtggagtcgtggggggagcgtggcccagcctgggactccctggacgactctcctgtgcagcgtctggattccaccttcagttagtcattcggcatcgcactggggtccncgaggcctccgaggcgaaggggcgtgggtaggtggggtggacaggtttaanagttggtatgagtaggaagttagactaagtactatcgacgaggtacctttcggaggaagggccctattaccgacccgttactaccgaggaaccgaactaaaccgtacccgaaagaaccacggtctacgtacttacgtacgactaaacgtacgaacccagtacctacgggaacgtacggacccggaagggtacccgaacgggtacttaagttacgttaacttcggaggttacggacggtaaggaacggaacgtaccgacgtacccgtaaccgg

SEQ ID NO: 184109 - DNA, 807 bp, Homo sapiens
  misc_feature: GYAE6OF02H29A2.34.78.H01.1.454.CMB.1.raw
  modified_base (254)..(254): a, c, t, g, unknown or other
  misc_feature (254)..(254): n is a, c, g, or t
tcagtacacgtgatcacgaccggtgctcgatttagtgtgagtagtttgggtttggggagctgtgggctcagaagcagagttctggggtgtctccaccatggcctggacccctctctggctcactctctcactcttgcataggttctggtagtttcttctgagctgactcacggtacccgttgtgtctgtggccttgggacacacagtcacgatcacatgccgagggacacgacggtcctacgtaaaaccttttntacgacgaagtcgttacggtaaccaaacgaacggaacgacccgaagggaaccgaccgggtacccccgtaggttaaccttaggttacctagtttgggttttacggtaaacgggtaaaaacggcggtacccggtcccctacggtaaacggggtcttaccgtcgttaccggtaaccgttacgtttttcgcggttcccgtaccggtaccgggtaacccggaaaccgtccggttacccttacccgtacgtacctagtaccgtaaccgggtcgggtccgttacggtaccgggacgggtaaagtcgtaacgggtacggtcgttaacgggttaactttagttacgttccgtaaccgttaaaccggtttcccgggaaacttactacggttaacgtaaccggtaaccctagttcccgttacggtccggtttacgggacggttccggacccgttaccgtccgttaccgtacgttacgaccgtaccgaccgtaaccggacccctacctaacggtccttacctacccgttaccgtaccccgttcccctaccgttccgtacctaccg

SEQ ID NO: 184110 - DNA, 659 bp, Homo sapiens
  misc_feature: GYAE6OF02JF852.34.78.H01.1.454.CMB.1.raw
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagagagctgtggcctgggtccgtcacgcccccgaaggaaacgggtcctgggacgttcctaggcgtcttcggtttagttggggtgcgtgtagtgagcgctacacgtccatctctgaacgacagctcaccatcacgaccgaccaaccccaaaacgngtcgactccngacacgtgaaccagttcggaccctggtgaacacgacgacctaccttattattgtcgacaacctaaacccgtaaaacccacggacccgggtgggtaccggggtaaccttacgtttacgaccgttacggtcggggcccgaacggggtcccgttcgggtacctaccgtccgttcccgtaccgaccggtccctaccccgaacccggaaccgggtacccctacggttaccccggttcccgtttaccccccggtggtcccccgg

SEQ ID NO: 184111 - DNA, 776 bp, Homo sapiens
  misc_feature: GYAE6OF02GTE3R.34.78.H01.1.454.CMB.1.raw
  modified_base (358)..(358): a, c, t, g, unknown or other
  misc_feature (358)..(358): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctgtggcctgggtcctcgacgcccccgaggaaagggcctggacgttcctagcgcttcggtttagttggggtcgctgacgtgagcgctacgagtccactctctacgacgaccnggctacaccatccaacggaccggaacccaaacccccaaaaacgtacggtacgaactacccgtagacctaccgtacgaccgtaacggttaccggacccgtcggtacggaaccgaccgacggaccctaaccttagtttaacgttacgttcgacctaaccgtaaaccctaaaacccgaccggtacccggttacgggtaaccgggggtaccttaaccgttttacggacccgtttaaccgggtccggggtacccggtaaccgggggtaccccggttcgggtacccgtaccccggttcccgtaccccgttaccgacccggtaaccccgtttacccccgaaaccccggtaacccggggttacccccgtacccggtttaccccgggtttaccccgttttccccccgggtccggttacccccccggg

SEQ ID NO: 184112 - DNA, 746 bp, Homo sapiens
  misc_feature: GYAE6OF02GF6BD.34.78.H01.1.454.CMB.1.raw
  modified_base (390)..(390): a, c, t, g, unknown or other
  misc_feature (390)..(390): n is a, c, g, or t
tcagtacacgtgatcacgaccggtgctcgatttagtgtgagtagtttgggtttgggggggaagaggaagactgacggtcctgccacaggtggtgctgggcacggtgggcactcgacacaacatttgcgctcaactgtcttgtcccagatcaccttgaaggagtctggtccgacgctggtgaaacccaaacagaccctcacgctgacctgcaccttctctggtttctcactcaccagtgaagaagaggctggtggcctgggtcctcacgcccccagggaaagggcctggagttcctagcgcttcggtttagttgggggtgctggatggagcgctacagtccatctctagaagaccaggctcaccatcacgacggacccaaccccaaaaacnggtagactcctagaccactacgaacctaacggttccggaccctggtacgggaacctaacgacgaccctaaccttatttaacgttcgtacgtaccaaccctaaacccgtaaaaacccgaccgggtaaccccggtacggggacccgggggttaaccttaacccgttttacggtaacccgttaccgggtccggggggtaaccctaaccgggggggtaacccccgttgggttaccccgtaacccggttccctcccggttacccgaacccggtccccttaccccgaacccggtaacccggggtccccctaaccggtttcccgggtacccccgttttccccccggaccgggttaccccccgg

SEQ ID NO: 184113 - DNA, 815 bp, Homo sapiens
  misc_feature: GYAE6OF02GVX8Y.34.78.H01.1.454.CMB.1.raw
  modified_base (365)..(365): a, c, t, g, unknown or other
  misc_feature (365)..(365): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggttctcactcaccagtgaagaagaggctgtggcctgggtccgtcacgcccccgaggaaacgggcctaggagttccgtagcgtcttcgtttagtgggtgctagatgacgcgactacagtcctaatcttacgtagaacgtaccaggcctacacctactaccgaacgaaccggaaccccaaacccccgaaaaaacgnggtacgaacttcccgtacgaaccactacgaaccgtaagttcggaaccctggtacgtaaccgacaacggccctaaaccgttaattacgttacgtacgacaaaccgaaaccccttaaaaccgaccgtcccgggtaggggtaccgggtaacctttaaccgtttaggaacccgttaacgggtacggggacccgtaaccggggtacccttacgggttacccgtaaccccggttccgtacccgtacccgaccggtaccccttacccgaacccggtaaaacccggtcccgtaacgttccccggttacccctttcccccggtcggacccggttcccttaccggcccttacccggaaccgggtacgtccccgtaaccccggttaccggaaccggtaaccgacccgtaaccggtccggtaccccggggtccccgtaccggggttacctacccggttccgg

SEQ ID NO: 184114 - DNA, 779 bp, Homo sapiens
  misc_feature: GYAE6OF02G6A4A.34.78.H01.1.454.CMB.1.raw
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtacgaaacccaaacacgaccctcacgctgacctgcaccttctcgtcgtttctcactcacagtagaagaagacggctgtcggccgtgggtccgtcgccgaccccgaaggaaacggccgtggtacgttccgtacgcgtcgttcggtttacggttggggtcgtcgttggaagttcggacgccggtactaaccgtacgttccaactcgtaccgtacggaaccgacgtacgggtacctaaccgacacgtacaacccggtaaccggaacccctaaaaccccgaaaaacgacggtacgacttacccgtacggaactacctaccgtaaccgtaacggttaccggtaacccgttacgggtaacgaccgaacgtacccggacctaaaccgttacttacgttcgtacgtaccaaccgtaaaccctaaaccgtaccggaccgggtaccgggtaaccggttaccgttacgtttaccggtaaccgttacgggtacccgggacgtaccggggtaccttccggtaccgtacccgtccgtcccgtaccgaccacccgttacccaaccggtacccggccgtaaccggttcccggttaccccgtcccggtaccgtccccgg

SEQ ID NO: 184115 - DNA, 887 bp, Homo sapiens
  misc_feature: GYAE6OF02HYN94.34.78.H01.1.454.CMB.1.raw
  modified_base (253)..(253): a, c, t, g, unknown or other
  misc_feature (253)..(253): n is a, c, g, or t
tcagtacacgtgatcacgaccggtgctcgatttagtgtgagtagtttgggtttgggggaagaggaagactgacggtcctgccacaggtggtgctgggcacggtgggcactcgacacaacatttgcgctcaactgtcttgtcccagatcaccttgaaggagtctggtccgacgcttgggtcaaaacccaaacagacccctcacggctggacctgccaccttctcgtggtttcctcactcaccagtcgaagaagnggtctggtcggaccgttcggggtccctcgaccggaccccccgaagggaaacgggtcccgtacgggtacgtttacccgtaggccgtccgttcggttttaacgttcggggggttcgtaccgttaggtacgtcggtaacggccggtaccttaacgtaccgtacccgtacgttcctaccgttacggaaaccgtaccggtaacgggtcctaccgtaaaccctacgttacccggtaaccgtaacccgggtaaccccaaaaaccccccgtaaaaacggtacggtaaccgtaaccgttacccgtacgaaccgtaaccgtaccgtaaccgtaacgggtttccggaccccgttacggtaccggaaccgtaaccgacgtaccctaacgtttaacgttacgttaccggtacgtaacccgtaaaccgtaaacccgttaaaacccgccgggtaccccggttacggggtacccgggttaaccttaccgtttaccggtaaccggttacgggtcccgggggtacccgaaccggggtacccgttaccgggtaccccgtaccggttacccgtcccgtaccgaccgttcccgaacccgtacccgtaccgggacccctcgttaccccggtcccgttcccccgtacggtcccccgg

SEQ ID NO: 184116 - DNA, 625 bp, Homo sapiens
  misc_feature: GYAE6OF02GI99B.34.78.H01.1.454.CMB.1.raw
  modified_base (287)..(287): a, c, t, g, unknown or other
  misc_feature (287)..(287): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (395)..(395): a, c, t, g, unknown or other
  misc_feature (395)..(395): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctggtggccgtgggtccgtcacgccccccagggaaagggcctgggagttcctagcgcttcgtttagttggggtgctgatgagcgctacngtccatctctgaacgcgagctcaccatcgacgacgaccaaccccaaaacgngtnactcctgacactagaccaggttcgaccctgtcgacacacgcctaactattatgngccacaacctaaacacgtccggtcggacgggtactacgttcgacgtacgtcggggccgacgggacccgttcggtaccaccgtccgtcctacgtacgcccgtaccacccgacggacccacgttccggtcccttccccgtcggcccgtccgtacgtcgttccgaggaccgtcctacccgttcgaacgcgaccaccgaccggtcccgacccggtacgggtccctaggtcccgg

SEQ ID NO: 184117 - DNA, 889 bp, Homo sapiens
  misc_feature: GYAE6OF02G90AM.34.78.H01.1.454.CMB.1.raw
  modified_base (800)..(800): a, c, t, g, unknown or other
  misc_feature (800)..(800): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacacgacctcacgctgacctgcaccttctctggtttctcactcaccagtgaagaagagctggtcggccgtgggtccgtcacgccccgagggaaacggcctggacgttcctagccgtctcgtttagttgggtcgctagagtcgacggtcgactacgtacgtaccaattccgtatacggaaacgacccgagggtccctaaccaacctagtaacccgaccggaaacccgggaaacccccaaaacccccgaaaaaaccgtaggggttaccaacgttaccccggtacaaccgtaacctaacggaacccgtaacggttaccgggaaccccgttggaaccggaacctaacgtaaccggaccctaaaccctttaagtttaacggttcgttaaccggaccaaaccccgtaaaacccgttaaaaaccccgcggtaccccgggtacggggtacccggggtaaacctttaacgttttaccggaaaccgttacgggtccgggggtaccgtaacccgggggtacccctacgggttaccctaccggttcccgtacccgttccgaacccgtccccgtaaccccgttaaaccgggaaccgggttaccccgtaacccggttccggtttaacccccctttcccccgggtaccggtccccgttccccgtacggttaccccnccggtaacgggtccctacccgtaaccgtaccggggacacccggcctaaccggccggtcccggtcccggtacgggtcctacggtccccgg

SEQ ID NO: 184118 - DNA, 735 bp, Homo sapiens
  misc_feature: GYAE6OF02FRQKH.34.78.H01.1.454.CMB.1.raw
  modified_base (254)..(254): a, c, t, g, unknown or other
  misc_feature (254)..(254): n is a, c, g, or t
  modified_base (556)..(556): a, c, t, g, unknown or other
  misc_feature (556)..(556): n is a, c, g, or t
tcagtacacgtgatcacgaccggtgctcgatttagtgtgagtagtttgggtttgggggagctgtgggctcagaagcagagttctggggtgtctccaccatggcctggacccctctctggctcactctcctcactctttgcataggttctggagtttcttctgagctgactcacggaccccgttgtgtctgtggccttgggacacacagtcacgatcacatgaccgagggagacagcctacgtaaaccttttagngacgaagtccgtaggtaaccaacgaagaacgaccgaaggaacgaccggaccccctaggaaacctttcgtactagtttcggtttaggtaacggaaaaacggacggccggtccctacggagggtacttcgtacgtcggtaccgttactttcgtcggccttaccggacgggtacccggaaaccgtaccgggtccctttacccgacgaaccctagtaccgtacggtcgggtcctcggtcgggacggtaaagtcgtaggaggtacgtagtaacgtttagttactgtacttaaccggttacccggaancttacgtacgttacggaacttacgttcccgtgttccggtacgggtaggtaccgtaaccggtccgtacccgttccggtccgttacggtaccaccggtacccgtaaccggacccctaaacccgcgtaccgtttccgaaccgtttcccgttaccctaccccctacccgttcctacctaccgg

SEQ ID NO: 184119 - DNA, 791 bp, Homo sapiens
  misc_feature: GYAE6OF02HI8KQ.34.78.H01.1.454.CMB.1.raw
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtcgaaacccaaacagaccctcacgctgaccctgccaccttctcttcggtttcctcactcaccagtagaagaaggacggctggtcggcctgggtccgtcacgcccccgaagggaaacggccgtgggacgttcctagcgtcgttcgtttagttggggtgtcgtggactggacgcgtactacacgtcctactctcgtaggaacgtaccgagcctacacgactaccgaaccgaaccggaaaccccaaacccccaaaacgtacgggtacaccgtacctacgaacctaccgtacgaacccgtacggtttccggtaacccgtaggtacggaccgtaaccgtacgtaccctaaccgttactttagttacggtaccgtacccttaaaccgaaacccctaaaaccggtaccgggcccgggtaaccggggtaccggggttactttaaccggttttaacgtacccgttaaaccggttccggggggacccgtaaccgggggttaccccgttggtacccgtacccggtttcccgtcccgtaccgtaccgtaccccgttaccccgaaccggtaccggtcccgttaacccggttccccggttaccccggtttccccggtcggttcccccg

SEQ ID NO: 184120 - DNA, 348 bp, Homo sapiens
  misc_feature: GYAE6OF02FWR9L.34.78.H01.1.454.CMB.1.raw
  modified_base (337)..(348): a, c, t, g, unknown or other
  misc_feature (337)..(348): n is a, c, g, or t
tcagtacacgtgatcacgaccggtgctcgatttagtgtgagtagtttgggtttggggggaagaggaagactgacggtcctgacactgaccaagttggaccctgtggacacagccacctattattgtgcacacctaaaaccagcccgtggcggggactactttgactactggggccagggggaccctggtcaccgtctcctcagcctccaccaagggcccatcggtcttcccctggcgccctgctccaggagcacctccgagagcacagcggccctgggctgcctggtcaaggactacttccatcacgttgtactgagcgggctggcaaggcgcatgnnnnnnnnnnnn

SEQ ID NO: 184121 - DNA, 761 bp, Homo sapiens
  misc_feature: GYAE6OF02GMPO8.34.78.H01.1.454.CMB.1.raw
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagtacacgtgatcacgaccggtgctcgatttagtgtgagtagtttgggtttgggtttcaccagcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaggcctggagttccagcgctcgttattggggtgctgatgagcgctacaggtccatctctgaagaccaggctcacatcacgacgacaaccccaaaacnggtgatccngacactgaccaagttcgaccctgtcggacacgacgccctaaccttattacttgtgaccctaacgtaaacccttaaaaaccgacggtaccccggttacggggacccgggggtaccgttaacgttttcggaaaccgttaccggtacggggggacccggaaccggggggtacccgttacggggtaccgtaaccccggttccgttaccccggttccgaccggtaccccgttacccgaaaccccggtaaccgggggtaccccctaacgggttccccgggttacccgtttaccccccggtaccgggccccgttaccccgtaccgtcccgttacccgacgggtaaccgcccgtaacccgtcccggaacggtaccgaccgtaaccgaccgggtaccccgggtcccgggtccggggtaccgttccgggtaaccccgg

SEQ ID NO: 184122 - DNA, 669 bp, Homo sapiens
  misc_feature: GYAE6OF02GB084.34.78.H01.1.454.CMB.1.raw
tcagtacacgtgatcacgaccggtgctcgatttagtgtgagtagtttgggtttgggggggaagaggaagactgacggtcctgccacaggtggtgctgggcacggtgggcactcgacacaacatttgcgctcaactgtcttgtcccagatcaccttgaaggagtctgggtccgacgctggtgaaacccaaacagaccctcacgctgacctgcaccttctctggtttctcactcacagtgaagagaggctgaggcctgggtcctcacgccccgaggaaagggcctggacgttcctacgccgctcggtttattggggtgcgtggatgagcgctacgacgtccatctctcggaaagaccgaggctccgactactccgaacggaccggtaacccaaaacccccgaaaaacgtgggtacactccctacgaaccacgtacgaacccgtaaaggttacggacccctggtacggacctaacgacgtaccaaccttagttactttagcgtacaaccaaaccctaaaaccgacgcccggtagggcccgggtacgttaccttggacttaacggtcgggaccggaacgggtcccgtggtaccaccgtccgtacctcgaccgtacccgtaccgaaccgaccggtacccacgtttacccgggtcccttccccggtacggtcccg

SEQ ID NO: 184123 - DNA, 761 bp, Homo sapiens
  misc_feature: GYAE6OF02IVWUN.34.78.H01.1.454.CMB.1.raw
  modified_base (556)..(556): a, c, t, g, unknown or other
  misc_feature (556)..(556): n is a, c, g, or t
tcagtacacgtgatcacgaccggtgctcgatttagtgtgagtagtttgggtttggggggaagaggaagactgacggtcctgccacaggtggtgctgggcacggtgggcactcgacacaacatttgcgctcaactgtcttgtcccagatcaccttgaaggagtctggtccgacgctggtcgaaacccaacagaccctcacgctgacctgctaccttctctggtttctcactcaccagtgaagaagaggctggtcggccgtgggtccgtcgacgacccccgagggaaacgggcctacggtacgttcctaggccgtccgttcgtttaggttggggtcgtcgtgacgtgacggccgctacgacgtcccagtcttctcgaacgaccgagccgtaccacctataccgaccgaaccggaccccaaacccccgaaaaccgaggtacgacgttccgacgaaccgactaccgaacccgtaacggttcggaccgtacgggacgtaaccacgacgaccctaacccttagtttacgttcgtacgaccctaaccgtaaaccctaaacccncggtaccccgggtaggggtacccggggttacgtttacgtttacggaacccgttaccgggtaccggggtcccggtaaccggggtcccgttcgggtaccctacccggttcccgtccgttacccgaccggtccccgtacccgtaacccggaacccgggtaccctaccggttccccggttacccccgttccccgtaccgggtccccccg

SEQ ID NO: 184124 - DNA, 704 bp, Homo sapiens
  misc_feature: GYAE6OF02H3FDR.34.78.H01.1.454.CMB.1.raw
  modified_base (116)..(116): a, c, t, g, unknown or other
  misc_feature (116)..(116): n is a, c, g, or t
  modified_base (159)..(159): a, c, t, g, unknown or other
  misc_feature (159)..(159): n is a, c, g, or t
  modified_base (177)..(177): a, c, t, g, unknown or other
  misc_feature (177)..(177): n is a, c, g, or t
  modified_base (188)..(188): a, c, t, g, unknown or other
  misc_feature (188)..(188): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (327)..(328): a, c, t, g, unknown or other
  misc_feature (327)..(328): n is a, c, g, or t
  modified_base (375)..(375): a, c, t, g, unknown or other
  misc_feature (375)..(375): n is a, c, g, or t
tcagtacacgtgatcacgaccggtgctcgatttagtgtgagtagtttgggtttggggggaagaggaagactgacggtcctgccagaggtgtgctgggcacggtgggcactcgacanaaacatttgcgctcaactgtcttgtcccagatcaccttgaagngtctggtccgagctggtnaaaacccaaanaacgcccttcacgctcgacctgcacctttctcttggtttccncactcgacaaggtgaagaaagngtctagtcggcctcgggtccacacgccccgaggaaacggccgtaggtactcctagcgtctcgtttagttggggtnntgagttgagcgtctacacgtccatactcgtagaacgcgaagtcaccnctaacgcaacgaccggaaacccaaaccccgaaaaaacgtccggtagaacctaccgtacgacgtaacgttacgaaccgtaacgttacgggtaccccgtagtacgggaacaccgaacgaccttaaccttagttaactgtacgaccaacgttaaaccaaacgtcgaccggtcggacggtactaccttacggacttacgtcgggccggaaccggtacccgtcggttaaccgccgtttcccggacctacgtaccggtaccccttacccggaacccggaaccgggtcccctaaaccggttcccgtttccccgttacccccggtcgtaacccccgg

SEQ ID NO: 184125 - DNA, 381 bp, Homo sapiens
  misc_feature: GYAE6OF02I8MBF.34.78.H01.1.454.CMB.1.raw
  modified_base (312)..(312): a, c, t, g, unknown or other
  misc_feature (312)..(312): n is a, c, g, or t
  modified_base (336)..(336): a, c, t, g, unknown or other
  misc_feature (336)..(336): n is a, c, g, or t
  modified_base (341)..(381): a, c, t, g, unknown or other
  misc_feature (341)..(381): n is a, c, g, or t
tcagtacacgtgatcacgaccggtgctcgatttagtgtgagtagtttgggtttggggggaagaggaagactgacggtcctgacactgaccaagttggacccctgtggacacagccacctattattgtgcacacctaaaaccagcccgtggcggggactactttgactactgggggccaggggaaccctggtcaccgtctcctcagcctccaccaagggcccatcggtcttccccctggcaccctcctccaagagccacctctgggggcacagcggccctgggctgcctgtcaaggactacgttcatcacgtntactgagcgggctggcaaggcganatagnnnnnnnnnnnnnnnnnnnnnnnnnnnnnnnnnnnnnnnnn

SEQ ID NO: 184126 - DNA, 530 bp, Homo sapiens
  misc_feature: GYAE6OF01AF77W.40.80.H03.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttanctccaggggaaangccatcctctcctgcagggccagtcagaatattgatacatacttagcctggtaccagcagaacctggcctggctccagggtcctcatccatgatgcctcccacagggccactggcactccccacacaggttcagtggcagtgggtctgggacagacttcagtctcaccatcagcagcctagagcctgaggtatttgactaatttatttctgtacaacagtctagctaccgtcggtccccgggtctaccgttccggacctaacgggaccacgactggaccagtacgaaacgtacgtggtcggctagcctaccatctcgtccttcgtac

SEQ ID NO: 184127 - DNA, 603 bp, Homo sapiens
  misc_feature: GYAE6OF01EEF0D.40.80.H03.1.454.CMB.1.raw
  modified_base (203)..(203): a, c, t, g, unknown or other
  misc_feature (203)..(203): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaangccatcctctcctgcagggccagtcagaatattgatacatacttagcctggtaccagcagaaacctggcctggcctccgagggtcctcatccatgatcgccctcccacgacgggccacgtcggccactaccccactacgacggttcaggtcggcagggtgggtcgtagggacagtacttcacgtcctacacctatcagcagcctagacgccgtggaggttattttgacttaattttactttcgtacgtacaacgtacggtacgtacgaccgtaccggtccgggtcccccgggtaccgtacccggttccgggacccgaacgggaccaacggacgtaggactaagtacggaaacgtacgtcggtcgcgtacgacctacctacttcttcgttccttctacccg

SEQ ID NO: 184128 - DNA, 555 bp, Homo sapiens
  misc_feature: GYAE6OF01ADUM3.40.80.H03.1.454.CMB.1.raw
  modified_base (204)..(204): a, c, t, g, unknown or other
  misc_feature (204)..(204): n is a, c, g, or t
  modified_base (394)..(394): a, c, t, g, unknown or other
  misc_feature (394)..(394): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccgaggggaaangccatcctctcctgcagggccagtcagaatattgatacatacttagcctggtaccagcagaaacctggcctggctccagggtcctcatccatgatgcctcccacagggccactggcactcccacacaggttccagtggctaggtgggtctggggacagtacttcgagtctcaccatcagcagcctagacnccgtagaggttatttgacttaattttatttctgtacaacgtgtacgtacgcctaccgtcgggccccgggttctacccgttccgggccgaacgggaccacggactgggacagtacgaaccgacgtggtcggctagacctacactcgtcgttccttcgtaccc

SEQ ID NO: 184129 - DNA, 618 bp, Homo sapiens
  misc_feature: GYAE6OF01BQLF8.40.80.H03.1.454.CMB.1.raw
  modified_base (204)..(204): a, c, t, g, unknown or other
  misc_feature (204)..(204): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccgaggggaaangccatcctctcctgcaggccagtcagaatattgatacatactagcctggtaccagcagaaacctggacctggcctcccgagggtcctcactccatgactcgccctacccgacgacgggcccacgtcggcactccccacacgacggttacaggtggcgtaggtcgggtctgggacagtactcgagtctcacatcacgcgacgacctagacgtcctaggaaggttacttttagactttaattttactttcgtgtactaacgtggtacgtacgccgaccgtaccgggtccccggtacctaacccggttccggacccgtaacgggacccgtaacggtacgtacggaacgtacgtaacggaaaccggtacttggtacggtcgtacgacccgtactacttcgtacgttccttcgtacccg

SEQ ID NO: 184130 - DNA, 525 bp, Homo sapiens
  misc_feature: GYAE6OF02HRTH6.40.80.H03.1.454.CMB.1.raw
  modified_base (202)..(202): a, c, t, g, unknown or other
  misc_feature (202)..(202): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctccagataccgccggagaaattgtgttgacacagtctccagccaccctgtctttatctccaggggaaangccatcctctcctgcagggccagtcagaatattgatacatacttagcctggtaccagcagaaacctggcctggctccgagggtcctcatccatgatgcctccacagggccatgcatcccacacaggttcagtcggcaggtgggtctgggacagacttcgagtctcaccatcagcagcctagacgcctgagtatttgactaatttattctagtacaactagtcgtagctaccgtcggccccggtcaccgttcggaccgaacgggacaacgactcggacagtacgaaacgactggtacgctgacaccatcgtcgtccttactacc

SEQ ID NO: 184131 - DNA, 545 bp, Homo sapiens
  misc_feature: GYAE6OF02FQJ4O.40.80.H03.1.454.CMB.1.raw
  modified_base (190)..(190): a, c, t, g, unknown or other
  misc_feature (190)..(190): n is a, c, g, or t
  modified_base (203)..(203): a, c, t, g, unknown or other
  misc_feature (203)..(203): n is a, c, g, or t
  modified_base (424)..(424): a, c, t, g, unknown or other
  misc_feature (424)..(424): n is a, c, g, or t
  modified_base (437)..(437): a, c, t, g, unknown or other
  misc_feature (437)..(437): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttanctccaggggaaangccatcctctcctgcagggccagtcagaatattgatacatacttagcctggtaccagcagaacctggcctggcctcccgagggtcctcatccatgatcgccctcccacgacgggccacgtcggcactccccacacaggttcaggtcggctaggtcgggtctggggacaggtacttcgagtctcaccatcgagcagcctagcgctgagtatttgctaatttnttctgtacaacgngtcgtagctaccgtcgggtccccggtctacccgttcggaccaacgggaccacgacgtggacagtacggaaacgactggtcggctgaccaccgtatctcgtcttctacc

SEQ ID NO: 184132 - DNA, 554 bp, Homo sapiens
  misc_feature: GYAE6OF02GDFCH.40.80.H03.1.454.CMB.1.raw
  modified_base (202)..(202): a, c, t, g, unknown or other
  misc_feature (202)..(202): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaangccatcctctcctgcagggccagtcagaatattgatacatacttagcctggtaccagcagaaacctggcctggctccagggtcctcatccatgatcgccctcccacacgggccacgtggccatccccacacaggttcagtggcaggtgggtctgggacagacttcagtctcacatcagcagcctagacgcctgagtatttgactaattttatttctagttcaactagcgtacgctaccgtcggccccgggtctaccgttccggaccgaacgggaccacgtacgtacggactacgtacggaaaccgtaacgtcggtcggcgtacggaccaccagttcgtcgttaccttctacc

SEQ ID NO: 184133 - DNA, 697 bp, Homo sapiens
  misc_feature: GYAE6OF02I0036.40.80.H03.1.454.CMB.1.raw
  modified_base (205)..(205): a, c, t, g, unknown or other
  misc_feature (205)..(205): n is a, c, g, or t
  modified_base (321)..(321): a, c, t, g, unknown or other
  misc_feature (321)..(321): n is a, c, g, or t
  modified_base (362)..(362): a, c, t, g, unknown or other
  misc_feature (362)..(362): n is a, c, g, or t
  modified_base (384)..(384): a, c, t, g, unknown or other
  misc_feature (384)..(384): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (511)..(511): a, c, t, g, unknown or other
  misc_feature (511)..(511): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccgaggggaaagngccatcctctcctgcgagggccagtcagaatattgatacatacttagcctaggtaccagtcaacgaaacctggccgtacggcctcccgtacgggtcctcactccatgactcgcccnccacgaccggcacgtcggaccactacccacacgtaggtacnggtcggcgtaggttcgggtcgngggactacgtactacgngtccgtacaccgtntaccgagccgtacgtactaacggacgtccgtagggtacgttagtttcgaactttaaattttacgtttctacggttaaccaacgtagtaccggtacncccgtaaccggtccgggttacccccggtaccgttaacccggttaccgggtaacccgtaaacgggggaccctaacgggtaccgtacgggttaccctaaggtaacgtaaacccgggtaacgttcgggtaccgggtacgttacgcccgttaacgttccggttaacgttcggtttaccttccgttacccg

SEQ ID NO: 184134 - DNA, 798 bp, Homo sapiens
  misc_feature: GYAE6OF02HYWNT.40.80.H03.1.454.CMB.1.raw
  modified_base (152)..(152): a, c, t, g, unknown or other
  misc_feature (152)..(152): n is a, c, g, or t
  modified_base (166)..(166): a, c, t, g, unknown or other
  misc_feature (166)..(166): n is a, c, g, or t
  modified_base (369)..(369): a, c, t, g, unknown or other
  misc_feature (369)..(369): n is a, c, g, or t
tcagtctagcgactcacgaccggtgctcgatttagctgtgcgtcgaagggaaagggggaggaactgctcagttaggacccagagggaaccatggaagccccagctcagcttctcttcctcctgcctactctggcctccagataccgccgganaaattgtgttgacncagtctccagccacctgtctttatctccgagggaaagacgcctactcctactcctgcgacgggccagtcagaattatacgtataactattaccttacggcccttagggtaccacgtcaaacgaaaccgtcggacctcggacctcccgacgggttcctctactccatgactcgccctaccgacgaccggccacgtcgacctacnccgacgacgtcgtacaggtcgactagggtgggtacgacgggtaacgacgttacgttcgacgttacctacacctaacaccgtaacgccgtaacggtacccgtaacgtaccgtacgttaaggtacggtttacgttttacgtaaccttttatttttacctttcgttaccgtaaaccgttaaccggtacggttaccggtaacccgtaacccggtttaacccggttccccggggttaacccccggttacgttaccccgggttaacccgggaacccgggtaacccgggtaactaaacccggggttaccggtaaccggtacgttaaccgggttaaacgtaaacccggttacgggttacggggtacccggcgtttaacccggacccttaaccggttccttacggtttacccgttttaccgttacctttaacccccgg

SEQ ID NO: 184135 - DNA, 639 bp, Homo sapiens
  misc_feature: GYAE6OF01C00WG.4.11.A11.1.454.CMB.1.raw
  modified_base (82)..(82): a, c, t, g, unknown or other
  misc_feature (82)..(82): n is a, c, g, or t
  modified_base (624)..(624): a, c, t, g, unknown or other
  misc_feature (624)..(624): n is a, c, g, or t
  modified_base (630)..(639): a, c, t, g, unknown or other
  misc_feature (630)..(639): n is a, c, g, or t
tcagagcactgtagcacgaccggtgctcgatttagctacgactgcaaagggaaagggaggcaccttcagtacgtttgatatnaattgggtgcgacaggcccctggacaagggcttgagtggatgggaaggatccacccctaccctgcctatggacaaaacaatgacacaagaagttccgagggcagactcaactaattacccggcggaacaagtccaaagcgcacagacgtacagtaggaactggaggacgcctgaagattcgagaacgaccgtacggtaccttttatacgtgtgcgagacgacggtccgggggctacggattatagtaacgtaagtaacggtaaacggttccggtaccgaactaaacgaacgtcggtacgacgtaccggtgggaccgtacgggaacctcggtaccgtaccgttcctcccgtacgccgtccctaccgaaccgaaccgggccctacgtcccggttcccttccccgtcggtccctacccctccgtaccaacgcgaccacccgtcgggcgggaccacgccggccggtcccgtggcctcgtcgtcgtacgaacgtaccttaccttacccgagtcgtcgtctcgagtcggcggtcgcggacgacggcanaggtcnnnnnnnnnn

SEQ ID NO: 184136 - DNA, 722 bp, Homo sapiens
  misc_feature: GYAE6OF01AX3QT.4.11.A11.1.454.CMB.1.raw
  modified_base (714)..(714): a, c, t, g, unknown or other
  misc_feature (714)..(714): n is a, c, g, or t
  modified_base (717)..(718): a, c, t, g, unknown or other
  misc_feature (717)..(718): n is a, c, g, or t
  modified_base (720)..(720): a, c, t, g, unknown or other
  misc_feature (720)..(720): n is a, c, g, or t
tcagagcactgtagcacgaccggtgctcgatttagctacgactgcgaagggaaagggaggcaccttcagtacgtttgatatcaattgggtgcgacaggcccctggacaagggcttgagtggatgggaaggatccacccctaccctgcctatggacaaacaatgcacagaagttccagggcagactcacaatccgcgaacaagtccaagccgcacagcgtacagtggaactgaggagcctggagatcaggaaagaccgtacggtccgtttaatacgtgtagacgagacgacggtccgggggctacggaatagttagaactaaagtaggtaaaaacgttccggtacgaactaaacgaacgtaggttacgagtccggtagggaccacgggacccgtggtaccaccgtccgtaccgtaccgacgtccctaccaaccggtaaccggaccctaacgttcccggttacccccttcccccgtacgggtacccctaaccccgttaccccgttaacccgaaacggtacccgacccgtaacccgtaccggtacgggggacccaacgtccgggacccggtcccgtacgggtcccgtaccggtacccggtacggtacccgtaaacggtcccttaacccgttcccgtaacgacggttcgacctacgtacggacgggtcgggtacctcgggaaccgacgggtcccgtagtaacgttagctagacgtcanagnngngc

SEQ ID NO: 184137 - DNA, 733 bp, Homo sapiens
  misc_feature: GYAE6OF01EO9GM.4.11.A11.1.454.CMB.1.raw
  modified_base (445)..(445): a, c, t, g, unknown or other
  misc_feature (445)..(445): n is a, c, g, or t
  modified_base (517)..(517): a, c, t, g, unknown or other
  misc_feature (517)..(517): n is a, c, g, or t
  modified_base (718)..(718): a, c, t, g, unknown or other
  misc_feature (718)..(718): n is a, c, g, or t
  modified_base (725)..(725): a, c, t, g, unknown or other
  misc_feature (725)..(725): n is a, c, g, or t
  modified_base (727)..(728): a, c, t, g, unknown or other
  misc_feature (727)..(728): n is a, c, g, or t
  modified_base (730)..(730): a, c, t, g, unknown or other
  misc_feature (730)..(730): n is a, c, g, or t
  modified_base (732)..(733): a, c, t, g, unknown or other
  misc_feature (732)..(733): n is a, c, g, or t
tcagagcactgtagcacgaccggtgctcgatttagctacgactgcgaagggaaagggaggcaccttcagtacgtttgatatcaattgggtgcgacaggcccctggacaagggcttgagtggatgggaaggatcacccctacctgcctatggcaaacaatgcacagaagttccagggcagactcaacaagttaccgcggaacaacgtccaaagccgacactacgacgtacagtaggaacctggaggtacgccctaggaagtatcgtaggaaacgtaccgtaccggtccgtttaattaccgtgtcgcgagacgacggtccgggggactacggtattacgttagaactaaggtaacgggttaaaaccggttccgggtaccgtaactaaaaccgaacgtacgggttacgaacgttccggacgggaccgaacgggtacccgtcggtaccncccggttactcccgtacgaccgtccctaaccgacccgtaacgggccctaacgttccggtaccccttccccgngtccctacccgtccctaccgaaggtccgtacctcccgtcggaccggggtcaacccggacgggcccggtccggtcgggtcctcggccgttacgggtaccgtaaccggtacctttacccggttacccctaaggtccgttaccggtccgttagtacggaccgggcggtacggttccggaaccggtaggacccgatacgttcgancctacgnanncngnn

SEQ ID NO: 184138 - DNA, 584 bp, Homo sapiens
  misc_feature: GYAE6OF01CCFWO.33.45.E01.1.454.CMB.1.raw
  modified_base (226)..(226): a, c, t, g, unknown or other
  misc_feature (226)..(226): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgattcagcctccctccgcgtccgggtctcctggacagtcagtcgccatctcctgcactggaaccngccgtgacgttggtggttataagtatgtctcctggtaccaacagcacccaggcaaagcccccaaaatcttgatttatgaggtcactgagcggcctgacgggtacctgactcgacttctctggctcaagtctggcaacgacggcctccctgaccagtctcgtcgggctccgaggtctgaggactgaggctagattacttactgacagtctcgtatcgctagggcgacaaactaagtttaacgggcgttacgggacggtagggaccgtaagggttcgaacccgttccgtaaggtacacggaccctaaggtcccgtccggtacccccgtaggttccaacccgttcgtcccggttacccccg

SEQ ID NO: 184139 - DNA, 570 bp, Homo sapiens
  misc_feature: GYAE6OF01C6SJA.33.45.E01.1.454.CMB.1.raw
  modified_base (225)..(225): a, c, t, g, unknown or other
  misc_feature (225)..(225): n is a, c, g, or t
  modified_base (249)..(249): a, c, t, g, unknown or other
  misc_feature (249)..(249): n is a, c, g, or t
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (356)..(356): a, c, t, g, unknown or other
  misc_feature (356)..(356): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccggtctcctggacagtcagtcgccatctcctgcactggaaccngccgtgacgttggtgttataagtntgtctcctggtaccaacagcacccaggcaaagccccaaatctgatttangagtcactgagcggcctnacgggtccctgatcgcttctctggctcaagtctggcaacncggcctcctgacccatctctgggctcaggctgaggatgagctgattattactgcagcttcgtatgcaggcgactaacgtaagtttaagggtgtttacgggcgggtacgggaaccgtaagggtcgtacccggtaccgtaaaggtccgaacggtccccgaaaggtccttaccgtaccccccgttggtaccctaaccgtccgttccggttccccccg

SEQ ID NO: 184140 - DNA, 625 bp, Homo sapiens
  misc_feature: GYAE6OF01DZD31.33.45.E01.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttancaccgtgtctcctggtaccaacaacacccagcacacgccccaaactcatactttangagtcactaagccggccctcgacgggtccctgactcgcttcnctggctccaagtctagaccaacaccggccctcctgacctcgtctcgggcctccgagctgacgtatgaggtctgtaatttattattgacgtagttacaagttaccgggaggtacaaaccgaaacgtaacttacttaccgtttaacgtttccgggacggtaacgggaacctaggtccgtacgacccgttaccgtaacgttccgaacggtaccccgaaggccctaccggtcccccccgttacggtaccctacttcccgttcccgtttcccccgaccccttccccg

SEQ ID NO: 184141 - DNA, 607 bp, Homo sapiens
  misc_feature: GYAE6OF01DPGYN.33.45.E01.1.454.CMB.1.raw
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (318)..(318): a, c, t, g, unknown or other
  misc_feature (318)..(318): n is a, c, g, or t
  modified_base (388)..(388): a, c, t, g, unknown or other
  misc_feature (388)..(388): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggagggactggagtggattgcctatattcattatgattggtccaccaatcgcaacccctcctcaagagtcgagtcaccatgtcagtggacacgtccaagaaccagttctcctgaacctgaagtctgtgaccgcgcggacacggccatgtatttcngtncgagnggtggtttcgctcccgagacgaggcggctagtacgggtatcagtcgaccacgtgggccagggaactccgnggtcaccgtctcctcacgccctccaccgaacgggcccacgtccggtccttccccgtcggcccaccctcctccaacgacgccaccgtccgtcggggccacgacggccggtcccgtcgggccgtcggtccgtcgggtaccgaacgggaccttaccgttccgtacggttgttcggttcggtacgttggacggtcggggtacgtgggacgtaacgggcgtacg

SEQ ID NO: 184142 - DNA, 664 bp, Homo sapiens
  misc_feature: GYAE6OF01B7DPM.33.45.E01.1.454.CMB.1.raw
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacgagggtcctgggcccagtctgccctgactcagccctccctccgcgtccggtctcctggacagtcagtcgccatctcctgcactggaaccagccgtgacgttggtgttaataagtatgtctctggtaccaacngcaccaggcaaacgccccaaatctgatttangagtcactgacgcggcctcgacgggtccgtgactacgtcttctctggctaccaagttcaggaccaacgccggcctcccgtgaacctatccgtcgcgggcctccgagctaggaggtagtggaggtctagtaactttagtacctggacctagtcttcggtaatcggacgcggaccgtacgtaaaccgttaagggttttacgggtacggtttaccggggacgggtaaaccgggaaccgtaaacggggtacggtaacccccggtttaacgtaaacggttccgaaccgggttaccccggaaacggtcccgttaccccggtacccccggttacggttaccgacccttaccggttcccggtttcccccccg

SEQ ID NO: 184143 - DNA, 548 bp, Homo sapiens
  misc_feature: GYAE6OF01CFU1N.33.45.E01.1.454.CMB.1.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (534)..(534): a, c, t, g, unknown or other
  misc_feature (534)..(534): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttanaagtatgtctctggtaccaacagcacccaggcaaagcccccaaatcttgatttatgaggtcactgagccggccctcgacggggtccctgactcgcttctctggcctccaagtctggacaacaccggcctccctgaccctatcctcgtcgggcctccgaggctggaggatgaggctagtattattactgcagtctgtatgcagggcgacaaacgtaagtttagggtgttcgggacggaggaccgaggtcgaccgtcgtaagtcacggcccaaggcctcgtccccgtgccnctccgtcgtccccg

SEQ ID NO: 184144 - DNA, 622 bp, Homo sapiens
  misc_feature: GYAE6OF01AW5RF.33.45.E01.1.454.CMB.1.raw
  modified_base (221)..(221): a, c, t, g, unknown or other
  misc_feature (221)..(221): n is a, c, g, or t
  modified_base (323)..(323): a, c, t, g, unknown or other
  misc_feature (323)..(323): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggaagggactggagtggattgcctatattcattatgattggtccaccaatcgcaaccccctccctnaagagtcgagtcaccatgtcagtggacacgtccaagaaccagttctccctgaacctgaagtctgtgaccgccgcggacacggccatgtatttctgtgcgagnggtggtttcggctcccgagacgaggcggctaggtacgggtatcatcgaccacgtggggccaggggaatcccgtggtccaccggtctccctcacgccctccaccgaacgggccccactccggtccttcccccgtggccctacccctccctcccaacgacgccaccctcgtcggggccacgacggccggcccgtgggcctcggccgtcgggtccgaacgggtaccttaccgttccgtaacggttggttacggttcgtaccgtggacgggtccggggacgttgggaccgaacgggcgtacgg

SEQ ID NO: 184145 - DNA, 624 bp, Homo sapiens
  misc_feature: GYAE6OF01A9ZBP.33.45.E01.1.454.CMB.1.raw
  modified_base (305)..(305): a, c, t, g, unknown or other
  misc_feature (305)..(305): n is a, c, g, or t
  modified_base (347)..(347): a, c, t, g, unknown or other
  misc_feature (347)..(347): n is a, c, g, or t
  modified_base (368)..(368): a, c, t, g, unknown or other
  misc_feature (368)..(368): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagccacccaggcaaacgcccccaaactcttgatttangaggtcactgagccggcctcgacgggtccctgactcgcttcnctggctccaagtctggcaacnccggcctccctgacccatcctcgtcgggcctccgaggctggagtagtggacggtcttagtatttacttacgtggctacgtcttcggttagtcgacgagggccggacgtaaacgttaaggttttaacggggtcgggttaccgggacgggacgggaaccgtaagggtccgaacccggttacgtaacggtccaacggaccccgaagggtcctacccggtccccccgtaggttaccctaccgttccgtcccgttaccccg

SEQ ID NO: 184146 - DNA, 558 bp, Homo sapiens
  misc_feature: GYAE6OF01A3XJV.33.45.E01.1.454.CMB.1.raw
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (363)..(363): a, c, t, g, unknown or other
  misc_feature (363)..(363): n is a, c, g, or t
  modified_base (454)..(454): a, c, t, g, unknown or other
  misc_feature (454)..(454): n is a, c, g, or t
tcagtacacacactcacgaccggtgctcgatttagtgagtcagtaagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcacccaggcaaagcccccaaatcttgatttangaggtcactgagcggccctnaggggtcccctgatcgcttctctggctccaagtctggcaacncggcctcctgaccatctctgggctccgaggctgaggatgaggctgattattactgcagctcgtatgcaggcggacaagtaagtttaagggngttcgggacggaagggaccaagggtcgacccggttccgtaaggtccaacggccccaaagggcctacggaccccccttgggtaccaccgttcgtccgttcccccg

SEQ ID NO: 184147 - DNA, 556 bp, Homo sapiens
  misc_feature: GYAE6OF01D4DAK.33.45.E01.1.454.CMB.1.raw
  modified_base (304)..(304): a, c, t, g, unknown or other
  misc_feature (304)..(304): n is a, c, g, or t
tcagtacacacactcacgaccggtgctcgatttagtgagtcagtaagggaaagggggggtctcaggaggcagcgctctcaggacgtcaccaccatggcctggctctgctcctcctcaccctcctcactcagggcacagggtcctgggcccagtctgccctgactcagcctccctccgcgtccggtctcctggacagtcagtcgccatctcctgcactggaaaccagccgtgacgttggtgttaataagtatgtctcctggtaccaacagcacccaggcaaaacgccccaaactcttgattttangaggtcactgagcggcctcgagggtccctgatcgcttctctcggctccaagtctggacaacgacggcctccctgacccatctctgggctccgagcctgaggacgagtcttgtttatactgctcgccgtatcatttcagcagctctcgtcgaacgttcgggacggacgggaccaaggtcgaccgtacttaacgtcgaagcccgaaaggcctccgcccccgttcggtacctacttccttccgttccctaccccg

SEQ ID NO: 184148 - DNA, 643 bp, Homo sapiens
  misc_feature: GYAE6OF01DG5IG.33.45.E01.1.454.CMB.1.raw
  modified_base (254)..(254): a, c, t, g, unknown or other
  misc_feature (254)..(254): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
tcagtacacacactcacgaccggtgctcgatttagtgagtcagtaagggaaagggggggtctcaggaggcagcgctctcaggacgtcaccaccatggcctgggctctgctcctcctcacccctcctcactcagggcacagggtcctgggcccagtctgccctgattcagcctccctccgcgtccgggtctcctggacagtcagtcgccatctcctgcacgtcggaaccagccgtgacgttggtggttataagtntgtctcgtggtaccaacngccaccaggaccaaacgcccccaaatcttgatttangagtcacgtgagccggcctcgacggtccngactacgcgtnctgctacagtcgcgacaacgcgcctacctgaccattcctcgtcgggtacctccgaaggtcctaggacgtagtagacggcttagtatttaacgttcgtagcctagtaccgtgtagtcgcgtaacgcggaactaaacggtaaggtttagggttacgtacggggtaccggacgggtaaacgtacgggtaccggtacccgtaccgttaaacggtaccgaacggtccccggaaacggtccccgtacccggtaccccccgttacgggtaccctacccgtttccgttccccggtttcccccc

SEQ ID NO: 184149 - DNA, 673 bp, Homo sapiens
  misc_feature: GYAE6OF01AV226.33.45.E01.1.454.CMB.1.raw
  modified_base (240)..(240): a, c, t, g, unknown or other
  misc_feature (240)..(240): n is a, c, g, or t
  modified_base (251)..(251): a, c, t, g, unknown or other
  misc_feature (251)..(251): n is a, c, g, or t
  modified_base (361)..(361): a, c, t, g, unknown or other
  misc_feature (361)..(361): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggnggttataagtntgtctcctggtacaacagcaccaggacaaacgccccaaatcttagatttatgaggtcactgagcggccctcgacggggtccctgactcgtcttctctggcctccaagtcnggaccaacgaccggcctccctgacctatcctcgtcgggcctccgagggtcctaggacggtatggaacggtcttagtaatttacgttaacgtgaccgtacggtccttacgtagtcggacgacgggtccggacgtaaccgttaaagggttttaaggggtcggttaccggggacgggtaacggggtaaccgtaacggggttccggtaaccccggtttaacgtaacggttccgaaaccggtaccccggaaagggtccccgtacccggtccccccgtacgggttaccctacccgttccgttcccggttacccccccg

SEQ ID NO: 184150 - DNA, 795 bp, Homo sapiens
  misc_feature: GYAE6OF01DUJ2H.33.45.E01.1.454.CMB.1.raw
  modified_base (251)..(251): a, c, t, g, unknown or other
  misc_feature (251)..(251): n is a, c, g, or t
  modified_base (271)..(271): a, c, t, g, unknown or other
  misc_feature (271)..(271): n is a, c, g, or t
  modified_base (582)..(582): a, c, t, g, unknown or other
  misc_feature (582)..(582): n is a, c, g, or t
  modified_base (746)..(746): a, c, t, g, unknown or other
  misc_feature (746)..(746): n is a, c, g, or t
tcagtacacacactcacgaccggtgctcgatttagtgagtcagtaagggaaagggggggtctcggaggaggcaggcgctcgtcaggacgtcgaccacctatcggcctaggctctcgctcctcctctacccttcctcacgtcagggccacgacgggtcctgggccctaggtctcgccctagacgtcagcccttccgtcgtcgtccggtctccgtggactgtcagtcgcctagtccgcctagcactggaaccngtcgtgacgttggtagttanagtatgtcctcgtaggtacaacgcgcaccgaggacgaaaccgacccctaaatcgttagtaatttacgtagtaccggtacctaccgtacgaccggtccggtccttcggaccgggttcccgtacgaccgtcgtaccttccgtcgtcgcctaccgtacgtccgtacgacctaacgccggtccttaccgacgaccctaagttccgtcgtacggttaccgtcggaggtaccgttcggaaggtaccgttaaggtacgtacgttaacgggtaacttttaacgtactaccggtaacgttaccggtacgttaacccggtntaaccgggtacccgtaaccgggtacccggaaagtttaaaaccccggtttaagggtttttaaacgggttccgggtttaacggggaccgggtaaaccggttaacggttaccggttacgttaaacccggtcggttaacacccggtaacggacccggtaccggtaccnccccgggttacccgcggtaacgtccggttcccgttcccggtaaaccccg

SEQ ID NO: 184151 - DNA, 895 bp, Homo sapiens
  misc_feature: GYAE6OF01DXDRR.33.45.E01.1.454.CMB.1.raw
  modified_base (232)..(232): a, c, t, g, unknown or other
  misc_feature (232)..(232): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcagggcacgagggtcctgggcccagtctcgccctgactcagccctccctccgcgtccggtctcctggacagtcagtcgcctatcctcctgcacgtggaaccnggccgtgtacggtttggtaggtttaataaggtattgtcctccgtggtaaccaacgagccacccgaaggaccaaaacgacccccaaaacttcctttagtaacttttagtacggtacgggttacctaacgtacggaacggcccggtccccgttacggtaacgggggtttttcctccgtaacgttccggtccgttttaccgttcgttacggtaccgttcccgtaaaacggttccgttacgggacgaacggaccggtaacccgggtccccttacccgtaccggtaacccgtaccttaccgttcccgtacggggtcccttaccggaacgggtccgttaggggaacgggtaacggtacgggttccgtttaggtttttaaaccttaccgttcggttacccgttaccggttaccccgtttaaacgttaaccgttaacgtttaccgtaacggtacccgtacggttcccttaccgtttacccgttaaccggttaacgggtttaccggggaaccggggtaaaccgggtaaccccggtaagggttacccgtaaaccggtttacggtttaaaccggtaccgtaccggaaaccccgtaaccgggtacccgttaccccgggtaccccccgttacgggtaccccttacccggtttcccgttcccccggtttaccccccg

SEQ ID NO: 184152 - DNA, 570 bp, Homo sapiens
  misc_feature: GYAE6OF01DUCQN.33.45.E01.1.454.CMB.1.raw
  modified_base (226)..(226): a, c, t, g, unknown or other
  misc_feature (226)..(226): n is a, c, g, or t
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttatagtatgtctctggtaccaacngcaccaggcaaacgccccaaatctgatttangagtcactgagcggcctcgacgggtccctgactcgtcttctctggctcgaagtctggacaacgcgcctccngaccntctctggctcgagctgagatgagctagtattatacgtgcagtcttagagtcgcaaggccgtactaaacgttaggtttagggtcgttcgggacgggtacggaacctaagggtcgaacccgttacgtaacgtcgacggtcccgaaggtccctccggtacccccgttaggtaccctaccgttccgttccggttacccccc

SEQ ID NO: 184153 - DNA, 637 bp, Homo sapiens
  misc_feature: GYAE6OF01ADHXA.33.45.E01.1.454.CMB.1.raw
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggaagggactggagtggattgcctatattcattatgattggtccaccaatcgcaacccctccctcaagagtcgagtcaccatgtcagtggacacgtccaagaaccagttctccctgaacctgaagtctgtgaccgccgcggacacggccatgtatttctgtgcgagaggtggtttcggctcccgagacgaggcggctagtacggggtatcgatcgaccacgtggggccaggggaatccgtggtcaccgtctcctcacgcctccaccaacgggccccagtccggtccttcccccgtcggccacccctccctcccaacgacgccacccgttccgtcgggggccaccgacggcccgggtccccgtcggggccgttcggcccgttcgggttccgaacgggtaccttaaccgtttcccgtaacggttcggttcggttcggttaccgttggacggtccgggggcgttagggccgaaagggccggtacg

SEQ ID NO: 184154 - DNA, 567 bp, Homo sapiens
  misc_feature: GYAE6OF01B7OTE.33.45.E01.1.454.CMB.1.raw
tcagtacacacactcacgaccggtgctcgatttagtgagtcagtaagggaaaggggggggtctcaggaggcagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggagctatgactatgtctcctggtaccaacaacaacctggaccaaacgccccaattattgatttctgatgtcactaatcggccctcgtagggtttctcatcgtcttctctgctcaagtctgcagcgacgcctccctgaccatctcgtggcctccgaggtctggaggacgaggtcttagtttatactgctcgtcccgtatacattcagcacgtctctctcgtaagttcgggacggacggaccaagggtcgtaccgtacgttagtccgacgcccgaaggtccctccgtacccccgtcggtaccctaccttccttccgttccccctaccccg

SEQ ID NO: 184155 - DNA, 642 bp, Homo sapiens
  misc_feature: GYAE6OF01CD5MX.33.45.E01.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (257)..(257): a, c, t, g, unknown or other
  misc_feature (257)..(257): n is a, c, g, or t
  modified_base (311)..(311): a, c, t, g, unknown or other
  misc_feature (311)..(311): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcagggcacagggtcctgggcccagtctgccctgactcacgccctccctccgcgtccgggtctcctggacagtcagtcgccatctccngcactggaaccngccgtgtacggttggtggttaataagtntgtcctctggtaccaacagcaccaggacaaacgcccccaaaactctagatttangagtcatgagcgcctgacgggtcctgatcgcttctctggctccaagtctggacaacgacggcctcccgtcgaccatctcgcggtctccaggccgtagacgagtagaggtcgtagtatttacttactcggactagtctacgtagtcgcgtaaggccggaacgtaaacgttaaacggtttaagggttcggttaccgggggacggtaacgggaaccggtaacggttaccggtaacccgtaccgttaacgacgtacccggaccccgaaaggtcccgtaccccggtacccccgttacccgggtacctaaaccttcccgtacccggtttccccccgg

SEQ ID NO: 184156 - DNA, 682 bp, Homo sapiens
  misc_feature: GYAE6OF01AXCA6.33.45.E01.1.454.CMB.1.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
tcagtacacacactcacgaccggtgctcgatttagtgagtcagtaagggaaaggggggggtctcaggaggcagcgctctcaggacgtcaccaccatggcctggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttataagtntgtctctggtaccacagcaccaggcaaacgccccaaactcttgatttangagtcactgacgccggcctcgacgggtcctgactcgtcttctcgtcggctccaagtcgtcggactaaccgaccggtcccttcccgtacgtacctactcctcgtcgggtacccttcccgagggtccgtggaaggtacgtacgggaacggtcttaagtaactttagttaccgttgacctaggtccttacggtatcggacgagggaccgtaacgtaaacgttaaggttttacggggtcggttacgggacgggtaacgggtaccgtaagggtaccggtaacccgttacgtaacggtaccgaaccggtaccccggaaacgggtcccgttaccccggtaccccccgttacgggtacccacccggtttcccgtcccggtttacccccccg

SEQ ID NO: 184157 - DNA, 661 bp, Homo sapiens
  misc_feature: GYAE6OF01DD5AK.33.45.E01.1.454.CMB.1.raw
  modified_base (251)..(251): a, c, t, g, unknown or other
  misc_feature (251)..(251): n is a, c, g, or t
  modified_base (256)..(256): a, c, t, g, unknown or other
  misc_feature (256)..(256): n is a, c, g, or t
  modified_base (273)..(273): a, c, t, g, unknown or other
  misc_feature (273)..(273): n is a, c, g, or t
  modified_base (309)..(309): a, c, t, g, unknown or other
  misc_feature (309)..(309): n is a, c, g, or t
  modified_base (354)..(354): a, c, t, g, unknown or other
  misc_feature (354)..(354): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
tcagtacacacactcacgaccggtgctcgatttagtgagtcagtaagggaaagggggggtctcaggaggcagcgctctcaggacgtcaccaccatggcctggctctgctcctcctcaccctcctcactcagggcacgagggtcctgggcccagtctgccctgactcagccctccctccgcgtccgggtctccgtggacagtcagtcgccatcctcctgacactggaaccagccgtgacgttggtagttaanaagtntgtcctctggtaccaanagcaccgagaccaaacgtccccaatctagatttagngagtcagtgacgtcggccctgacgggtcctaggcttcgtcttcgntcggctacgagtcgngacacgccgcctactcgacnctctcggacggcctcgaggtctaggacggtatcggaggtactaggttattaacgtcgtgcgtacgtcgttacgtatcggaacgtcgggacgtaaccgtaagtttaacggtttacgggtcggttaaccggggacgggtaaacgggtaccggtaaggtcccggaacccggttaacgtaaccggtaccgaacccgggtacccgtaaacggtccccggttacccggtacccccggtttacgacccctacgtttccccggtaaccctttccccccgg

SEQ ID NO: 184158 - DNA, 679 bp, Homo sapiens
  misc_feature: GYAE6OF01DTIM8.33.45.E01.1.454.CMB.1.raw
  modified_base (233)..(233): a, c, t, g, unknown or other
  misc_feature (233)..(233): n is a, c, g, or t
  modified_base (260)..(260): a, c, t, g, unknown or other
  misc_feature (260)..(260): n is a, c, g, or t
  modified_base (656)..(656): a, c, t, g, unknown or other
  misc_feature (656)..(656): n is a, c, g, or t
tcagtacacacactcacgaccggtgctcgatttagtgagtcagtaaggggaaaggggggggtctcaggaggcagcgctctcaggacgtcaccaccatggcctgggctctgctcctcctcaccctcctcactcagggcacgagggtcctgggcccagtctcgccctgactcagccctccctccggcgtccgggtctccgtggacagtcagtcgccatctcctgccatggaaccngccgtgacgtttggtaggttataagtntgtctccgtggtaccaacagcaccgagacaaacgaccccaaactctagtatttatgacggtcactgacggccggtcctcgacgggtccgtgactcgtctctcgtcggctacagtctggacaacgacggtcctccgtacgacctatcgtcgtcggtcctccgcggtacgtggacggtagtaggacggtcgttagttaacgtttaactttacgtcgaccgtacgtaccttacggtttaacgcggtacggagggtaccggtaacgtaaacgtttaaagggttttaacggggttcgggtttaaccgggacgggtaacgggaacgtacgggtaccgtaacccgttacggtaacgtacgacgtacccggaaggtcccgtacccggtccccgttaccggtacnccgttccgttcccggttaccccc

SEQ ID NO: 184159 - DNA, 650 bp, Homo sapiens
  misc_feature: GYAE6OF01E4E8I.33.45.E01.1.454.CMB.1.raw
  modified_base (227)..(227): a, c, t, g, unknown or other
  misc_feature (227)..(227): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttataagtatgtctcctggtaccaacagccaccgaggacaaacgccgaccaaactcttagatttatgagtcactgacgccggccctcgacggggtccctgactcgcttctcgtcggcctaccgaagtcgtcggacaacgaccggtccctccctagaccctatccgtcgtacgggtcctccgaggtcgtaggaggagtggaggtctagtaacgtttattacgtgacgtacgcgttaccgtagtcggcgtaacggaccggactaaacgtttaaaggtttaacggggttcggtttaccggggacgggtaacgggtaaccgtaagggtaccggtaaccgtaccgtaacgttccgaaccgaccccgtaaggcccttaccggcccccgttaggtcctaccgttccgttccccgg

SEQ ID NO: 184160 - DNA, 634 bp, Homo sapiens
  misc_feature: GYAE6OF01BPHD1.33.45.E01.1.454.CMB.1.raw
  modified_base (312)..(312): a, c, t, g, unknown or other
  misc_feature (312)..(312): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggaaggactggagtggattgcctatattcattatgattggtccaccaatcgcaacccctccctcaagagtcgagtcaccatgtcagtggacacgtccaagaaccagttctcctgaacctgaagtctgtgaccgccgcggacacggccatgtatttcngtgcgagaggtgttcgctccgagacgagcggctaggtcggtatcatccgaccacgtgggaccaggtaactccgtggtccaccggtctccgtcacgtccctccgaccgaacgggccctacgtccggtacccttcccccgtcggtacccaccccttcccgtacccaacgaccgcccgacccttcggtacggggccaccgacggcccgggtcccgtcgggcctccggcccgttcgggaccaaacgggaccttaaccgttcccgacggttggttacggttcgttaccgtggaacggtcgggacgtcggacgtaagggccgtaacgg

SEQ ID NO: 184161 - DNA, 735 bp, Homo sapiens
  misc_feature: GYAE6OF01AB2PC.33.45.E01.1.454.CMB.1.raw
  modified_base (172)..(172): a, c, t, g, unknown or other
  misc_feature (172)..(172): n is a, c, g, or t
  modified_base (227)..(227): a, c, t, g, unknown or other
  misc_feature (227)..(227): n is a, c, g, or t
  modified_base (301)..(301): a, c, t, g, unknown or other
  misc_feature (301)..(301): n is a, c, g, or t
tcagtacacacactcacgaccggtgctcgatttagtgagtcagtaagggaaagggggggtctcaggaggcagcgctctcaggacgtcaccaccatggcctggctctgctcctcctcaccctctcactcaggcacaggtcctgggcccagtctgccctgactcagccctcccncgcgtccgggtctccgtggacagtcagtccgcctatcctcctgcactcggaaccngccgtgacgttggtagttataagtatgtctcgtcgtacacagccaccaggccaacgccccaatctagtatttancgaggtcactcgacggccggtccctcggacgggtccctgactcgtccttctcgtcggactaccgtaacgtctacggaccaacaccggtccctaccacgtaccctacgttccgttaccggtcgggtacctcccggtaaggccgttaggtacgggtacgttacgggacggttaccgttaaggttaactttaacggtttacgtacgtaccgtacggtcctttacggttacgtaccggacggttaacgggaccggtaacttaaacgggttaaggttttaccgggggtactttaaccgggggaacggtaaccgggaaaccggtagggtttacccggaacccgtttaacggaacgttaccggacccggtaccgtaacggtaccccgttcccggtacccccgttcggtaccccttccgttcccggttcccgttaccccccg

SEQ ID NO: 184162 - DNA, 727 bp, Homo sapiens
  misc_feature: GYAE6OF01D0SDM.33.45.E01.1.454.CMB.1.raw
  modified_base (210)..(210): a, c, t, g, unknown or other
  misc_feature (210)..(210): n is a, c, g, or t
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
  modified_base (254)..(254): a, c, t, g, unknown or other
  misc_feature (254)..(254): n is a, c, g, or t
  modified_base (267)..(267): a, c, t, g, unknown or other
  misc_feature (267)..(267): n is a, c, g, or t
  modified_base (379)..(379): a, c, t, g, unknown or other
  misc_feature (379)..(379): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcgagggcacgagggtcctgggcccagtctgccctgactcacgccctccctccgcgtccggtctccgtggacagtcagtcnccatcctctgcactggaaccngcgtgacgttggagttanaagtntgtctctgtacangccacagacaaacgacccaatctagtattacgtgacggtctacgtacgacgccggaccctcggacgggtccgtgtacgttccggttcgtcgtcggtcctccggtcgtaaccncgtccttaccttaccgtaactttccggtactcccctttacctaccctacctaccgttccgttaccgttacggtacccgttaaggtaaccggtaccggttacgggaaacggacggtaacggtacgttttaacgtaacgtttaaccgtttaacgtcggttaacgtacgtttaacccgttaagtaccgtaacgtaaaccggaaccccttaccgtaacgttcggttacgggtttacccgggtaccggggtacgggtaacctcgggtacccgtacgggttcccgtacggtcggtacgaccgtaccggaccgtaccgtccgtccgccccgtagtccctaccgtccgttaccccg

SEQ ID NO: 184163 - DNA, 759 bp, Homo sapiens
  misc_feature: GYAE6OF01C0FMQ.33.45.E01.1.454.CMB.1.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
tcagtacacacactcacgaccggtgctcgatttagtgagtcagtaagggaaagggggggtctcaggaggcagcgctctcaggacgtcaccaccatggcctgggctctgcctcctcctcaccctcctcactcgagggcacgacgggtcctcgggacccaggtctcgccctgacctcacgccctcccctccggccggtccgggtctccgtggactagtccaggtccgcctacttcctcctgcacgtacggaaccngccgtgtacgttggttagttaataagtntgtcctcgtacggtaccaacgcgaccaccgagaacaaaccgacccctaaactcgttagtatttagtacggacggtacacgtggacggcccggtcccgtcggaccggggtccctaggtactccgtcctttcgtcgtacggtcctaccgtaagtccgtacggaccaaccgtcccggtcccttacccgtacgtaccctacttccgtcggtcgggtccctaccggtacgggtccgtagggaaggtacgtacgggaacggtcgttaaggttacttttaacgttacgttcggacgtacggtccttcggtaagtcggaccggtacggaccgtaaacgtaaacgttaagggttttaacggggtcggttaacggggaccgggtacggtaaccggtaacgggtccggtacccgttacgtaacgtcgaacgtcccgaacggtcccgttacccgccccgttacgtcctaccttccggttccctacccccg

SEQ ID NO: 184164 - DNA, 662 bp, Homo sapiens
  misc_feature: GYAE6OF01A8AW4.33.45.E01.1.454.CMB.1.raw
  modified_base (229)..(229): a, c, t, g, unknown or other
  misc_feature (229)..(229): n is a, c, g, or t
  modified_base (310)..(310): a, c, t, g, unknown or other
  misc_feature (310)..(310): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcagggcacgagggtcctgggcccagtctgccctgactcagcctccctccgcgtccgggtctcctggacagtcagtcgccatcctcctgcactggaaccngccgtgacgttggtgttataagtatcgtctccgtggtaccaacacgcaccgaggacaaaccgccccaaatcttagatttangagtcactgacgccgcctcgacgggtccctgactcgctttctcgtcggcctaccgaagtctcggaccaacgaccggcccttcccgtcgacctactccgtcggtcgggtcctccgaggtaccgtggaggtactagggaacggtctaggtaactttacgttacgtcgtactacggtccttagttactcggacgagggaccgtacgtaaacgttaaaggtttacggggtcgttacggggacggaacgggtaacgtaacgggtcgtaaccgttaccgtaacggtcccaacggacccgtaaacggcccgttacccggtccccgttacggtaccctaccgttcgtaccccggttcccc

SEQ ID NO: 184165 - DNA, 706 bp, Homo sapiens
  misc_feature: GYAE6OF01DNW1E.33.45.E01.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (351)..(351): a, c, t, g, unknown or other
  misc_feature (351)..(351): n is a, c, g, or t
tcagtacacacactcacgaccggtgctcgatttagtgagtcagtaagggaaaggggggggtctcaggaggcagcgctctcaggacgtcaccaccatggcctggctctgctcctcctcaccctcctcactcactatacagggtcctgggcccagtctgtgctgactcagcccaccctcacgcgtccgtccggggccccccgggnaggacgggtcctccatcctcttgttctggagtccacttccaacatacggaaatatgatgtgagctggtaccagcgacggtacccgaggaaccggaccccaaacgtccacactctactaaccatgatgngccgtcctcgacgggtcccncgtaccgtattcctctcgcctacaagtcgacgctacgtcacgtcccttcgtacggactacgttccgtcggtccctccgtagtccgtggcggtagtggtacggttctttgttttactttacgttcgttaccgaggtaccggtacgggtacgttccggaccgacgggtaaccggtagttacgggtacgttaagggtttacggggttacggtcggggtaccggggtaaacgggtaacccgttaaagggtcccggtaacccggttaccgttacgggacccgaccggtacccggacggttccccgtaccccggtcccccgttacgggaccctttcccgtcccgtttcccggttccccccg

SEQ ID NO: 184166 - DNA, 840 bp, Homo sapiens
  misc_feature: GYAE6OF01DAJ8E.33.45.E01.1.454.CMB.1.raw
tcagtacacacactcacgaccggtgctcgatttagtgagtcagtaaggggaaaggggggggtctcaggaggcagcgctctcaggacgtcaccaccatggcctggctctgctcctcctcaccctctcactcgaggcacgaggtcctggcccagtctcgccctgacctcacgccctcccgtcgcggttccgggtctcctaggactagtcacggtccgcctaattccctccgtcgaccgtaacgtaccgggaaccacggtccgtttacggtaaccgggttttggggttaagttttaaacgttaaaggttcttcgggtttcctacccggttacggtaaacccaaactccggacccaaccccggagaaccaaacccggtaccccctaaattcgttagtagttttacgacggtacgttccgacgttacggaccggtcccggtcccgtacgggtaccgggtccctagtaaccgtttccggtcctttaccggttcgtccggtaccttacccggaagttaccggacggacccctaaaccggtcccggtccccttaccctaccgtacctcgtttccggtccggtcggtaccccttagggaccgtcggtaggagtacgttaggaccttagttaacgtatttacgtactcgtaacccgtgttaaccgtcgtaggtccgaacgggaggtaaccgtacgttaaaggtacgggttttacggggcgttaacggggacgaacggggtaacctgggtacccgtaaacggtcgaaaccggtccaacccgggtacgtacccggacccttcccggtaccccggtacttacgtttacccccggtcgtccccgttacccccgg

SEQ ID NO: 184167 - DNA, 841 bp, Homo sapiens
  misc_feature: GYAE6OF01BEESU.33.45.E01.1.454.CMB.1.raw
tcagtacacacactcacgaccggtgctcgatttagtgagtcagtaagggaaagggacagggtctccgaagccttcggagaccctgtccctcacctgctctgtctctggtggctccctcagtacttactactggaactggattcggcacgcccccgagggaagggactggagtggattgcctatattcattatgtattggtccaaccaatccgaccaaccccctccctacaagacgtcgagtcaccatgtcagtgacacgtaccaagaacctagttcctccctagtaaccctagaacgtctggtcgaccgccggcggacgacggcctatcggttatttcgtcggtgcggtaggtacgggtttcggtttccggccgttacccggaggaacggacgggccggtacgtaagggttacgggtactcgtaacgtaccgaccgtacggtcggggaccgaaggggtacctccgttaccgggttaccacccgttccgtcccgtaccgaccgtaccccgtacccgaacccggaaccgggtcccctaccgttacccgggttccccttccccccggtaccggtaccccctacccccgttaccccgtacccgtaacggtacccggacccctacccggttccgggtaccgggggtaacccaaccgggtaccccgggaccccggggtcccgggttcccgggtaccgttcccgggtacccggttaccgggtaacccggtaaaccgggttaacccttaacccgtttacccggtaacggttcgggttacggttaaccggttaccggtacggggtacgggtcccggggtcggtacgggaccggaacggggtccgtaacgg

SEQ ID NO: 184168 - DNA, 654 bp, Homo sapiens
  misc_feature: GYAE6OF01EIZPR.33.45.E01.1.454.CMB.1.raw
  modified_base (199)..(199): a, c, t, g, unknown or other
  misc_feature (199)..(199): n is a, c, g, or t
  modified_base (235)..(235): a, c, t, g, unknown or other
  misc_feature (235)..(235): n is a, c, g, or t
  modified_base (437)..(437): a, c, t, g, unknown or other
  misc_feature (437)..(437): n is a, c, g, or t
  modified_base (539)..(539): a, c, t, g, unknown or other
  misc_feature (539)..(539): n is a, c, g, or t
  modified_base (605)..(605): a, c, t, g, unknown or other
  misc_feature (605)..(605): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacgagggtcctgggcccagtctcgccctgactcacgcctccctccgcgtccggtctcctggacngtcagtccaccattcctcctagcacgtacggaaccncgtccgtgtacggtttgggtaggtttaataagtgttcgtaccttccgtacggtaaccaacacgaccaacccgagaccaaaccgacccctaaacttcttagtatttagaggtacggttacacgtggacggtccggtaccgtcggaccggtaccgtcgacgtaccgtcgttctcgcggtaccacgtaacgtgtacgccgaaccnccggtccctccgtacgactcgttctcgtcggtacctaccgaggtcctagggacgagttcggagttcgtagttacttacgttacacgcctaggtcctgttacnggaacggcggactaacgtaaggttacgttgggcgtacggaggacggtacgaggcgtacctaggtcncgaccggtcaccggtcgtacccgtccgtcacctcttcgtacccgtcccg

SEQ ID NO: 184169 - DNA, 788 bp, Homo sapiens
  misc_feature: GYAE6OF01CU6ZS.33.45.E01.1.454.CMB.1.raw
  modified_base (192)..(192): a, c, t, g, unknown or other
  misc_feature (192)..(192): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactacgtggaactggattcggcacgcccccgagggaaggactggagtggattgcctatattcattangattcggtaccaccaatccgacctaaacccctcctacgaagagtccgagtccaacagttgacgagtgggactaccggtaccaaacgaaccagttacctcctagaaccctggtaacgttcgtacggtcgacccggccggaccggaaccgaccggaccctaagttcggttactttaccgtggttacgacggtaaggtacgggtttggtttccggaccgttacccggagtacgggacggtcgtcggtaacgtacgggtaatcgaacgttacgacccgtagtcgggggaccaagggtaactccgtaggtacctaccggtctaccgacgaccgtccctacccgaaccgtaaccgggtaccctaacgttcccggttaccgttaccccccgtaggccccctaacccgttccctacccgaaacggtaccgacccgtaccggttaccggtacgggggtaaccaccggtaccggcccgggtacccgtgggacccgtcggtaccgtcggaacgtaaccggtaccttaaccgttcgtaaggttcgttacggttacgtaaccggtcggtacgggtccgggtacgtcggaacgggaacggtcgtaaacgg

SEQ ID NO: 184170 - DNA, 745 bp, Homo sapiens
  misc_feature: GYAE6OF01BPG7V.33.45.E01.1.454.CMB.1.raw
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (272)..(272): a, c, t, g, unknown or other
  misc_feature (272)..(272): n is a, c, g, or t
  modified_base (307)..(307): a, c, t, g, unknown or other
  misc_feature (307)..(307): n is a, c, g, or t
tcagtacacacactcacgaccggtgctcgatttagtgagtcagtaagggaaagggggggtctcaggaggcagcgctctcaggacgtcaccaccatggcctggctctgctcctcctcaccctcctcactcagggcacgagggtcctgggcccagtctgccctgactcacgcctccctccggcgtccgggtctccgtggacagtcagtccgcatcctcctgcactggaaccngccgtgacgttggtggttataagtntcgtctctggtaccaanagcaccgagacaaacgccccaaatctgattagtgngtcagtgagcgacctgacgggtcctgactcgtcttcgtcgtcgctacgaagttcgtacggactaaccggaccggtcccttacccgtacgaaccctactcgtccgtacgggtccttccggacggtcgtacgggacggtacgtggtaacggtcttagtaatttacgttacgtcggacctacggtccgtacggttacgttaggaccggtaacgggtacccggaactaaaaccgggtttaagggttttaaaccggggttcgggttaacccgggggtaacggggtaaaccggggtaaccgtaaccggggttaccgttaaacccggttacccggttaaacgtacccgggtaacccgaccccgggtaaacggttccccgtaccccgggttacccccggttcccggttacttaccccgtttaccgttcccggttaaccccccccgg

SEQ ID NO: 184171 - DNA, 792 bp, Homo sapiens
  misc_feature: GYAE6OF01A21S7.33.45.E01.1.454.CMB.1.raw
  modified_base (200)..(200): a, c, t, g, unknown or other
  misc_feature (200)..(200): n is a, c, g, or t
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
  modified_base (256)..(256): a, c, t, g, unknown or other
  misc_feature (256)..(256): n is a, c, g, or t
tcagtacacacactcacgaccggtgctcgatttagtgagtcagtaagggaaaggggggggtctcaggaggcagcgctctcaggacgtcaccaccatggcctggctctgctcctcctcaccctcctcactcagggcacgagggtcctgggcccagtctcgccctgactcagccctccctccgcgtccggtctccgtggacngtnacgtcgcatctcctgcactggaaccngccgtgacggttggtagttataagttntcgtcctccgtagtaaccaacgacgccaccgaggaccaaaccgaccccctaaacttcttagtactttagtagacggtcacgtacggacgccggtcccgtcggacgggttccctagtacgtccgtcgtttccgtcgtcggacctcgtaagtccgtacgacctaaaccgtccggtcccttctaccgactacttccgtacgtcgggacctccgacggtccgtaggacggtagtaggacgtaccgttagtaagttttaccttaagtcggtacgtacgtacgttacggtactacgggtacgaacggggaccgtaaaccgttaaacggttaacggggttttacgggttacggggttaccggggaacggggttaccggggtaaacccgtacgggttaaacccggtaaccggtttaacccggtaaaccggtacccggtaacggggtacccccgggtaaacgttccccgggtaaccccccgggtccccttaacccgggttaacccgtttcccccgtttccccggtacccccgttttaccccccgg

SEQ ID NO: 184172 - DNA, 612 bp, Homo sapiens
  misc_feature: GYAE6OF01BS5IL.33.45.E01.1.454.CMB.1.raw
  modified_base (231)..(231): a, c, t, g, unknown or other
  misc_feature (231)..(231): n is a, c, g, or t
  modified_base (250)..(250): a, c, t, g, unknown or other
  misc_feature (250)..(250): n is a, c, g, or t
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (325)..(325): a, c, t, g, unknown or other
  misc_feature (325)..(325): n is a, c, g, or t
  modified_base (354)..(354): a, c, t, g, unknown or other
  misc_feature (354)..(354): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcaggcacagggtcctgggcccagtctgccctgactcagccctccctccgcgtccgggtctcccgtggacagtcagtccgccatcctcctgcactggaaccngccgtgacgttggtgttanaagtntgtctcctggaccacagccaccagacaacgccccaaatctatattangagtcatactcgcctgtggttcntactcgtcttctctcggtcctacagtcgngctacgccgaccggtccctcccgtcgactactccgtcgtcgggcctccgaggtcgtacggacggacgtcggtcgttacgtttattaccgtgtcgtacgtccctaataccgtaacttcgacgtcgtaccgtacttccgtacgtacggtacgttaccgggacggtacgggaacgtacggtacgtaccgtagttaacgtccgtaacgaccgacgtccgtacccgccccgtgtaccctaccgttcctcccgtccccgtcccg

SEQ ID NO: 184173 - DNA, 766 bp, Homo sapiens
  misc_feature: GYAE6OF01ARL4X.33.45.E01.1.454.CMB.1.raw
  modified_base (201)..(201): a, c, t, g, unknown or other
  misc_feature (201)..(201): n is a, c, g, or t
  modified_base (500)..(500): a, c, t, g, unknown or other
  misc_feature (500)..(500): n is a, c, g, or t
  modified_base (537)..(537): a, c, t, g, unknown or other
  misc_feature (537)..(537): n is a, c, g, or t
  modified_base (718)..(718): a, c, t, g, unknown or other
  misc_feature (718)..(718): n is a, c, g, or t
tcagtacacacactcacgaccggtgctcgatttagtgagtcagtaaggggaaaggggggggtctcaggaggcagcgctctcaggacgtcaccaccatggcctgggctctgctcctcctcaccctcctcactcagggcacgacgggtcctgggcccagtctcgccctgactcacgccctcccgtccgcggtccggtctccgnggacagtcgacgtccgacctactcctcctgacacgtacggaaccaggtcccgtggtacggttgggtagttaactagtacgtcgtccgtaccgtacgtaaccaacgacgtacccaaccgacggaaccaaaccgaccccctaaacgttcgttaggtaactttacggtacgtacggtccacgtacggtacggcccgggtacccgtacggtaccggggtccctaggtacgtccggttcctttacgtccgtcggtaccctacgtaacggtcgtacgaccaaccgccgtccctacgtacgacctntccgtggcggtacctccgaaggtccgtaggacggtanacgggtacgtcgtaacgttaagttaccttagccgtaactcggtaccgttacgtagtcggacggtacgacgaacgttaaaggttagggttaccgggtacggacggggtaccgaacgggtaagtacgggtaccttaaccgtacggtaaccggtaccgaacccggtaccgaccggggttacccncccggtacccggttacggttacccacgtttcccgtccccggtaccccg

SEQ ID NO: 184174 - DNA, 686 bp, Homo sapiens
  misc_feature: GYAE6OF01AHZLO.33.45.E01.1.454.CMB.1.raw
  modified_base (175)..(175): a, c, t, g, unknown or other
  misc_feature (175)..(175): n is a, c, g, or t
  modified_base (195)..(195): a, c, t, g, unknown or other
  misc_feature (195)..(195): n is a, c, g, or t
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (302)..(302): a, c, t, g, unknown or other
  misc_feature (302)..(302): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctcccncgcgtccggtctcctggacngtcagtcgccatctcctgcacgtggaaccngccgtgacgttggtagttanagtntgtctccgtgtaccangccaccaggaccaacgcccctaaatcttagatttagngtacgtcacgtgacgccggcctggacgggtcctgactcgtcttcgctcggtcctacgagtcgtacgaccaacgccgtacctcctacgactacgtcgtacgtcgggaccctacggacggtacgtagggtaacgtcggtacggtaacgtcgttaacgttaacgtttaacgttaccgtcggtaccgtaacggttccgttaacggtactccggggaaccgtagggtacccgttaaccggtaaacgttttaaggggtttaaccggggtcggttaccgggaacgggtaaccggtaacgtacgggtaccgtaacccgtaacgttacgacccgacggtaacccgacggtcccgaacccgtccccgtagtacccgccttcggtcccgtacccg

SEQ ID NO: 184175 - DNA, 861 bp, Homo sapiens
  misc_feature: GYAE6OF01BX75B.33.45.E01.1.454.CMB.1.raw
tcagtacacacactcacgaccggtgctcgatttagtgagtcagtaagggaaaggggggggtctcaggaggcagcgctctcaggacgtcaccaccatggcctgggctctgctcctcctcaccctcctcactcactatacagggtcctgggcccagtctgtgctgactcacgcccaccctcacgtcggtccgtccggggccccccgggcgacggacgggtcctccacttccttcgtttcgttcgtggacgttcctaccttaccaactagtaaccggaaaattaagtagtattggtagtacgtccggttacggtaacccgacggtaccgtaaccgggtaccccgaaccgggaaacccggtacccccaaaacctccctactactaccttaacctaacctaagttgacgttcggtccggaccccggtccccgtaccgggtaccggggttccccgtaccgtaaccgttacttccctccgtccgtccctacgacgttcgtcggacctacggtctaccgtccgtccgtacggtactccgttaccgtccggtaccctaccgtacgtcgtacgggtcgtagtacggtacgttcgtttagttttactttcgttacggtaccgtacgggtacggtaacggtcgtacggtacccgtacgggaaccggtaaggtacggtaacgggtttaacggttgggttaccgggtacggggtaccgggttaaccgggtaaccggttacggtacccggttaacccggtaaccggtaacgggttacccgtaacccggaacccggttacggtacccccggttacccccggtccccggttacgggttacccctaaccccggtttcccgttaccccggttaccccccc

SEQ ID NO: 184176 - DNA, 789 bp, Homo sapiens
  misc_feature: GYAE6OF01C9PRU.33.45.E01.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
tcagtacacacactcacgaccggtgctcgatttagtgagtcagtaagggaaaggggggggtctcaggaggcagcgctctcaggacgtcaccaccatggcctggctctgctcctcctccaccctcctcactcagggcacgagggtcctgggccccagtctcgccctgactcacgccctcccgtccgcgtccgggtctccgtaggacagtcagtccgccatccncctgacacgtggaaccngccgtgtacgttggtagttaatagtatgtctctaggtaccaacacgccacccgaggacctaaaaccgccccctaaaactcttacgtatttagtggtaacgtacgaccgtggacgtcccggtaccccgtacggtaaccggggttccccttaggtaaccgttcccgttccgttttccgtcgtaccggtaccgttaacccgtaaggtttccgtacggaaccaaaccggtcccggcccctttacccccgtagtacccgtacgttccgtcggtacgggtccctaccgacgggtcttaacgggagacggttggacggtactttaaggtactttacgttaaccgcgaacgtcgttccgtttaaggtactcgaacggtaacggtcggtaaaccttaaaaggtttcggtttaaacggggttcggttccgggggaacgggtaaccggtaaacggttaagggcccgttaccgttaaccggtaacgtccggaacggttaccccgaaggtcccgtaccccgttccccgttaacggtctacccgttcgttaccccgtacccccg

SEQ ID NO: 184177 - DNA, 666 bp, Homo sapiens
  misc_feature: GYAE6OF01EVB7M.33.45.E01.1.454.CMB.1.raw
  modified_base (197)..(197): a, c, t, g, unknown or other
  misc_feature (197)..(197): n is a, c, g, or t
  modified_base (205)..(205): a, c, t, g, unknown or other
  misc_feature (205)..(205): n is a, c, g, or t
  modified_base (214)..(214): a, c, t, g, unknown or other
  misc_feature (214)..(214): n is a, c, g, or t
  modified_base (271)..(271): a, c, t, g, unknown or other
  misc_feature (271)..(271): n is a, c, g, or t
tcagtacacacactcacgaccggtgctcgatttagtgagtcagtaagggaaaggggggggtctcaggaggcagcgctctcaggacgtcaccaccatggcctggctctgctcctcctcaccctcctcactcagggcacagggtcctgggcccagtctgccctgactcacgccctccctccgcgtccggtctcctgacngtcagtcnccatctccngcactggaaccagccgtgacgttggtagttaatagtatcgtctacgtagtacaacanccaccagcaaacgccccaaactctgatttatgagtcactagagccgcctgacggtcctagactcgcttctacgtcgtctcaacgtctacggacaaccgacgccctccgtacgaccaactcgtacgtcgggacctacgacgtaccgtggaacgtactacggtagaccgtaggtaactttaagttaccgtagtaccgtacgccttacggtatcggactaagggtaccgactaaacgtaaaggtttaacgggttacggttaccgggtacggaacggtaaccgtaacggttaccgaacccggttaacccgtaacgttaccgaacggtacccgtaaccggtcccgttaccccgtaccccccgttacggtacccttacgttccgtacccgtttaccccccg

SEQ ID NO: 184178 - DNA, 738 bp, Homo sapiens
  misc_feature: GYAE6OF01DEOMQ.33.45.E01.1.454.CMB.1.raw
  modified_base (540)..(540): a, c, t, g, unknown or other
  misc_feature (540)..(540): n is a, c, g, or t
  modified_base (563)..(563): a, c, t, g, unknown or other
  misc_feature (563)..(563): n is a, c, g, or t
  modified_base (574)..(574): a, c, t, g, unknown or other
  misc_feature (574)..(574): n is a, c, g, or t
  modified_base (581)..(581): a, c, t, g, unknown or other
  misc_feature (581)..(581): n is a, c, g, or t
  modified_base (619)..(619): a, c, t, g, unknown or other
  misc_feature (619)..(619): n is a, c, g, or t
  modified_base (675)..(675): a, c, t, g, unknown or other
  misc_feature (675)..(675): n is a, c, g, or t
  modified_base (693)..(693): a, c, t, g, unknown or other
  misc_feature (693)..(693): n is a, c, g, or t
  modified_base (720)..(720): a, c, t, g, unknown or other
  misc_feature (720)..(720): n is a, c, g, or t
tcagtacacacactcacgaccggtgctcgatttagtgagtcagtaagggaaagggggggtctcaggaggcagcgctctcaggacgtcaccaccatggcctggctctgctcctcctcaccctcctcactcgagggcacgacgggtcctcggcctagtctcgccctagactcgacgtccctcccgtccgtccggtcccggtcctccgtaggactacgtccgacggtccacctctcccttccgcgacctaacggtacggaaaccgtccggtccggttacggtacggttttaggggttaaggtttaacttaaggttcgttcgttccttaccggtaacggtaacccaacgaccggacccaaccggacgtaaacccaaccccgtaacccctaactttcgttagtttaacgtttacgacggtaacgttcgaacgttcggacccggtcccggtacccgtcgggtaccggtccgtgtaccggtcctccgtttcgtaccgtcggtccctaacgtacgttcgaccgtaaccgtccggcccgtccttaccgnaaccctgttccgtcgcggtaccncggagtcgganacggttnaggtctacgttattcttacgtgacgtcgagtcttaagngaccggcgcgtaacaaggttacggttaaggtcgggtcgacgggaggaaccgtacgnggtacctacgacgtaacnccacgccgactcccgtcccgtacgtcncctccttccgtccctccg

SEQ ID NO: 184179 - DNA, 740 bp, Homo sapiens
  misc_feature: GYAE6OF01ET52V.33.45.E01.1.454.CMB.1.raw
  modified_base (233)..(233): a, c, t, g, unknown or other
  misc_feature (233)..(233): n is a, c, g, or t
tcagtacacacactcacgaccggtgctcgatttagtgagtcagtaaggggaaagggggggggtctcaggaggcagcgctctcaggacgtcaccaccatggcctgggctctgctcctcctccaccctcctcactcagggcacagggtctcgggcccagtctcgccctgactcacgcctcctccgcggtccgggtctcctggacagtcagtcgccatctcctgcactcggaaccngccgtgtacgttggtagttagtaagtatgtctccgtggtaaccaacgacaccacccgaggacaaaaccgacccctaaattcttagtaatttagtacggtacgtcaacgtggacggccggtacccgtacgggtaccgggtaccctacggtacctactttccgtcgttaccgtccctaacgacggtcgtacggtcctacgtaccaccgtccgttaccgtaggacctaccgtccgtcggtccctacgtcgttccgtggtacggtaggtggtacggtcttttaggttttactttcggttacgttacggacgtaccggtacgggtacgtaccggacgacgggacggttaacggtcggtaaggttacgggtttagggttacggttacgggacgggtaaccggtaacggttaacggtccgggaaccggttaccgtaacggtccgaacggacccggtagtcccgtcccggtacccgtacggtcccgtaacgttcccggttccgtcccccgtcccg

SEQ ID NO: 184180 - DNA, 707 bp, Homo sapiens
  misc_feature: GYAE6OF01CG3QR.33.45.E01.1.454.CMB.1.raw
  modified_base (233)..(233): a, c, t, g, unknown or other
  misc_feature (233)..(233): n is a, c, g, or t
  modified_base (256)..(256): a, c, t, g, unknown or other
  misc_feature (256)..(256): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
tcagtacacacactcacgaccggtgctcgatttagtgagtcagtaagggaaaggggggggtctcaggaggcagcgctctcaggacgtcaccaccatggcctgggctctgctcctcctccaccctcctcactcagggcacgacgggtcctgggcccagtctcgccctgactcacgcctccctccgcgtccggtctccgtggacagtcagtccgccatctcctgcactggaaccngccgtgacgttggtgttatagtntgtctcgtgtaccacngccaccgngacaacgccccaatcttatattncgagtcagtgacgccgtacctcgcgggtccctgactcgcttactcgtcgctacagtcgtcgacaaccncggcctccgtcgaacctacttccgtcgtcgggtaccgtccgacggtcgtacgggtaggtacgtcggacggtcgtacgttactttaacgttacgtcgacgtacgtaccgttcgtacgtcggtacgacgggtaccgaacgtaaacggttaaacggtttagggttcggttaaaaaacgggccggggtaacggtaccgggtaacggtacccggtaaccggttaaccggttaaccggtacggtaacccggtacccggaacccgggtaccccggttaccccggtacccccggttacccgggttaacccgtacccgtttacccgttccccgtttaccccccgg

SEQ ID NO: 184181 - DNA, 860 bp, Homo sapiens
  misc_feature: GYAE6OF01DDRQV.33.45.E01.1.454.CMB.1.raw
  modified_base (605)..(605): a, c, t, g, unknown or other
  misc_feature (605)..(605): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctctcactcagggcacagggtcctgggcccagttctgccctgactcagcctcctcgcgtccgggtctccgtggacctagtcacgtacgccattcctccctggccacgtacggaaccacgtccgtgtacggtttgggttagttaattaagtagtcgtctccgtacggtaccaactacgaccaaccgaggaacctaaaaccggaccccctaaaattccgttagttaactttttagtagggtaccggttacaacgtttcggaaccggtccgggtaccccgtacgggtaccggggttaccccgttacggaacgtttcccggtcctttttaccgccggttaccgggtacctttaccgtaaacgggttccgtacggaacccgtaaaccgaaccgggtcccctttaacccgtcgaacccttacgttcccgttacggtccgggttaccctaccgacgggttacctagggaacgggttatacgggtacggttntaacggttaatttaccggttaacgtcgaccgtacggtcctaacggttacgtcggacggtacgggaccgtacggtaaaggttaacgggttttaacggggtacggttacccgggaagggtaaccgggtaaccacgggggttacctacccgggttaaacgtaaacgtaaccgtaacccgggaacctttaacccggggaccttacccccgggtacccccgttagtacccgttaacgttccccggtcccgtttacccccg

SEQ ID NO: 184182 - DNA, 813 bp, Homo sapiens
  misc_feature: GYAE6OF01AOYZM.33.45.E01.1.454.CMB.1.raw
  modified_base (196)..(196): a, c, t, g, unknown or other
  misc_feature (196)..(196): n is a, c, g, or t
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (255)..(255): a, c, t, g, unknown or other
  misc_feature (255)..(255): n is a, c, g, or t
  modified_base (275)..(275): a, c, t, g, unknown or other
  misc_feature (275)..(275): n is a, c, g, or t
tcagtacacacactcacgaccggtgctcgatttagtgagtcagtaagggaaaggggggggtctcaggaggcagcgctctcaggacgtcaccaccatggcctggctctgctcctcctcaccctcctcactcaggcacagggtcctgggcccagtctgccctgactcagcctccctccgcgtccggtctccgtggacngtcagtcncctatcctcctgcacgtggaaccngccgtgtacggttggtgttataagttntcgtcttcgtagtaccaacngccaccgagcgaaaccgccccaaactcttagtatttacgtagtacggtcacgtcgacggtccggcccttacggacgggtcccgtgacgtaccgtcttcgttcgtggtcctacgtaacgtcgtcgacgaccgccggtccctcgtacgacctacgtccgtacgttcggccctacggcgtacggtacgggtacggtagggttacggtacggtcgttaacggttaattttaaccgttacgttacgaccgtaacggttcccgtttacggttaggacccgtcggggaacccggttaccggtaaaccgttaaccgggttttaaacgggttttacgggggtaccgggtttaccgggggaacggggtaacccgggaaacccgggttaggggtaaaccccggttacccggttaaacccgggttaacccgttaagggtaaccccgggtaaccccgggtaacccgggttcccgtttaccccccgggtaccccccgtttacccggggtaaccttacccccggtttcgttaaccccccggggttaacccccg

SEQ ID NO: 184183 - DNA, 762 bp, Homo sapiens
  misc_feature: GYAE6OF01B885H.33.45.E01.1.454.CMB.1.raw
  modified_base (139)..(139): a, c, t, g, unknown or other
  misc_feature (139)..(139): n is a, c, g, or t
  modified_base (415)..(415): a, c, t, g, unknown or other
  misc_feature (415)..(415): n is a, c, g, or t
tcagtacacacactcacgaccggtgctcgatttagtgagtcagtaagggaaaggggggggtctcaggaggcagcgctctcaggacgtcaccacatggcctgggctctgctacttccctcccctctcactcgaggcacgngggtcctcgggcccagtctgcccgtgactcgaacctgcctcgttgtcgtggtctcgtgacgtgtcgtcacgtctctcctgctcgtacggaaccaggttacgtcgtaacggttggacggtacttatcggtaactagttcgtaccgttccgtacggtaaacccaactaaaccgtaaccgtacggaaccaaacccgtaccccttaatttacgttacgttacttttcgaggttattcgttaccgaacttaacgtcccgtccgttacggttacgggtttcnctacgttcctcgttaccgttcgtcgtaccgtactaacgtcgtacgacgacgaccggcctccgtaccgtacgacgtacgttcgtacccggtcgggtacctaccggaggtccgtaaggacggagggttaacgtctttaggttaaacgtccgtaggtaccgtttacggaccttaacgtacgtacggtttaacagtcccttaggtacccttcgttaccgttaacggtaaccggttcgggaacggtaacggaccggttacgtacggtacggttaacgtacttaccggaccgtccgtaccggaccgtcccggttacccgtacgtcctacccgtttccggtcccttaaccccgg

SEQ ID NO: 184184 - DNA, 912 bp, Homo sapiens
  misc_feature: GYAE6OF01DTCZ5.33.45.E01.1.454.CMB.1.raw
tcagtacacacactcacgaccggtgctcgatttagtgagtcagtaaggggaaaggggggggtctcaggaggcagcgctctcaggacgtcaccaccatggcctggctctgcctccctcctccacccctcctcactcgagggcacgacgggtcccgtcgggccctagtcctcgccctgactcacgccctcccgtccggtccggtcccgggtctccgtaggactcgtcacgtccgacctactcctcctcgacacgtaccggaaccgtacggtccgttaggttacgggtttagggttaacggttaattaagttacggttccgttacccgttaccgttaacggtaaccccaaacgccggaacccaaccccggaaggaacccaaaacccgaaccccctaaacgttctaacgtttaactttaggacgtaacggttacctaaccgtaccggcccggtaccccgtcgggtaacccggtcgtgtcgtcgttccttcgtaccgtacgtaccgtaccgttacgtacaacccgaacccgtacccgtcctacccctcggtacccgtcctttaccggtcggacccgtcgtaaccgggcggtaaccgtcggtacgtaaccggttggtaacgtacgtttaacgtttactaccggtacgttcccggttacgtttaaccccgaacgttacctttacgtaaccgttcggaaccgtaccggttcgtttaaccgttccggttacccggtttaaccgggtacgggtacccggggttaaacggccggtttaaaccggcggtttaaccgttacccgtaacgggttaaccaccccgggtacccggtaccggtcccccgggttaccccgtcccccggttaaccccgttaccgttaccccgtttaccccttcccccgttaccccgttaacccccgtcccg

SEQ ID NO: 184185 - DNA, 533 bp, Homo sapiens
  misc_feature: GYAE6OF02GALCM.33.45.E01.1.454.CMB.1.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (373)..(373): a, c, t, g, unknown or other
  misc_feature (373)..(373): n is a, c, g, or t
  modified_base (451)..(451): a, c, t, g, unknown or other
  misc_feature (451)..(451): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcacccaggcaaagcccccaaatcttgatttangaggtcactgagcggcctcgaggggtccctgatcgcttctctggctccaagtctggcaacncggcctcccngaccatctctgggctccaggctgaggatgagctgattattactgcagctgtatgcaggcgcaaactaagtttaagggngttcggcggagggaccaagggtcgaccgtctaaggtccagcccgaaggcctcggcccccttggtccacgttcctcgttcccc

SEQ ID NO: 184186 - DNA, 855 bp, Homo sapiens
  misc_feature: GYAE6OF02H6Q5Y.33.45.E01.1.454.CMB.1.raw
  modified_base (376)..(376): a, c, t, g, unknown or other
  misc_feature (376)..(376): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
tcagtacacacactcacgaccggtgctcgatttagtgagtcagtaagggaaaggggggggtctcgaggacggcacgcggcttcctacgaggacgttccaccctaccgatggcctgggctcctgacctcctcctcaccctcctcactcgagggtcgacagggtcctgggcccgtagtcttgccctgactcgagcctccctccgcgttccgggtctcctggcaggtcgaggtccggccgattccgtccgtcgggccactaggaaccctagcccgtggacgttggtaggttactaacggtatcgtctccttggtaacccaagacggtccaacccgtaggaccaaaacggtccccccaaaacttcgttgtaacttttagnggacggtcacgtggacgtcggccctgacgggtccngactcgcgttncgtggctccgtagtctaggccaacgtcggtccgtcccgtaggaccctagttccgtttagggcccttacccgtaggccgttaggaaacggtaacgtccggaaacggtaccttaccggtaatttacgtttaaccgtccggtaaccctaaggttaccgttaccgggttaaactacgggacccgtaagggggacccggtaaaccgtaaaccggttaaaacgggtttttaacgggggtccgttttaaccggggaaccgggttaaacgggtaaccccgttaagggggttccggaaccccggtttacccggttaaaacgggtcccttaaaccggggaccccctaaaggggttccccttaacccgggttcccccccggttagggggtaccccttaacccggtttccgggtttacccccggtttaccccccgtaccccccgg

SEQ ID NO: 184187 - DNA, 655 bp, Homo sapiens
  misc_feature: GYAE6OF02GLMD4.33.45.E01.1.454.CMB.1.raw
  modified_base (282)..(282): a, c, t, g, unknown or other
  misc_feature (282)..(282): n is a, c, g, or t
  modified_base (336)..(336): a, c, t, g, unknown or other
  misc_feature (336)..(336): n is a, c, g, or t
tcagtacacacactcacgaccggtgctcgatttagtgagtcagtaagggaaaggggggggttctcaggaggcaggcgctctcacggacgtcaccgaccatcggcctgggctactgctcctcctcgacccctcctcacgtcagggcctacgagggtccctgggccccagtcctgccctgactcagcctccctccgcgtccgggtctccgtggactagttcaggtccgccgatcctcctgccacgtgggaaccaggccgtagacgtttgggtaggttataagtntgtctccgtggtaccaacagccaccgaggcaaacgcccccaaatcttgatttangaggtcactgagccggcctcgacggggtccctagacttccgtccttcgtcgtggcctaccgtaagtcgtcggaccaaccgaccggtccctccgtacgtacctattcctcgtgggcctccgaggtctgagtatggagttctagtatttattacgtgacctagcttcgtagtcgccgacgggcggacgaacgtaagtttacgggtgttaccggacggtacggtaccgtaagggtccgacccgtaccgtaacggtccacggtacccgaacggtcccgtaccggcccccgttaccggtacctaccgttccgtccgttcccccg

SEQ ID NO: 184188 - DNA, 613 bp, Homo sapiens
  misc_feature: GYAE6OF02F99MC.33.45.E01.1.454.CMB.1.raw
  modified_base (228)..(228): a, c, t, g, unknown or other
  misc_feature (228)..(228): n is a, c, g, or t
  modified_base (419)..(419): a, c, t, g, unknown or other
  misc_feature (419)..(419): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggttctgggcccagtctgccctgactcagcctccctccgcgtccgggtctcctggacagtcagtcgccatctcctgcactggaaccngccgtgacgttggtgttataagtatgtctcctggtaccaacagcaccaggcaaagcccccaaactcttgatttatgaggtcactgagcggccctcgacggggtccctgatcgcttctctggctcaagtctggcaacacggcctccctgaccatctctggctccgagctgagatgaggtctgattattacgngcagctagtatgcgaggcggactaaacgtaagttttaaggggtcgttaccgggacgggtaacggggaaccgtaacggggtacgtaacccggttaccgtaaacggttacccgaacggacccccgaaagggtcccgtacccggtccccccggttacgggtaccctaacccgtttccgttaccgtttacccccccgg

SEQ ID NO: 184189 - DNA, 557 bp, Homo sapiens
  misc_feature: GYAE6OF02HWL1R.33.45.E01.1.454.CMB.1.raw
  modified_base (366)..(366): a, c, t, g, unknown or other
  misc_feature (366)..(366): n is a, c, g, or t
  modified_base (473)..(473): a, c, t, g, unknown or other
  misc_feature (473)..(473): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcacccaggcaaacgcccccaaatcttgatttatgaggtcactgagcggcctcgacggggtccctgatcgcttctctggctcaagtctggcaacncggcctcctgaccatctctgggctccgaggctgaggatgaggtctagtatttattactgcagtctacgtatgcgaggcgacaaacgtaagtttaagggtgttcgggnggagggaccaggtcgaccgtccgtaagtccgacgcccgaaggcctaccggccccgtcggtacctaccgttcgtccgttcccccg

SEQ ID NO: 184190 - DNA, 618 bp, Homo sapiens
  misc_feature: GYAE6OF02GDCUU.33.45.E01.1.454.CMB.1.raw
  modified_base (223)..(223): a, c, t, g, unknown or other
  misc_feature (223)..(223): n is a, c, g, or t
  modified_base (314)..(314): a, c, t, g, unknown or other
  misc_feature (314)..(314): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggaagggactggagtggattgcctatattcattatgattggtccaccaatcgcaacccctcctcaagngtcgagtcaccatgtcagtggacacgtccaagaaccagttcctccctgaacctgaagtctgtgaccgccgcggacacggccatgtatttcngtgcgagaggtggtttcggctcccgagacgaggcggctaggtcgggtatcatcgaccacgtggggccagggaactccgtggtccaccggtctcctcacgcctccaccaacgggcccactccggtccttcccccgtcggccaccctccctccaacgacgccacctcgtcggggccacgacgccggcccgtcgggcctcggccctgggtccaacgggtacctaccgttcccgaaggttcggttacggttcggttaccgttggaacggtccggggtaccgttcggggaccgtaacggggccgaccgg

SEQ ID NO: 184191 - DNA, 519 bp, Homo sapiens
  misc_feature: GYAE6OF02HEOHR.33.45.E01.1.454.CMB.1.raw
  modified_base (226)..(226): a, c, t, g, unknown or other
  misc_feature (226)..(226): n is a, c, g, or t
  modified_base (301)..(301): a, c, t, g, unknown or other
  misc_feature (301)..(301): n is a, c, g, or t
  modified_base (321)..(321): a, c, t, g, unknown or other
  misc_feature (321)..(321): n is a, c, g, or t
  modified_base (395)..(395): a, c, t, g, unknown or other
  misc_feature (395)..(395): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtggttataagtatgtctcctggtaccaacagcaccaggcaaagcccccaaatcttgatttangaggtcactgagcggccctnacggggtccctgatcgcttctctggctcagtctggcaacacgcctcctgaccatctctgggctcgagctgacgntgagctgattatactgcagcttcgtatgcacgggcgacaaagtagtttaagggtcgttcggcggaggacaaggtcgacgtcgtaagtcagcccaaggcctcgccctggtccacgtctcgtcccc

SEQ ID NO: 184192 - DNA, 581 bp, Homo sapiens
  misc_feature: GYAE6OF02GNKPQ.33.45.E01.1.454.CMB.1.raw
tcagtacacacactcacgaccggtgctcgatttagtgagtcagtaagggaaaggggggggtctcaggaggcagaactctgggtgtctcaccatggcctggatccctctacttctccccctcctcactctctgcacaggctctgcggcctcctacgagctgacacagccaccgtcggtttctgtgtcactgggacaggacggccaggatcacctgctcgtggagatgcagttcgaccaaaagccaatacgctttaagttcggtacccagcagaagccaaggccaggcccctgtactgataatatacaaagagaatggagacggccctagagggactcccgtagagacgtattccgccggactacaatgacaggacaacagtcacgttgacagtcagtgactcgaggcaaggaacgacgagctagactatacacgtcgccactcgacggcgacctacgaggtaggtagggtcgggttcgttacgggcggtaacgggacctaggttcgaccgttccgtaaggtaccacgcccgaaggtccgtaccggtcccccgtaggtaccaaccttccgtacgttacccccg

SEQ ID NO: 184193 - DNA, 638 bp, Homo sapiens
  misc_feature: GYAE6OF02IXSH6.33.45.E01.1.454.CMB.1.raw
  modified_base (303)..(303): a, c, t, g, unknown or other
  misc_feature (303)..(303): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcaccaggcaaacgccccaaatcttagatttangaggtcactgagccggcctcgacgggtccctgatcgcttctctggctacagtctggacaacgacggcctcctgacctactctcgtcgggcctaccgaggtctaggaggtagtggacggtctaggtaactttattacgtgctagtccttacgtatcggacgtacgggaccgaactaaacgttaaggttttaacggggtcggttacgggacgggtaacgggaaccgtaagggtcgaacccgttacgtaaacggtccgaaccggtacccgtaacgggtcccgttaccccggtaccccggtaccggtaccctaccgttacccggttccccgttcccccg

SEQ ID NO: 184194 - DNA, 575 bp, Homo sapiens
  misc_feature: GYAE6OF02GZSBE.33.45.E01.1.454.CMB.1.raw
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcaccaggacaaacgcccccaaactcttagatttangaggtcactgagccggcctcgacgggtcccngactcgtcttctcgtggctccgaagtctcggacaaccgacggtccctccctgaccatcctcgtcggcctcgaggctggagatgagctgattattactgcagtctcgtatgcgaggcgactaagttaaggttagggtcgtacgggacggaacggacgtaggtccgtaccgtacgtaacgtcgaacgaccgaacggtcctacccggtccccgtggtacctaccgttccgtccgtccccg

SEQ ID NO: 184195 - DNA, 608 bp, Homo sapiens
  misc_feature: GYAE6OF02JBKUD.33.45.E01.1.454.CMB.1.raw
  modified_base (228)..(228): a, c, t, g, unknown or other
  misc_feature (228)..(228): n is a, c, g, or t
  modified_base (248)..(248): a, c, t, g, unknown or other
  misc_feature (248)..(248): n is a, c, g, or t
  modified_base (271)..(272): a, c, t, g, unknown or other
  misc_feature (271)..(272): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtggttanaagtatgtctcctggtaccaacnncaccaggcaaacgccccaatctagattatgagtcactgagcggcctcgacgggtcctgatcgcttctctggctcaagtctggacacgacgcctcctgaccatctcgtcggcctccgaggtctggacggtatggagctagtacttatacgtgactacgtctcgtagtcgcgagggccgactaaacgttaaggtttaacgggtcgttacgggacgggtaacgggtaaccgtacggtacggtacccgttaccggtaaacggtccgaacggaccccgaaggtcccgttacccggcccccgttacggtaccctaacccgttccggttacccgttacccccg

SEQ ID NO: 184196 - DNA, 663 bp, Homo sapiens
  misc_feature: GYAE6OF02HTE2C.33.45.E01.1.454.CMB.1.raw
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtntgtctctggtaccaanagcaccaggcaaacgccccaaactcttgatttatgaggtcactggacgcggtccctcgacggggtccctgactcgctttctctggctccgaagtctaggacaacgacggcctccctagacctagtcctcgtcgggcctcccgagggtcctagggaggtagtggacggcttaggtaactttaagttactgtaccgtagtccttacgtatcggacgtacggggaccgacctaaacgttaaggttttaaggggtcggtttaccggggacgggtaagggaacccgaaggggttcgtaacccggttaaccggttaacggtaccgaacggtacccgtaacgggtcccgtaccggtcccccgttacggttcccgacctttcccggtacccgttaacccccg

SEQ ID NO: 184197 - DNA, 562 bp, Homo sapiens
  misc_feature: GYAE6OF02HG6FP.33.45.E01.1.454.CMB.1.raw
  modified_base (302)..(302): a, c, t, g, unknown or other
  misc_feature (302)..(302): n is a, c, g, or t
  modified_base (409)..(409): a, c, t, g, unknown or other
  misc_feature (409)..(409): n is a, c, g, or t
tcagtacacacactcacgaccggtgctcgatttagtgagtcagtaagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcaccaggcaaacgcccccaaatcttgatttangaggtcactgagcggccctcgacggggtccctggactcgcttctctggctccaagtctggccaacgacggcctccctgaccatctcgtgggcctccgaggctgaggntgaggctgattatactgcagctcgtatgcaggcgacaacgtaagtttagggtcgttcgggacggagggacctaagggtcgacccgttacgaagtccaacggcccgaaggtcctccggacccccgtcggtaccaccttccgtaccgttcccccg

SEQ ID NO: 184198 - DNA, 658 bp, Homo sapiens
  misc_feature: GYAE6OF02I0HYH.33.45.E01.1.454.CMB.1.raw
  modified_base (228)..(228): a, c, t, g, unknown or other
  misc_feature (228)..(228): n is a, c, g, or t
  modified_base (249)..(249): a, c, t, g, unknown or other
  misc_feature (249)..(249): n is a, c, g, or t
  modified_base (271)..(271): a, c, t, g, unknown or other
  misc_feature (271)..(271): n is a, c, g, or t
  modified_base (303)..(303): a, c, t, g, unknown or other
  misc_feature (303)..(303): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtccgcatctcctgcactggaaccngccgtgacgttggtggttaanagtatgtctccgtggtaccaangcaccaggacaaacgccccaaatctgatttangagtcagtgacgcgcctcgacgggtccctgactcgtcttcgcgttggcctaccgaagttccgtacggacaaaccgccggtcccttacccgtacgaaccctacttccgtcgtacgggtcctccgaacggtccgtaggacggtacgtggacggtctacgtatttacgtttcgttcgttacacggttcgaacgggtacttcggaccgtacggaccggtaagtacgggtaccgtaagggtttacggggttaacggtttaccggggacggggtaacgggtaccgtaggttaccggtacccgtacgtaacgtcgacgacccgtacggccgtccgcccgttcggtactaccgttcgttcccg

SEQ ID NO: 184199 - DNA, 753 bp, Homo sapiens
  misc_feature: GYAE6OF02G1ON7.33.45.E01.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccngccgtgacgttggtgttanaagtatgtctcctggtaccaacagcaccaggacaaacgcccccaaatcttagatttatgaggtcactggacgccggccctcgacgggtccctgactcgtcttctcgtggcctaccgaagttcgtcggaccaaccgaccggtcccttcccgtacgaccctacgttccgttccggtacgggtccctacccggaacgggtcccgttagggaacggtacgttacgggacggtccgttaggttaacttttacgtttaaccgtggaccgtagtccttacggtattcggaccggacgggacccgtaacgtaaacgttaaagggtttttaacggggtcgggtttaccggggacgggtaaacggggtaacccggtaacgggttaccggtaacccggttaaccggttaacggtacccggtaaccggtaccccggtaaaccgggtcccgttaccccggtccccccggttaccggtaccccgttaccgtttccccggtttaccccgtttacccccccg

SEQ ID NO: 184200 - DNA, 727 bp, Homo sapiens
  misc_feature: GYAE6OF02II2FH.33.45.E01.1.454.CMB.1.raw
tcagtacacacactcacgaccggtgctcgatttagtgagtcagtaagggaaaggggggggggtctcaggaggcagcgctctcaggacgtcaccaccatggcctgggctctgctcctcctcaccctcctcactcagggcacagggtcctgggcccagtctgccctgactcacgccctccctccgcgtccgggtctccgtggacagtcagtcgccatctcctgcactggaaccagccgtgacgttggtgttaataagtatcgtctccgtacggtaccaacacgccacccgaggaccaaaaccgaccccctaaactcttagtatttagtgacggtcacgtgacgtccggcctcggacgggtccctagactcgtcttccgtctcggcctaccgtaacgtcgtacgaccaaacgtaccggtccctcccgtacgtaccctacttcccgttaccggtcgggtaccctacccggacggtcgtagggacggaacgttcgggaaacggtccttaggttaacttttaagttacgtcggtacacgtccgttacgtaagtcggacggacgggaccgtaaccgtaaaagttaacggtttagggtcggttacgggacgggtaacgggtaaccgtaagggtccgtaccggttacgtaacggtaccgacggtaacccgtaacggtcccgttcccggtacccccgttacggtacccgtaaccgttccgttacccggttccccccg

SEQ ID NO: 184201 - DNA, 573 bp, Homo sapiens
  misc_feature: GYAE6OF02F0AR0.33.45.E01.1.454.CMB.1.raw
  modified_base (306)..(306): a, c, t, g, unknown or other
  misc_feature (306)..(306): n is a, c, g, or t
  modified_base (458)..(458): a, c, t, g, unknown or other
  misc_feature (458)..(458): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacagtcagtcgccatctcctgcacgtggaaccagccgtgacgttggtgttataagtatgtctctggtaccaacagccaccaggcaaacgcccccaaactctgtatttangaggtcactgacgcggccctgacggggtcctgatcgtcttctctggctccgaagtcgtggaccaacgcggtcctccctgaccctactcttcgtcgggcctcccgaggtctgggagagtcggaggtctagtaattacttctgcagcttcgtancgcgcggacgactaaacgtaaggtttagggagttcggacggacggacgaggtcgaccgtacgtaagcgacgcccgaagtccgtacgccccgtggtcctcctccgtcgttcccccg

SEQ ID NO: 184202 - DNA, 546 bp, Homo sapiens
  misc_feature: GYAE6OF02G5OHZ.33.45.E01.1.454.CMB.1.raw
  modified_base (444)..(444): a, c, t, g, unknown or other
  misc_feature (444)..(444): n is a, c, g, or t
  modified_base (531)..(531): a, c, t, g, unknown or other
  misc_feature (531)..(531): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagccacccaggcaaacgcccccaaaatcttgatttatgaggtcactgagcggcctcgacggggtccctgactcgcttctctggctccaagtctggcaacgacggcctccctgaccatctcgtgggctccgaggctgaggatggacggctagtatttatactgcagtcctcgtancgcgaggccgacaacgtaagtttacgggtgttcggacggtaggaccaggtcgaccgtctaagcacgccgagctcgacccctggtccncttccgtcgtacccc

SEQ ID NO: 184203 - DNA, 666 bp, Homo sapiens
  misc_feature: GYAE6OF02IA4Q4.33.45.E01.1.454.CMB.1.raw
  modified_base (272)..(272): a, c, t, g, unknown or other
  misc_feature (272)..(272): n is a, c, g, or t
  modified_base (278)..(278): a, c, t, g, unknown or other
  misc_feature (278)..(278): n is a, c, g, or t
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (608)..(608): a, c, t, g, unknown or other
  misc_feature (608)..(608): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcacgcccccgagggaacgggactgggagtggattggcctatattcattatgtattggtccactaatcgaccaacccctcctacaagacgtcgagtcaccatcgtcagtcggacacgtaccaagaacngttccncctgaacctnaagtcngtcgccgcgngacgcggcatgtatttcagtcgcgagtggtttggttccggcctccggagtacggacggcggtacgtacgggttacgggatccgatccggacgtacgtggggaccaggggtactccgtcgggtccaccggtactccctcgaccgtcctacccgaaccgacggtaccctaggttcccggtccttcccccgtgtcccacccgttcccgaccgacgtaccgctaccgtccggtacgggtaccgaccggaccggccgggtcccgtccgggtacgccggtcgtcgggtacgacggtacctacggttccgnggttcggtcgttccggtacgtggtaccgcgggtcggttcgggacggtacggcggtacg

SEQ ID NO: 184204 - DNA, 347 bp, Homo sapiens
  misc_feature: GYAE6OF02FQ6WR.33.45.E01.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (338)..(347): a, c, t, g, unknown or other
  misc_feature (338)..(347): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagccctccctccgcgtccgggtctcctggacngtcagtcgccatctcctgcacgtggaccngccgtgacgttggtgttatagtatgtctctggtaccaacagccaccgaggcaaacgcccccaaaactcttgattatgaggtcactgagcgggctggcaaggcgcaatgnnnnnnnnnn

SEQ ID NO: 184205 - DNA, 595 bp, Homo sapiens
  misc_feature: GYAE6OF02HUHR7.33.45.E01.1.454.CMB.1.raw
  modified_base (227)..(227): a, c, t, g, unknown or other
  misc_feature (227)..(227): n is a, c, g, or t
  modified_base (251)..(251): a, c, t, g, unknown or other
  misc_feature (251)..(251): n is a, c, g, or t
  modified_base (266)..(267): a, c, t, g, unknown or other
  misc_feature (266)..(267): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
  modified_base (393)..(393): a, c, t, g, unknown or other
  misc_feature (393)..(393): n is a, c, g, or t
  modified_base (428)..(428): a, c, t, g, unknown or other
  misc_feature (428)..(428): n is a, c, g, or t
  modified_base (571)..(571): a, c, t, g, unknown or other
  misc_feature (571)..(571): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactcgaggcacgagggtcctgggcccagtctgccctgactcagcctccctccgcgtccggtctcctggacagtcagtcgccatctcctgcactggaaccngccgtgacgttggtgttataagtntgtctctgtaccacnncaccaggcaaacgccccaaatctgatttatgagtcatgagcggcctcgacgggtcccngatcgcttctctggctccaagtctggcaacgccgtcctccngacctntctcgtggctcnggtctgagntggagctagtattactactcgctacgtcgtacgtntcggcgacggcgaacgtaaacgttaaggtttacgggttcggttcgggacggtaacgggaaccgtacggttaccggtaccgttaaccgtaacggtaccgaacggacccgtaagggtcccttaccggtcccccgttcggttaccnccgttcccgttcccggttaccccc

SEQ ID NO: 184206 - DNA, 825 bp, Homo sapiens
  misc_feature: GYAE6OF02JB3E6.33.45.E01.1.454.CMB.1.raw
  modified_base (202)..(202): a, c, t, g, unknown or other
  misc_feature (202)..(202): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacacgggtcctgggcccagtctcgccctgactcacgcctccctccgcggtccggtctcctggacngtcagtcgccagtcctccgtgccgactacgggaaccacggtccgtaggtccgggtttgggttaggtttaaactaaagttagttcgttccgttccgttacggttaacccaacgacgtacccaacccggtagggaaccaaaacccggtacccccctaaaacgttcgttaacgtaacgtttttaacgagggtaacggtacctacgtacggacgggtccggtccccgtacggtacggggtccctaggttactccggttcctttaccgtgtcggtcctaacgtagttaccgtcggaacctaaccggtccgtcccgtaccgtacggaaccctcttacgttcgtacggcctaccggacggctaggggacggtacgttacggagtcgttacgttacgtttacttacgacggtcgaccgttcttagtactcggacggtacgggacgtaacctaaaggtttaaacgggtttacgggtcgggttaccgggacgggtaaaccgggtacggtacgggttaccggaaccgttacccggtaaaggttaccggaacccggtaccggttaaccggttccggttccccggtacccgtttccggaaccgtttaccggtttcccgttaaccccggttaccccc

SEQ ID NO: 184207 - DNA, 674 bp, Homo sapiens
  misc_feature: GYAE6OF02FL7IV.33.45.E01.1.454.CMB.1.raw
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagcccccagggaagggactggagtggattgcctatattcattatgattggtccacaatcgccaacccctcctcaagagtcgagtcaccatgtcagtggacacgtccaagaaccagttcctccctagaaccctgaagtctgtcgaccgccgacggacacggccagtgtatttctgtcgcgaggaggttggtttcggccgtcccggagacggaggcggctagggtacggtatcagtcgaccacggtgggccgagggaactccgtggtcctacccgtctccgtcacgccctacccgaaccgaaccggccccgaacgttcccggttccctttcccccgtcgggacccctaccccttccctacccgaaacgtaccgcccgtacccgtccggtcggggaccaccgacggcccggtcccggtccgggcctccggccgtcgggtaccgtaacgggtcccttaaccgttccgtaaggttcgttcggttacgttaccgtggacgggtccgggtcgtacgggaccgtacgggcgtaacg

SEQ ID NO: 184208 - DNA, 725 bp, Homo sapiens
  misc_feature: GYAE6OF02HT8CG.33.45.E01.1.454.CMB.1.raw
  modified_base (199)..(199): a, c, t, g, unknown or other
  misc_feature (199)..(199): n is a, c, g, or t
  modified_base (247)..(247): a, c, t, g, unknown or other
  misc_feature (247)..(247): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagccctccctccgcgtccggtctcctggacngtcagtcgccatctcctgcactggaaccagccgtgacgttggtgttanaagtntgtctctgtaccancgcaccagacaacgccccaatctgtaatttatgacggtcactgacgccgtcccgtccggtacgggtccctggtactcgtccttcctcgtcggtcctaccagttcgtcggaccaaaccgcggtcccttcccgtaccgacctactccgtcgtcgggtcctaccggaggtccgtagggaacgggtatcgggtacggtaccgttagttaagttttacgttacccgtcgtacgtacgttcgttacgtagtacggccgacggggtaccgtaaccgtaaaacgttaaagggtttttacggggtacgtttaccggggacggaaacgggaccggtaagggttcccgggtaaccggttacccgggtacggtacccggaaccggtaccccgtaacgggtacccccgttccggtaccccccggtaccggttaccccgtaccgtttccccggttccccgtttaaccccccgg

SEQ ID NO: 184209 - DNA, 688 bp, Homo sapiens
  misc_feature: GYAE6OF02IPA2E.33.45.E01.1.454.CMB.1.raw
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcacgcccccagggaagggactgggagtggattgcctatattcattatgattgtccaccaatcgcaacccctccctcaagagtcgagtcaccatgtcagtggacacgtaccaagaaccagttcctccctgaaccctgaacgtctgtcgaccgccggcggacaccggccatgttacttttcgtgtgcgaggtagggttggtttccggcgtccccgagacgaggcggtctagacgggtntacgataccgaccnggtgggccgaagggaactccgtcggctaccgtctccctgcgccctaccaccgaacgggccctacgtccggttcccttcccccggcgtacccctaccccttccctacccgaaacgaccgccctacccgtccgggtaccgggggacccaacggccggtacccgggccccggtgggcccgttccgggcccggttacgggtaccgtaaaccggacctttaaccgttccgtaacgggttacgttggttcgtacgtcggtacgggccggggtgtaccgggacgtacggggccgtaacgg

SEQ ID NO: 184210 - DNA, 603 bp, Homo sapiens
  misc_feature: GYAE6OF02GIN19.33.45.E01.1.454.CMB.1.raw
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
  modified_base (384)..(384): a, c, t, g, unknown or other
  misc_feature (384)..(384): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
tcagtacacacactcacgaccggtgctcgatttagtgagtcagtaagggaaagggacagggtctccgaagccttcggagaccctgtccctcacctgctctgtctctggtggctccctcagtacttactactggaactggattcggcagccccagggaagggactggagtggattgcctatattcattatgattggtccacaatcgcaacccctcctcaagagtcgagtcaccatcgtcagtcggacacgtaccaagaaccagttcctccctgaacctgaagtctgtcgaccgccgcggacacggccatgtacttctgtncgagnggttggttcggctccgagcgaggcgctagtacggatcatcgaccngtgggcagggatcgngtcnccgtntccncncgccncaccgacggccacgtcgtcccttccccgtgcccacccttcctaccaacgtcgacctacccgtcggtcggggtccacgaccggccggtccccggtgggtctccggccgttacgggtaccgtaacggtaccttaccttaccgacggttcgttggttcgtaacgtggtacgcggggtacgtcggacggaacggtccgtaacg

SEQ ID NO: 184211 - DNA, 651 bp, Homo sapiens
  misc_feature: GYAE6OF02J2AY8.33.45.E01.1.454.CMB.1.raw
  modified_base (219)..(219): a, c, t, g, unknown or other
  misc_feature (219)..(219): n is a, c, g, or t
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
tcagtacacacactcacgaccggtgctcgatttagtgagtcagtaagggaaaggggggggtctcaggaggcagcgctctcaggacgtcaccaccatggcctgggctctgctcctcctcaccctcctcactctagggcacagggtcctgggcccagtctgccctgactcagcctccctccgcgtccgggtctcctggacagtcagtcgccatctcctgcnctgaaccngcctgacgttggtgttanaagtntcgtctctgtacacagcaccaggcaacgccccaaatctgatttangaggtcacgtgagccgtccctcggacgggtcccctagacgtctcgttctacgtcggcctacctaacgtctcggacacgtaccggccttacccgacacctacgttccttaggtacgggtcctaccgacggtactagggaccgtagttacggacgtactacgtatttaactacgtcgaccaggtcctaacgtcgtcgacgacggtaccgaattaaaccgttaggttacgggttacggtccggtacggaaacgggtaccaacggggttctaaccggtaccgtaacggtccaaggccccgtaagcccgttaccggtcccccgtacgttaccgtacccgtttacccgtcccgttcccccgg

SEQ ID NO: 184212 - DNA, 730 bp, Homo sapiens
  misc_feature: GYAE6OF02FVCLN.33.45.E01.1.454.CMB.1.raw
  modified_base (196)..(196): a, c, t, g, unknown or other
  misc_feature (196)..(196): n is a, c, g, or t
tcagtacacacactcacgaccggtgctcgatttagtgagtcagtaagggaaagggggggggtctcaggaggcagctctctcaggacgtcaccaccatggcctgggctctgctcctcctcaccctcctcactcagggcacgagggtcctgggcccaggtctgccctgactcagcctccctcgcgtccgggtctccgnggacagtcagtcgcatctctgcacgtggaaccgtccgtgtacgttggtagttaataagtctcgtcctacgtcggtaaccaacgacgaccaaccgaacggaaccaaaaccgacccctaaacgttcttagtaactttagtacggtacggtaccacgtacgacggccggtaccgtcggtacgggtccgtacgacgttccgtcttccgtcgtcggactaccgtacgtccgtacggacaaccggtaccgtcctaccgtacgtaaccctacgttccgtacggtcggtcccgtaccgaggtcgtacggaacggtagtacggacggtacgtagttaacttaacgttacgtacgtacgtacgtccgttacggtagtacggtacgacggaccgtaacgtaaacgttaaacggtttacgggtacgggttacgggacgggtaacgggtaacgtacgggtaccgtaccggttacgtaacgtaccgtaacggtaccgtaacggtccgtaccgtacccggttacgtccgtaccgttccgtacccgtccc

SEQ ID NO: 184213 - DNA, 666 bp, Homo sapiens
  misc_feature: GYAE6OF02JDJ5E.33.45.E01.1.454.CMB.1.raw
  modified_base (274)..(274): a, c, t, g, unknown or other
  misc_feature (274)..(274): n is a, c, g, or t
  modified_base (451)..(451): a, c, t, g, unknown or other
  misc_feature (451)..(451): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatcctcctgcactggaaccagccgtgacgttggtgttataagtatgtctccgtggtaccaacganccacccaggaccaaacgacccccctaaagttctagtatttatggaggtcactgagccggccctcgacgggtccctgactccgtacttctcgcggtcctaccgtagtcctcggacaaaccgccggtccctcccgtacgacccattccctacgtcggtcctaccgcgtcgtaggaggtntcgaggtctagtacgtttacttacgtcgacacgtccgttactgtcgacgtacgggtaccgagtaaacggtttaaagttaacggggttacgttacggggacggaacgggtaccgtaacggtaccgaccgtaccgtaacggttaccgacgtacccggtaacgtcccggtaccgtccccggtaccgtaccgttaccgttcccgttccgttaacccccg

SEQ ID NO: 184214 - DNA, 919 bp, Homo sapiens
  misc_feature: GYAE6OF02H7KLN.33.45.E01.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (403)..(403): a, c, t, g, unknown or other
  misc_feature (403)..(403): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctctcactcagggcacagggtcctgggcccagtctgccctgactcagccctcctccgcgtccgggtctccgtggacagtcacgtcgccatccgtcctgaccacgtcggaacccagtccgtagtacggtttggtaggttataagtntgtcttccgtggtaccanagtaccaccgaggacaaaccgaccccctaaatcttagtaattttagacggtaggtacctacgtaggacggcccggtccctacggacgggggttccctaggaccgttcgtccgtttacnccgtcggtccttaacccgtaaggttccgtacggacctaaccggtccgtcccttaccccgtacgtacccctacgttcccgttcgggttacccggggtacccttacccggtagggtacccgtttaggggtaaccggtaacgtacgggtaacggtccgttaaacgggtttaacttttaacggtttaaccgtcggtaaccgtacggtttaccgttaaccgggtacgtaaccgggtcggttaaaccggggtacccggtaaaccgttaaaacgggtttaaaccggggtttttaacggggttccggttaaaccggggggtaaccgggtaaaacccgggggtttaacgtaaaccgggtttacccgggtaacccggttaaccggtttaaacccggtaaccggaacccggttaacccccggtaaccggggtcccccgtttaaccccggggttccccccggttaaccggttttaaccccggtaaccccgtttttaccccggttcccccgggtttaaaccccccccgg

SEQ ID NO: 184215 - DNA, 596 bp, Homo sapiens
  misc_feature: GYAE6OF02FKPJM.33.45.E01.1.454.CMB.1.raw
  modified_base (423)..(423): a, c, t, g, unknown or other
  misc_feature (423)..(423): n is a, c, g, or t
  modified_base (439)..(439): a, c, t, g, unknown or other
  misc_feature (439)..(439): n is a, c, g, or t
  modified_base (466)..(466): a, c, t, g, unknown or other
  misc_feature (466)..(466): n is a, c, g, or t
tcagtacacacactcacgaccggtgctcgatttagtgagtcagtaaggggaaagggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtgttataagtatgtctctggtaccaacagcaccaggaccaaaacgtcccccaaaatcttacgtatttatggagtcatgagccggcctcgaggggtcccctgatccggtctttactcgtggtcctacaagtcgtcggtacaacgaccggtcctccctacgacactcttcgtgggccttccgnggctggagagtgaggntagtactattactgctagctatgtcgngtaggcgacgtaattaagtttacgggtgtaccgggacggtacggaacgtaggtccgtaccgtacgtaagaccgacgtaccgtaacggtcgtaccgtccccgtacggtcacccgttcgtccgttacccccg

SEQ ID NO: 184216 - DNA, 597 bp, Homo sapiens
  misc_feature: GYAE6OF02GMW7K.33.45.E01.1.454.CMB.1.raw
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
  modified_base (434)..(434): a, c, t, g, unknown or other
  misc_feature (434)..(434): n is a, c, g, or t
  modified_base (475)..(475): a, c, t, g, unknown or other
  misc_feature (475)..(475): n is a, c, g, or t
  modified_base (563)..(563): a, c, t, g, unknown or other
  misc_feature (563)..(563): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcacgccctcctccgcgtccgggtctcctggacagtcagtccgccatcctcctgcacgtcggaaccgccgtgacgttggtagttatagtatgtctccgtgtaccaacngccaccaggacaaacgacccccaaattcttgatttangacggtcacgtggacgccgccgtgacggggtccctgactcgtcttctcgtcgcttaccagtcgtggacaacnccggtccctccgtagacctatcctcgtcggcctaccgaggctaggacgagngaggtctagtactttatctcgtacgtgtctcgtagtgacgnggacgactaacggttaaagtttcgggtacgtcggaggaacggtactacgggaccgtaacgtctaacggacaccgggaactcggtcccncggtcccctgccgtaccgttcgtcccgtcccccg

SEQ ID NO: 184217 - DNA, 790 bp, Homo sapiens
  misc_feature: GYAE6OF02FGXVE.33.45.E01.1.454.CMB.1.raw
  modified_base (277)..(277): a, c, t, g, unknown or other
  misc_feature (277)..(277): n is a, c, g, or t
tcagtacacacactcacgaccggtgctcgatttagtgagtcagtaagggaaagggacgagggtctccgaagccttcggagaccctgtccctcacctgctctgtctctggtggctccctcagtacttactactggaactggattcggcacgcccccgagggaaggactggagtggattgcctatattcattatgtattggtcccaaccaatccgccaaccccctcctacaacgagtcgagtccaccatgtcagtcggacacgtcaagaaccagttccncctagacctgaagttctgtacgaccgccgacgggaacaccgggcctatcgttaacttcgtgtgacgagtacgggttcggtttccggccgttacccggaggtaccggacgggtccgacgtacggttaacggggtatcgtaagtcccgaccgtacgggtcgggggaaccctaggggaaaccttcccggtaggtaccccgtacccgttccgtaccccgtacgtaccgtacccctacccggtaaaccggaaccggggtccccctaaggttccccggtttaccccgttccccccgacggtacccccttaccccgttccctaacccgaacgtacccgacccgttacccgtccgggacggggttaccacggtacccgggtcccggtccggttccgggccgtcggtacccgggttacggtacgaaaccgggttcccttaaccggtccgtaagggtccgtttcggtaaccggttacgtacgggtacgggccggggttactacgggaccgacgggtctaaccg

SEQ ID NO: 184218 - DNA, 832 bp, Homo sapiens
  misc_feature: GYAE6OF02FW4AR.33.45.E01.1.454.CMB.1.raw
  modified_base (228)..(228): a, c, t, g, unknown or other
  misc_feature (228)..(228): n is a, c, g, or t
tcagtacacacactcacgaccggtgctcgatttagtgagtcagtaagggaaagggggggggtctcaggaggcagcgctctcaggacgtcaccaccatggcctgggctctgctcctcctcaccctcctcactcagggcacagggtcctgggcccagtctgccctgactcagcctccctcgcgtccgggtctcctggacagtcagtccgccatcctctgcactggaaccngccgtgacgttggtaggttataagtatgtcctcgtcgtaccaacacgacaccgaggaccaaaccgaccccctaaacttcttagtactttataggtacggtcctacgtcggacggcccggtacccgtcggtaccggggttcccgtagtacttccgtcctttcgtcgtcggtcctaccgtaaggtccgtacggacctaacccgacccggtcccttaccccgtagtaccctaacgttccgttaccggttcgggtacccgtaccggtacggtaccgttgggaacgggttacgtacgggtacggttacgttaaggttaacttttaacggtttaaccggttacggtaccttaacggttaccggtttacggttaacggtcggtaccgggtaccggggaccgttaaaccgtaaaacggttttaacggggttttaacgggttcggggttaaaccggacggggtaaaccgggtaccggttaacgggttaccggtaacccgttacggttaaaccggtaccggtaacccggtaaccgttaacgggttcccgttaccccggtaccccggttaccgttaacccgtccccggtttaccggttcccgtttaaccccccgg

SEQ ID NO: 184219 - DNA, 672 bp, Homo sapiens
  misc_feature: GYAE6OF02IY0F0.33.45.E01.1.454.CMB.1.raw
  modified_base (200)..(200): a, c, t, g, unknown or other
  misc_feature (200)..(200): n is a, c, g, or t
  modified_base (204)..(204): a, c, t, g, unknown or other
  misc_feature (204)..(204): n is a, c, g, or t
  modified_base (207)..(207): a, c, t, g, unknown or other
  misc_feature (207)..(207): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
tcagtacacacactcacgaccggtgctcgatttagtgagtcagtaagggaaaggggggggggtctcaggaggcagcgctctcaggacgtcaccaccatggcctgggctctgctcctcctcaccctctcactcagggcacagggtcctgggcccagtctgccctgactcagcctccctcgcgtccggtctcctgacagtcngtcnccntctcgtncagtgaaccnggcctagtacgttggtgttaataaggtgtntacctccgtagtaccaactcgccaccgtagaccgaaaccgcccctaaacttntactacgttagngtacggtctacgtgacgtccggacccgtcgtaccgggtccgtagtacgtcgttccgttacctcggttcggacccttaacgaccgtttcggaccgtaacgtaacccgaccggtcccttacccggtccgtacgttcccttacgggtccggtctaccggtgaccgttcgacgtgtcggagtcgtagttattattgtagcgttagttctaacggtacgacgaacaacgaactattctcgttacggtcggacggtacgaccgtagtacgtaccgtactaccggttacgaccgtacgtacccgacgtccccgtaccgtacccgtccgtaccgttcctacccggttcccgtccccgtaccg

SEQ ID NO: 184220 - DNA, 803 bp, Homo sapiens
  misc_feature: GYAE6OF02J0GK4.33.45.E01.1.454.CMB.1.raw
  modified_base (252)..(252): a, c, t, g, unknown or other
  misc_feature (252)..(252): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
tcagtacacacactcacgaccggtgctcgatttagtgagtcagtaaggggaaagggggggggtctcaggaggcagcgctctcaggacgtcaccaccatggcctgggctctgctcctcctcaccctctcactcgagggcacgacgggtcctgggaccctgtctcgcccttgacctcacgtccctcccgtccggcggtccgggtctccgcggactagtcagtccgcctatccgtcctgaccacgtacggaaccnggcccgtgtacggttggtacgtttatacgtacgtcgtaccttcggtacgtaaccacgtagaccccaccggaggacccaaaaccccggacccccttaaagttccgttagttaattacggtacggtacgtaccgtagtacggaccggtcccggtccccggtacgggtacccggttcctacgtaccgtcttcccgttacgtggtacccgtctacccgtaggtccggtcgacccgacgttcccgcctcccgtcaacctcgttcggccgtacgtcgtaccgtgacggtcggaacgcgtcggtacgtcgttagttaacgtacgttacgtcgacgtaggtccgtcgtagtaccgnggnggtacccgtaaacgtacggtttaaccgggttggttacccgggtaacgggacggtaccgggtaaccggttcgggtacccgtaccggttaaccgggaccggttaaccggaccgggtaacccggttaccggacccggttacccccggttcccgggtaacctttaccgtaccccgggtttaccccttaacccgggttccccccg

SEQ ID NO: 184221 - DNA, 666 bp, Homo sapiens
  misc_feature: GYAE6OF02HR8TN.33.45.E01.1.454.CMB.1.raw
  modified_base (202)..(202): a, c, t, g, unknown or other
  misc_feature (202)..(202): n is a, c, g, or t
  modified_base (322)..(322): a, c, t, g, unknown or other
  misc_feature (322)..(322): n is a, c, g, or t
  modified_base (328)..(328): a, c, t, g, unknown or other
  misc_feature (328)..(328): n is a, c, g, or t
  modified_base (360)..(360): a, c, t, g, unknown or other
  misc_feature (360)..(360): n is a, c, g, or t
  modified_base (380)..(380): a, c, t, g, unknown or other
  misc_feature (380)..(380): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagtacacacactcacgaccggtgctcgatttagtgagtcagtaagggaaaggggggggtctcaggaggcagcgctctcgaggacgtcgaccaccatggcctgggctctgctctcctcaccctctcactcagggcacgagggtcctgggcccagtctagccctgactcagccctcctaccgcgtccgggtctccgtggacngtcagtcgacatcctctagcagtcggaaccggtccgtggacgttggtagttaatatatcgtcttccgtacgaaccaacgacgcaaccgagtacaaaccgaccctaagtctagtacttagngacgtnacgtgcgacgtccgtaggacgggtctgacgtntcttcagtcgactcgagtcngacacgcgaccttccganaccgttcncgacgccgtgacgtcgtaggacgtgagtcgngttagtaactttagacgtcggacacgtccgtagttgaccgtaggccggacgtaaccgtaagttaaggtttaacgggtcggttaccgggaacgggaaccggaacggttaaggtaccggttaaccgttaacggttacggtacccgaacggaaccggttaacccggccgtttaaccgggccccccgtttacgggtaaccctttaccggttcccgttaccggtttccccccgg

SEQ ID NO: 184222 - DNA, 491 bp, Homo sapiens
  misc_feature: GYAE6OF01AQ1BM.51.71.G05.1.454.CMB.1.raw
  modified_base (484)..(484): a, c, t, g, unknown or other
  misc_feature (484)..(484): n is a, c, g, or t
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggatccaggcagaggacgaggctgactatattgtcaatcaacagacaccattggtacttatgtcttcggaactgcgacaaggtcacgtctgggtcagcccaaggccaacccnctgtcac

SEQ ID NO: 184223 - DNA, 273 bp, Homo sapiens
  misc_feature: GYAE6OF01DCOY7.51.71.G05.1.454.CMB.1.raw
  modified_base (271)..(273): a, c, t, g, unknown or other
  misc_feature (271)..(273): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcactctgagcggctggcaaggcgcatagnnn

SEQ ID NO: 184224 - DNA, 503 bp, Homo sapiens
  misc_feature: GYAE6OF01BBD6T.51.71.G05.1.454.CMB.1.raw
  modified_base (238)..(238): a, c, t, g, unknown or other
  misc_feature (238)..(238): n is a, c, g, or t
  modified_base (417)..(417): a, c, t, g, unknown or other
  misc_feature (417)..(417): n is a, c, g, or t
  modified_base (496)..(496): a, c, t, g, unknown or other
  misc_feature (496)..(496): n is a, c, g, or t
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgntatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattatgtcaatcaacngaacaccattggtaactttatgtcttcggaaacttgacgaccgaaggtcaccgtctgggtcagcccaacggccaacccntgctacc

SEQ ID NO: 184225 - DNA, 589 bp, Homo sapiens
  misc_feature: GYAE6OF01CRGCW.51.71.G05.1.454.CMB.1.raw
  modified_base (239)..(239): a, c, t, g, unknown or other
  misc_feature (239)..(239): n is a, c, g, or t
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttattggtaccagcagaagccgggccaggcccctgtgttggtgatgtataaagacactgagaggccctcgagggatccctgagcgattctctggctccaggtcagggacaacgtctacactgtcgactatacgtggtaggtacgtacggacgacgaaggaacggacggagtcggtacgtaacttagtttagttacgtaactaacgtaacaaacgaacgaaccctaaacgttaggtttacgttaacttagttacttacggttaaccgacgtacgaccgtaaacgtacgtaccgtaccgttcggtacgtacgacccgaccgaaccgacccaaaccctcgtcgtaccc

SEQ ID NO: 184226 - DNA, 508 bp, Homo sapiens
  misc_feature: GYAE6OF01B66OD.51.71.G05.1.454.CMB.1.raw
  modified_base (497)..(497): a, c, t, g, unknown or other
  misc_feature (497)..(497): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgtggtgatgtataaagacactgagaggccctcagggatcccgtgagcgattctctggctccgaggtcagggacaacggtcacatggccatcagtggagtccgaggcaggaggacgaggctagactattattgtcaatcaacagacacattggtacttatgtcttcggactgaccgacgtaagtcaccgtctggtcacgacccgaaggcccaacccnctgtcctaccg

SEQ ID NO: 184227 - DNA, 531 bp, Homo sapiens
  misc_feature: GYAE6OF01AMY8X.51.71.G05.1.454.CMB.1.raw
  modified_base (432)..(432): a, c, t, g, unknown or other
  misc_feature (432)..(432): n is a, c, g, or t
  modified_base (519)..(519): a, c, t, g, unknown or other
  misc_feature (519)..(519): n is a, c, g, or t
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcgagggtactcccgtgagcgtattctctggcctccgaggtcgagggacaacggtcaacgattggccatcaggtggacgtccagggcaggaggacgaggctgactattattgtcaatcaacngaacacattacggtacttatcgtcttacggactgaccgacgaacggtcctaccgtcgtcgggtcacgacccgaacggcccaaccccnctcgtcctaccg

SEQ ID NO: 184228 - DNA, 517 bp, Homo sapiens
  misc_feature: GYAE6OF01B8FKD.51.71.G05.1.454.CMB.1.raw
  modified_base (505)..(505): a, c, t, g, unknown or other
  misc_feature (505)..(505): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagacggccctcgagggatcccgtgagcgattctctggctccaggtcagggacaacggtcacattggccatcagtggagtccaggcaggaggacgaggctgactattatgtacaatacaacagacactattgtacttatgtctcggaactgccgaaccaaggtccaccgtcgtgggtccaggcccaacgggcccaaaccccnctggtctacccg

SEQ ID NO: 184229 - DNA, 623 bp, Homo sapiens
  misc_feature: GYAE6OF01A7OCC.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccggaccacggcccctgtgttggtgatgtataaagacactgagacggccctcgagggactccctggacgcgtattctcgtcggctaccgaggtcgaagggacaaacgggtcaacgtagttcggaccagtcgaggtacggacgtcccgaaggtccgaaggaacgggaacgaggtcgtagaaccgttaattagttgtacaaattaccaaacgacgtaaccaccgtaatttacggttaacctttagttgttacttaacggaacttacggaccgaaccgtaacggtaccgtacccgttccggtcgggttaccaccggaccccgtaaacggacccctaaacccccgatccgtccgtaaccccg

SEQ ID NO: 184230 - DNA, 552 bp, Homo sapiens
  misc_feature: GYAE6OF01CLLN9.51.71.G05.1.454.CMB.1.raw
  modified_base (241)..(241): a, c, t, g, unknown or other
  misc_feature (241)..(241): n is a, c, g, or t
  modified_base (310)..(310): a, c, t, g, unknown or other
  misc_feature (310)..(310): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctctcactctctgcacaggctctgaggcctcctattagctgacacagcccaccctcggtgtcagtcgtccccaggacagacggccaggatcacctgctctggagatgcattcgaccaaacgntatgcttattgacagcagaagccggcaggccctgtgtggtgatagtataaagacactgagacggccctnagggactccgngagcgattcncgtggctccaggtcacgggacaacggtcacaagttcggaccagtcaggtaggacgtccgaggcaaggaggacgaggctaggaacttattatgtacaatcaaacagaacaacctagttgtaacttagtcgtacgttacgaactcgacgaacctaaggtccaaccggtcgtacgggtacacggacccaacggaccccaacccactcggtacctaccgttcccg

SEQ ID NO: 184231 - DNA, 276 bp, Homo sapiens
  misc_feature: GYAE6OF01DRY5O.51.71.G05.1.454.CMB.1.raw
  modified_base (272)..(276): a, c, t, g, unknown or other
  misc_feature (272)..(276): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnn

SEQ ID NO: 184232 - DNA, 637 bp, Homo sapiens
  misc_feature: GYAE6OF01CHE2D.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgaccaaaacgatatgacttattggtaccagcagaagccggcacggccctgtgttggtgatgtaataaagacactgagacgccctgagggactcccgtgacgcgtattcctcgtcggcctccgaggtcgaacgggaaccaacgggtcaacgtagttcgggacctagtacgaggttcggaacgtacccgagggaccgaaggaacgggaacgaggctaggtacttaagttattcggtacaatacaacaacgaacctaccgtaagttacggttactttacgtacggttacgttaccggactcggaccgtaaccgtaacgggttcccgtaacccggttccggttcggggtacccaacggtacccccgaaacgggaccccctaaacccccgtacgttccgtcccttaacccg

SEQ ID NO: 184233 - DNA, 275 bp, Homo sapiens
  misc_feature: GYAE6OF01BO13S.51.71.G05.1.454.CMB.1.raw
  modified_base (271)..(275): a, c, t, g, unknown or other
  misc_feature (271)..(275): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctggggcacagcggccctgggctgcctggtcaaggactacttcctcgtagcactctgagcgggctggcaaggcgcatagnnnnn

SEQ ID NO: 184234 - DNA, 584 bp, Homo sapiens
  misc_feature: GYAE6OF01BA1ZA.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccacggcccctggtgttggtgatgtaataaagacactggagacggccctcgagggtactcccgtggacgcgtattctcgtggcctcgaggtcgagggacaacggtcacagttcggcatcgaggtggacgtcgaggcaggaggacgaggctagactattatgtacaatacaacagacacctagttacggttactttagttgttaccgttacggtaactcggaccgtaccgtaacgggtccgacccggttccggtcgggtacctaaccggaccccgtaaaccgggacccccaaacccccgcgttccgtcctacccg

SEQ ID NO: 184235 - DNA, 606 bp, Homo sapiens
  misc_feature: GYAE6OF01BUP2P.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgagacctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagacggccctcagggatcccgtgagcgattctctggctccaggtcagggacaacggtcacgattcgggccatcagtggagtccaggcaggaggacgaggctgactatttattgtctaatcaacagtaaccaaccctagtttacgggttaacctttagttcggttacgtttaccgggaaccttcggaccgtaacccgtaaagggttccctaaccccggttcccggttacggggttacccaaccggacccccgtaaacggggaccccctaaaacccccccgtcgttaccggtcccttaaccccgg

SEQ ID NO: 184236 - DNA, 928 bp, Homo sapiens
  misc_feature: GYAE6OF01C7CY0.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccaggatcacctgctctggagatgctattcgacccaaaccctacttactttactttaagtttcgggtaacccaggaccaaggaaacgacccgaacgggcccaacggggtcccccttggttcggtttggtttagaattaattaagtaaaaaggacctaacgtaggaaggtacgggtacccgtttacgaacggggtactccccgttaggaacgtccgtatttccgtacgtcgggtcccttacccgtaaccgttacggaacggggtaacctaagtttccgggtaccaaacgttagtttacggaaccctaagttacccgaagggttacggggtaaccgttacccggaaagggaccgtaaaacggggaaaacgggtaaccgggaacggggtacccgtttaagggtaaaccttttaacgtttttacccgttaacggttaaccttaaaccgttttccgtttaaccgaaacggttaaccgtaaacgtttaccggttaaacgggtttacgggtttttaaaccttttacggtttacggttttaaccccggttttaaccggggaaaacccggttttacgggggaaaaccccggttaaaacggggtttaccccgttaaaccccgggttttaccccggtttaacggggttaaccccgaacccgggttaacccccccggaaaaaccgggtaccccccccgtaaaaaccccccgttccggtttacccggttaacccccg

SEQ ID NO: 184237 - DNA, 598 bp, Homo sapiens
  misc_feature: GYAE6OF01EL2YI.51.71.G05.1.454.CMB.1.raw
  modified_base (307)..(307): a, c, t, g, unknown or other
  misc_feature (307)..(307): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcgttgaccaaaagaatctgtctttttggaccatcagaggccaggccaggcccctgtattggtcatctatgaggacaccgaanccgaccctccggaactccctagagagagtcgctcggctccgaggtcgagggacaagtcggcctaccgttgacttatccgacgtacgggacccaggagtcgggaacgataggaaggtcgaacctacctagttgttactcgacagacagcgagtaggtagtcgtagggggttccttcggggacgggaaggggacgaagggtccgtacggacccggttcgtggtaccgtcgacggaccccggaaaggcccgttacccggccccccgttagggtccctaccgtccgttaccccgg

SEQ ID NO: 184238 - DNA, 601 bp, Homo sapiens
  misc_feature: GYAE6OF01DV2WN.51.71.G05.1.454.CMB.1.raw
  modified_base (241)..(241): a, c, t, g, unknown or other
  misc_feature (241)..(241): n is a, c, g, or t
  modified_base (588)..(588): a, c, t, g, unknown or other
  misc_feature (588)..(588): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattcgccaaaccgntatgcttattggtaccagcagaacgccggccacggccctgtgttggtgatgtaataaagacactgagacgcctagacgggactcctgagcgtagttctctggctccgaggtcgaagggacacggtcacgtagttcggacctagtcgaggtcgggtacgtccgaagggcgaaaggacgggaaccggtaggtcgttagtaaccttaagtttatttcggtaactaaacgtaccaaacacgtaaccacctagtttgtaactttgtgttaccgttacgaacgtgaccgtaaccgtaacggtccctaccggttccgtgggaccacggacccctaacgggaccccaaccccgtntccgtcctacccg

SEQ ID NO: 184239 - DNA, 646 bp, Homo sapiens
  misc_feature: GYAE6OF01EYQIK.51.71.G05.1.454.CMB.1.raw
  modified_base (239)..(239): a, c, t, g, unknown or other
  misc_feature (239)..(239): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggaccagacggccaggatcacctgctctggagatgcattgccaaacgntatgcttattggtaccagcagaacgccggccaggcccctgtcgttggtgatgtataaagacacgtagagaggccctcgagggactccccgtgacgcgtattcctcgtggcctccgacgggttcgaacggggactaaaccgggtcaaccgtagtttcgggaccctaagtcgaaggttggacgttccgaagggcccaagggtaacgacggaggcgtaggactttatttcgtagttactaattccttacagaactatcgaagttcgttaacttagttacgttccgttaccgggtaaacgttccggggaaacccgtaaagggttcccctaaccgggttcccgttagggtaccctacggacccccgtaaacgggtcccccaaaacccccgtccgttacgtcccttaaacccg

SEQ ID NO: 184240 - DNA, 606 bp, Homo sapiens
  misc_feature: GYAE6OF01C38I6.51.71.G05.1.454.CMB.1.raw
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctggtgtcagtcgtccccaggacagacggccaggatcactgctcgtgganatgcattcgaccaaacgntatgcttataggtaccagcagaacgccggccaggccctgtgttggtagatagtataaagacacgtagagacggccctacgagggactccgtagacgcgtattctcgtcggcctcgaggtcgacggaactacgtcacgtagttcggacagtcgaggtaggacgtcgaggacaggaggacgaggctaggtaacttagttagttcgtaactaatacctaaacaacgtaactaaccctaagtttacggttaacttaagttcgttaccgttaacggtaactcgaccgtaacgaacggttccgtacccgttccgtcggggtacctacggaccccgaaacgggacccccaaccccgtactcgtaccctaccg

SEQ ID NO: 184241 - DNA, 593 bp, Homo sapiens
  misc_feature: GYAE6OF01AZG4P.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaacgccgggccacggcccctggtgttggtgatgtataaaagacactgagacggcccctcgagggtactcccgtgacgcgtaattctcgtcggctccgaggtcacgggacaacggtcacgagttggccatcgagtggagtccgaggcaggaggacgagctagtacttattagttgtacaatacaacgagaactagtactagtttaggttaactttagtgttacgttcggaacttacgaccggtaaaccgtacgggtaccgtaccccggttccgtacggggtaccaaccggtaccccgaaacgggacccccaaaccccgtccgtcgtaaccccg

SEQ ID NO: 184242 - DNA, 692 bp, Homo sapiens
  misc_feature: GYAE6OF01C14PU.51.71.G05.1.454.CMB.1.raw
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctctatgagctgacacagccaccctcggtgtcagtcgtcccaggacagacgccaggatcacctgctcnggagatgcattcgaccaaaacgntatgacttataggtaccagcaagaagccggcacggccctgtgttggtgatgtataaagactactgagacggccctagacgggtatcccgtgagccggatttcgtcgtggtccttcgagggtccaagggaacgtaacggtcaacgtacgttacggaccctaataccgagtacgggtaacgtacccgacgggagaacggacggaaccggaggtccgtaaggaacctttaagtttaggttttacaccttaaaattaccgaaacctacggtaaacctaacccgttaagttttccgggtaaacctttaagttccgttacgttaaccgggtaaacgttcggaaccgtaaaccggtaacgggtacccgacccggtttaccggtaccgggtacctaccggtaaaccccggtaaaccgggtaacccctaaacccccggaacttaccgggtcccttaaacccg

SEQ ID NO: 184243 - DNA, 646 bp, Homo sapiens
  misc_feature: GYAE6OF01E06OM.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagcccaccctcggtgtcagtgtccccaggacagacggccaggatcacctgctctggagatgcattgaccaaaaccgataatgcttattgtaccagcagaagccggccaggcccctgtgttggtgatgtaataaagacacgtgaggacggccctgagggactcccgtgagcgattctctgcctccaggtcagggaacaacggtcactagtcggccatcgaggtaggagtccgaggacgaaggaaggacggaggactaggtaacttaactttattacgtactaaacttacaaacgtaacgaacaaccgtagtttacggttaactttaagttcgttacgtttaccggaaacttcggaaccgtaacccgtaaacgggttccctaacccgggttacccggttcggggtacccaaacccggacccccgtaaacccgggtaacccccaaaaccccccgtaccgttaccggttacccgttaaccccgg

SEQ ID NO: 184244 - DNA, 778 bp, Homo sapiens
  misc_feature: GYAE6OF01DT34H.51.71.G05.1.454.CMB.1.raw
  modified_base (263)..(263): a, c, t, g, unknown or other
  misc_feature (263)..(263): n is a, c, g, or t
  modified_base (349)..(349): a, c, t, g, unknown or other
  misc_feature (349)..(349): n is a, c, g, or t
tcagcgatcgtatacacgaccggtgctcgatttagtgtcgtcgcaagagagaggggggtgggtccaggaggcaagaactctgggtgtctcaccatggcctggactccctctacttcctccccctcctcactctctgcacaggctctgacggccctctatgtcgactgaaccacgacgcccctacccgttcggtcgttcccggtcgtacccccgaagggaccgaacggaccggaccgtaaggactccacctgcctcgtggaatntcgctagttaccgaccctaacctacttagtttcttagtcggtaccagacaagaacgcgacggccacgtcccgtggttgttcggtanaataataaagtaaacgacgtacgtaggaacggtacggtcccgttacgaacgggtacctacccgtagacggtacgttcgtttccgttcgcggtacccttcccgaccgtacggaacgggtaactaagtcgtactacgactttacggaactacgttacgaggttagaccgtccggaaggacgaaagggacggtaacggtacggtcgtaacgtaatttaagtttagtaccgttaacaaacgtcgtaaaaccgacgtaacccttaacgttaagtttacggttacttaacggttcgttaccggttaacgtaccgtacggtaaacccgtaaccggtaaaccgggtcccttaacccgggtccggttccgggaaacctaccccgtaacccggaacccggaacccctaaccccggtacttcccggtaccttaaccccgg

SEQ ID NO: 184245 - DNA, 640 bp, Homo sapiens
  misc_feature: GYAE6OF01C9GZS.51.71.G05.1.454.CMB.1.raw
  modified_base (248)..(248): a, c, t, g, unknown or other
  misc_feature (248)..(248): n is a, c, g, or t
  modified_base (308)..(308): a, c, t, g, unknown or other
  misc_feature (308)..(308): n is a, c, g, or t
  modified_base (346)..(346): a, c, t, g, unknown or other
  misc_feature (346)..(346): n is a, c, g, or t
  modified_base (381)..(381): a, c, t, g, unknown or other
  misc_feature (381)..(381): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacacgccaccctcggtgtcagtcgtccccaggacaggaccggccaggactccacctgctcgtggagatgcagttcgaccaaacgntatgtacttattcggtaccagcaagacggccggcaccggtcctgtgttggtgatagtaanaagcacgtggagcgtcctgaggtctccgtgcgtacgtnttcgtcgtcgcctcgacggtcgaacggacacggtnaacgtgttcgacctagtcggtagtcggtacgtaccgaggacgaagggaaggacggtagtcgtagttactttaagtttacgtacgttaactaaacgtacaaacgtaacgtaacccaacgttagtttacggttaacctttagttcgttaccgttaacggaccttacgggaaccgtacgtaaccggttcgaaccccggttcggtacggtacccgaacccggcccgaaaccgtaccccaccccgttatccgacccttacccgg

SEQ ID NO: 184246 - DNA, 717 bp, Homo sapiens
  misc_feature: GYAE6OF01BU3KG.51.71.G05.1.454.CMB.1.raw
  modified_base (228)..(228): a, c, t, g, unknown or other
  misc_feature (228)..(228): n is a, c, g, or t
  modified_base (247)..(247): a, c, t, g, unknown or other
  misc_feature (247)..(247): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctctcactctctgcacaggctctgaggcctcctatgagctgacacacgcccacccgtcggtgtcagtcgtccccaggacagacggccaggactccacctgctcgtgganatgctattcgaccaaacgntatgtcttattcggtaccagacaaggaacggccgggaccacggtccccttggtggttggtgtagtagttaaataaacgactaagtaggacggacggcccgtacggaacgggtactcccgtaggacgacgtacttcgtacgtcggtaccgtaccggtagggtaccggaacgggtaaccgtaacgggtaccaacgttacggttacgggacctacgtaccgtagggtacgggacgttacccggaagggtaccgaagggaacgggtaacggacggtactaggtaactttacgttagttagtactaataccgtaacgacgaaccgtaccttaagttacggttaactttagttacgttaccgtacgtaacgtcgaaccggtaacccgtaacggtcccgtaccggttcggtacgggtaccgaacccggtaccccgaaccgggtaccccctaaccccgtacgttccgtccgtaccccg

SEQ ID NO: 184247 - DNA, 672 bp, Homo sapiens
  misc_feature: GYAE6OF01DWITT.51.71.G05.1.454.CMB.1.raw
  modified_base (179)..(179): a, c, t, g, unknown or other
  misc_feature (179)..(179): n is a, c, g, or t
  modified_base (245)..(245): a, c, t, g, unknown or other
  misc_feature (245)..(245): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacacgccaccctggtntcagtcgtccccaggacagacggccaggatcacctgctcgtggagatgctattcgaccaaaaccgntatgtacttagttcggtaccagacaaggaacgccgggccacggtccctggtggttggtagattgtaagtaaagactacgtaggagacggcccctagacgggtacctccgtaggacgtcgtacttctacgtcggcctaccgtaggtaccgaacgggtaacctaacgggtccaacgtacgttcggacctacgtcgaggtaggaccgtcgacggacgaggaacggacgtaaggctaggtaaccttaagtttattacgtaactaataccgaaaacgcggtaacctaaccgttaaggtttacgttaactttacgttgttaccgttacggaacttcggaccgtaaaccggtaacggttccctaaccgggttcgtacgggtaccaccggtaccccgaaacggtacccccaaacccgtcgtcgacccgttacccg

SEQ ID NO: 184248 - DNA, 562 bp, Homo sapiens
  misc_feature: GYAE6OF01CQOQO.51.71.G05.1.454.CMB.1.raw
  modified_base (466)..(466): a, c, t, g, unknown or other
  misc_feature (466)..(466): n is a, c, g, or t
  modified_base (488)..(488): a, c, t, g, unknown or other
  misc_feature (488)..(488): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagcccaccctcggtgtcagtcgtccccaggacagacggccagactcacctgctcgtggagatgcattcgaccaaaccgatatgtcttattggtaaccagcgagaacggccggggccacgggcccctgtggttggtgtatagtaataaagacacgtggagacgccctcgagggtactccctgagcgtattcgtcgtcggctcgaggtacgacgggaaccaacggtcaactgtcggactatcgaggtggacgtcgaggacaggaggacggaggctagtaacttatattgtaacatacaaacncgaaccactagttcgtaacttnttagtcttacgactcgacgaccgaagtccaccgtcgtggtaccacgacccaacgcccaaccctctgtccctacg

SEQ ID NO: 184249 - DNA, 722 bp, Homo sapiens
  misc_feature: GYAE6OF01DKPEN.51.71.G05.1.454.CMB.1.raw
  modified_base (226)..(226): a, c, t, g, unknown or other
  misc_feature (226)..(226): n is a, c, g, or t
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgaggcctcctatgagctgacacagccaccctcggtgtcagtcgtccccaggacagaccggccaggactcacctgctctgganatgactatcgaccaaaccgatatgtcttagttcggaccagcaaggaacggcccggcacggccctgtgttggngatgtaataagcactggagacgccctgacgggtactccgngacgcgtattcgtcgtcgctaccgagggtacgaagggacctaacgggtcaagtacgttcggacctagttcgaacggtcgggtaacgtccggaagggacgaagggaacgggcggtaacgggcttaacggtaacttttaagtttagttacgtaaccaaacgttaaccaacgtaaacggtaccctaaaccgtttaggttttacgggttaaaccctttaggtttaccgttaccggttaaccggggtaaaccttccgggaaacccgtaaacccggtaaccggggttaccccttaacccggtttcgggtaaccgggcccgtaaacccggaacccccggtaaaccgggaacccccctaaccccggttactaccggtttccctaaaccccgg

SEQ ID NO: 184250 - DNA, 558 bp, Homo sapiens
  misc_feature: GYAE6OF01CVKAA.51.71.G05.1.454.CMB.1.raw
  modified_base (362)..(362): a, c, t, g, unknown or other
  misc_feature (362)..(362): n is a, c, g, or t
  modified_base (369)..(369): a, c, t, g, unknown or other
  misc_feature (369)..(369): n is a, c, g, or t
  modified_base (398)..(398): a, c, t, g, unknown or other
  misc_feature (398)..(398): n is a, c, g, or t
tcagcgatcgtatacacgaccggtgctcgatttagtgtcgtcgcaagagagaggggggtgggtccaggaggcataactctgggtgtctcaccatggcctggatccctctacttctcccctctcactctctgcacaggctctgaggcctcctatgagctgacacagccacctcggtgtcagtgtccccaggacagacgccaggatcacctgctctggagatgcattcgccaaaccgatatgtcttattggtaccagcagaagccgggtccaggcccctggtgtcggtgatgtataaagacactgagaggccctcgagggtactcctgacgcgattctctggctcgagtcagggacacggtcanttggccnttcgagtcggagtccaggcacgaggacgnggctagactagttattgacaataccaacaacgacctactagttcggtaactttagacgttcgttacgaacgttgaccgtaacgaacggtccaaccggttcggtacgggtcctaacggccccgtaaacgggaccccaaaccctccttaggtccctaacccg

SEQ ID NO: 184251 - DNA, 569 bp, Homo sapiens
  misc_feature: GYAE6OF01BY9JD.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctattagctgacacagccaccctcggtgtcagtgtccccaggacagacggccaggatcacctgctctggagatgcattgaccaaacgatatgcttattggtaccagcagaacgccgggccaggcccctgtgttggtgatgtataaagacactgagacggccctgagggactcccgtgagcgattctctggctccgaggtcgagggacaacggtcactagttcggccatcgagtggagtccgaggcaggaggacgaggctgacttattattgtcaatcaaacagaacaacctagttacggtacttagtcgttacgttacggaactggaccgaaccgaacggttaccacccggttccgtacggggtccaacggccccgaaacgggccccaaaccccgacgttcgtccctaccgttccccg

SEQ ID NO: 184252 - DNA, 715 bp, Homo sapiens
  misc_feature: GYAE6OF01C2RWH.51.71.G05.1.454.CMB.1.raw
  modified_base (244)..(244): a, c, t, g, unknown or other
  misc_feature (244)..(244): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagcccaccctcggtgtcagtcgtccccaggacagacggccaggatcacctgctctggagatgctatcgaccaaaacggtntatgtcttagttcggtaccagcaaggaacggccgggccacggtcccctggttacggttggtacgtaagtaggtaataaaggaccactaggacggacggtccctacggagggacctccgtaggacgtcgtacttcgtcgtcggcctaccgaagggtcgaacgggtaaccaacgggttcaacgtagtttcggacctagtacgtaggtgggtaacgtcccgagggacagggaaggaacggcggtactagtaaccttagtttacttggttaccaaacttccaaacgacgtaacccgtaaccgtagttttacggtaactttcgtacggttaccgttaaccggtaaaccgttgggacccgttaaacccgaaacgggttaccctaacccgggtttcccggttaggggtaacccaaccgggtaaccccgaacccgggtaaccccctaacccccggtaaccgttcgtaccccttaacccg

SEQ ID NO: 184253 - DNA, 794 bp, Homo sapiens
  misc_feature: GYAE6OF01ACS8C.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctctcactctctgcacaggctctgacggcctcctatgagctgacacagcccacccgtcggtgtcagtcgtccccgaggacacggacggccaggactccacctggccttcgtaggacgtatggactattccgacccaaaccgatagtcgtacgtttaagtccggtaaccaggcgaaggaaccggccgggacccgacggtccccgtggttggttgggtacgtagttaacgtaaagtaaaacgccgtacgtaggaacggtccggaccccgttacggacggggtaccttcccggtaggacgtacgttactttccgtacgtcgggtcccttacggtaagggtacggaacggggtaaccgtaaccggtttacgaaccggtttacggttcccgggtaaccttaacgttaacccggtaggggtaccgggtaaccggtcccgggaacggggtaacccgtaaagggggtaacgggtaaccgggagggtaccgttaacggttaaactttaacgtttagtacgtaacgaacttaccaacgtacgtaaccctacgttaagtttacggtacttagttaccggttctaaccggaatccggaaccgtaacggtaccgttccgtaccggttacggtcggtacccaccgacccccgtaacggaccccctaccgtaacgtcgtacccttacccg

SEQ ID NO: 184254 - DNA, 610 bp, Homo sapiens
  misc_feature: GYAE6OF01C68TJ.51.71.G05.1.454.CMB.1.raw
  modified_base (257)..(257): a, c, t, g, unknown or other
  misc_feature (257)..(257): n is a, c, g, or t
  modified_base (315)..(315): a, c, t, g, unknown or other
  misc_feature (315)..(315): n is a, c, g, or t
  modified_base (417)..(417): a, c, t, g, unknown or other
  misc_feature (417)..(417): n is a, c, g, or t
  modified_base (447)..(447): a, c, t, g, unknown or other
  misc_feature (447)..(447): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggcctctgacggcctcctatgagctgacacacgccaccctcggtgtcagtcgtccccaggaccagaccggccaggatccacctgcctgtagggatatgactattacggacccaaaacgnttatgtactttagttcggaccagcaaggaacgccgggaccacggtccctgtggttggngtatagtaataaaggcacgtgaagcggaccctgagggcctccgtagagtcgtacttcgtcgtcggcctcgacggtcgagggaccacggtcaactgtcgactntacgagtggactcgagcgtagacggaacgnggtctagtacttagttattagactaatacgaatcgaaacctcgttaagtgttaccttaggtttcctgttaacggaccttacgaccgaagtaaccggtcctaccgttcgtcgggacctaaccgccccgaaacgtcccctaaccctagttcggtcccttacccgg

SEQ ID NO: 184255 - DNA, 584 bp, Homo sapiens
  misc_feature: GYAE6OF01A69U0.51.71.G05.1.454.CMB.1.raw
  modified_base (335)..(335): a, c, t, g, unknown or other
  misc_feature (335)..(335): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatccacctgctcgtggagatgctattcgaccaaaccgatatgtcttattggtaccagcagaacgccgggccaggcccctgtgttggtgatgtataaagacatgagacggccctcgagggactcccgngagcgattctctgctcaggcaggacacggtcacagtggaccatcagtcggagtcgaggcaggaggacgaggcgtagtactagttagtcgtacatacaacgagaacctacgtagttacggttaactttagtacgttacgttacggtaacgttcggaccgtaaccgtaacgggtcctacccgggtccttcggggtacccaacggaccccgaaccgggacccccaaaccccgaccgttccgtccgttacccg

SEQ ID NO: 184256 - DNA, 706 bp, Homo sapiens
  misc_feature: GYAE6OF01CJLFI.51.71.G05.1.454.CMB.1.raw
  modified_base (253)..(253): a, c, t, g, unknown or other
  misc_feature (253)..(253): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccctctcactctctgcacaggctctgacggcctcctagtgagctagacacacgcccacccgtcggtgtcagtccgcccgaggacagaccggcaggatcactgcttgaggagagtcgacacttacgaaccaaaacgtnttatagtacttacgttacggtaccaagacgaaggaacgggcccggggaccgtaaccgggtccccgttaggttggttcgggtaggtaacgttaacggtaaagtaaaacgaacctagtacggaacggacccggtacccgtacggaacgggtacctaccgtagacggtacgtaacttcgtcgtacggccttacggacggtacgaacggtaacgtaacgtacacgtagtacggacctagtacgaggcggtacgacgagacgaaggacggtacgagtacgtagtaacgttatttagtacgaacaacgtacaacgtacaaccgtaacttagttacggaatttcgtagttaccgtacgtaagtcgaccggtaaaccgtacggtacccgtacggtaccggttacggccgtaaaccgtaacccggaaccgaacccctaaccggtactccggtacccttaccg

SEQ ID NO: 184257 - DNA, 728 bp, Homo sapiens
  misc_feature: GYAE6OF01D0DBR.51.71.G05.1.454.CMB.1.raw
  modified_base (235)..(235): a, c, t, g, unknown or other
  misc_feature (235)..(235): n is a, c, g, or t
  modified_base (257)..(257): a, c, t, g, unknown or other
  misc_feature (257)..(257): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctctcactctctgcacaggctctgacggcctcctatgagctgacacacgcccacccgtggtgtcagtccgacccgaggacacggaccggaccaggactcaccgtgcctcgagganatgactagtcgaaccaaacgtnttagtcgtactttagttacggaccagacgaacggaacggcccggaccgaccggtccccgttggttcggtttagggtacgtaagttaacggttaaacgtaaaacggtaccgtacggttagggaaccggtaccggtccccgtaagggtaaccgggtaccttacccggtaggaaccgtcgttaacgtttccgtcgttacggccctaccggaggtacggaacgggtaaccgtaaccggtactaacgtacggttcgactacgtcgagggtacggacgtcgagggtacgagggacggacgtacgtctaggtaacttagtttacgtactacaactacaacgactaaccgtattacgttagttacgttagtcgttacgtacgacgttaccggacgtaaaccgacgttccgaaccgttcggtaccggaccgtaaccgaccccgtaaccggacccctaacccggtcttcgtacccgtaccc

SEQ ID NO: 184258 - DNA, 591 bp, Homo sapiens
  misc_feature: GYAE6OF01E06EB.51.71.G05.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (287)..(287): a, c, t, g, unknown or other
  misc_feature (287)..(287): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctggtgtcagtcgtccccaggacagacggccaggatcacctgctctgganatgctattgaccaaacgntatgcttattggtaccagcagaagccgggcacgtccctgtgttggtnatgtataaacgacacgtgaggacgccctcgagggactcccgtgacgcgtattcctcgtgctccgaggtcgagggaaccaacggtcaacgtagttcggaccagttccgaggtggacgtccgaggcaggagggacgaggctagaacttagttacttgtacaactcaacgagtaaccaccgtagtttaggtactttagtgttacttacggaactcggaccgaaccgtaacggtcctaaccggttccgttcgggtaccaacggtaccccgaacggaccccaaaccccgtccgtacgttcccgtaaccg

SEQ ID NO: 184259 - DNA, 806 bp, Homo sapiens
  misc_feature: GYAE6OF01BI8DT.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggcaggatcacctgcctctggacatgactattcggaccaaaaccgatatcgctttaagttggtaacccagccgaaggaacggaccggggtcccgaacggccccccgtaggtttggttgggtagtaagttacgtaaacgtaaaaacggaacctacgttacggaacggaacgggtaccccttacgaacgggggtaaccttccccgttaggaacggtaccgttaacgtttacgtccgttcgggacccgttaccggtaacgggttaccggaacggggtaacctaaaccgggttccgtaaacctacggtttcgggaaccctaggttacgtaacggtacgggtaaccgttacccggaacgggccgaaagggtaacgggaaccggaagggcgttaacggtacttaagtttaacgttacgttaaccaaacttaccgaaaacgtaaccgtaaccaaccgttaagtttaccggtttaactttaacgttcggtttacctaacgggtaaaccgttgacccggtaaccgtaaacggtcccggtaaccggtccggttccgggtaacctacggaaccccgtaaaccggaccccctaaacccgtccgtacgtcccgtaacccg

SEQ ID NO: 184260 - DNA, 816 bp, Homo sapiens
  misc_feature: GYAE6OF01AJD1A.51.71.G05.1.454.CMB.1.raw
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctctcactctctgcacaggctctgaggcctcctatgagctgacacagccaccctggtgtcagtcgtcccccaggacagacggccaggactcacctgctctgganactgctattcgacccaaaccgntactgctttagtcgtaccagcgaagacgccgggccacggcccctggttgttcggtgtagtagtaataaagactacgtagaggtaccggccctgacgggactcccgtaggacgcgtactttccgtacgtcggtcctacccgtagggttaccgaacggggtaaccgtaaccgggtcctaaccgtacggtttacggacccgtaagttccgtaacgggttacgggtaacggtaccccggacgggtaccggaacgggaacggggaaccgggtacgggtaccgtttacggttaaaccgttttaaggttttaacgttacggttaaccctaaacgtacccgtaaaaccgtaaccgtaaacccgtaccgtttaacggttttaacggtttaaccgttttacgttaccggttttaacccggttaaccggttaacccgtacgggtaaaccccgtaaacccgggtaaacggtttccccggtaaaccccggttcccgggttaccgggtaaccccgtaccggtaacccccgaaacccgggttacccccctaaaccccgcgtttaccccggtacctttacccccgg

SEQ ID NO: 184261 - DNA, 671 bp, Homo sapiens
  misc_feature: GYAE6OF01D6WCF.51.71.G05.1.454.CMB.1.raw
  modified_base (179)..(179): a, c, t, g, unknown or other
  misc_feature (179)..(179): n is a, c, g, or t
  modified_base (223)..(223): a, c, t, g, unknown or other
  misc_feature (223)..(223): n is a, c, g, or t
  modified_base (241)..(241): a, c, t, g, unknown or other
  misc_feature (241)..(241): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtntcagtcgtccccaggacagacggccaggctcacctgctctgganatgcattcgaccaaacgntatgcttagttcggtaccagcgaaggaacgcccgggaccacggtccccgttggtggtttcggtagtagtagttaaagtaaaacgacgaaccgtggaacggaccggtaccctacggagggtactccccgtaggacggcgttagtttcctcgtcggcctaccggacggtacggaacgggaacccgaacggtccaacgtacgttacggaccctagtcgaaggttcggacgtaccgaggcgaaggacggacggacggcgtagtacttagtttacgtaggtactaacgtaccgaaacacgtaacctaccgtaagtttaccgttaacgtttacgttcgtaaccgttcggaacctggacccgtaaccgttacggtcctacccggttcgtcggaccctagaccccgtaaccgaccccaacccgtctcgtccctacccg

SEQ ID NO: 184262 - DNA, 649 bp, Homo sapiens
  misc_feature: GYAE6OF01A5FBW.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggaccagacggccaggatcacctgctctggagatcgcattcgaccgaaaccgataatgacttagttcggtaccagcagaacggccgggccacggcccctgtcggttggtagagtagtaataacgacacgtagagacggccctcgaagggctacccgtagacgcgtattacgtcgtcggctaccggacggtcgaaggggacctaaacgggtccaacgtagttaccggacctaagtcgaaggtacgggtacttacccggaagacgaggaagggacggacggtccgtagtaaccttaagtttacttcggtactaacgttaccaaacacggtaacctaccgtagttaggttaactttagtacgttaccttacggactcgacccgtacgaacgggtacctacggtaccggtcgggtaccaccggacccgaaccgtaccccaacccctcgtctaccgtacccg

SEQ ID NO: 184263 - DNA, 628 bp, Homo sapiens
  misc_feature: GYAE6OF01CFOQZ.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccacggcccctgtgttggtgatgtataaagacactgaggacgcctacgaggactccgtgagcgtattctcgtcgctaccgaggtacgacggacgacggtacacgtagttcggactatccgaggtcggacgtaccgagggcaagggacgggacggacggtcgtacgtaacgttagtttacgttcggtaactaacttaaccgaaactaacggtaaccctaaccgttaagtttacgggttaacctttagttcgttacgttaccgggtaactcgggaaccctaaccggtaacggtcccgtacccggttccggtcgggtacccacggtacccaacggtacccccaaccctcgtcgtcctacccg

SEQ ID NO: 184264 - DNA, 913 bp, Homo sapiens
  misc_feature: GYAE6OF01CAFPM.51.71.G05.1.454.CMB.1.raw
  modified_base (241)..(241): a, c, t, g, unknown or other
  misc_feature (241)..(241): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccacccgtcggtgtcagtcgtcccaggacagacggcagatcacctgctcgtggagatgcattcgaccaaacgntatgtacttagttcggtaaccacgacaaggaacggcccggggaccctaaccggtcccccgtggttcgggtttggtagtagtaagttaataaaaacgacgtacgtaggaacggaccgggtaccccgtacggtaacggggaccttccccgttagggtaacgtaccggtaacttttccgttaccgtcgggtaccttacccggtaagggtaaccggaaacggggtaaccgtaaacccgggtaacctaaccgttaacgttaccggggaacctaaccgtacggtaacggtttacgggaaccggttaacccgaacggggaacgaaacgggaacgggtaaacgggtaaccggacgtttacggtaaacctttaaagtttaacgtttacggtaacgtaaacgtaaacgtaaacgaaacggtaaccctaacccgttaacggttttaaccggtttaaacgttttaaccgtttacgggtttaacccgttaccggggttaaaacctccgggttaaaccccggaaaaccccggttaaccggggtttaaacccccgtaacccggttttaacccccggttgggggtaaacccccctaaacccgggttaaccccccgtaaaaacccgggggaccccccctaaaaaccccccgggttacgtttaacccggtaccccgttttaaacccccgg

SEQ ID NO: 184265 - DNA, 808 bp, Homo sapiens
  misc_feature: GYAE6OF01B91Q8.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgacggcctcctatgagctagaccacacgccctaccgtcggtcgtcacgtcgtccccgaggacagaccggcaggactcacctgctcgtaggagatgactattcgaaccgaaacgtatagtcgtacgtttacgttacggtaacccgagaccgaaaggaaccgggccggggcccgtaaccggtccccgttggtttacgggttggttaggagttaacgttaaacgtaaaacgactacggttagacggtacccgtcctacggaggtccctccgtagtacggtacgttactccgtacgtcgtccgtacgtacggtacgacggtaacgacgtacgagtacgtcgactacgtcgtaggtcggacgtaccgacgggaacgaagggacggtaacgggacgtacgtagtaacctttagtttaacgttacgtaacttaacgaaccgaaacgtaccgtaaccttaaccgttaggtttaaccgtttaacgtttaacgttcccgggtttaccggtaacccggttaccggttaacggaccccggtaaaccggttaaaccccggtaaccggtttaacccggttcccgggttaccggtaaccccggtaaaccccgggtacccgaaacccccggtaaacccccctaaccccggtttacggtaccccttccggtttaacccccgg

SEQ ID NO: 184266 - DNA, 400 bp, Homo sapiens
  misc_feature: GYAE6OF01CSBRW.51.71.G05.1.454.CMB.1.raw
  modified_base (339)..(339): a, c, t, g, unknown or other
  misc_feature (339)..(339): n is a, c, g, or t
  modified_base (343)..(400): a, c, t, g, unknown or other
  misc_feature (343)..(400): n is a, c, g, or t
tcagcgatcgtatacacgaccggtgctcgatttagtgtcgtcgcaagagagagggaactcgattacagcagccctcgaagaacatcatgatggctttgatatcgtggggccaagggacaatggtcattgtcttcttcacgccctaccaaccgaacgggcccagtccggttccttcccccccgtggccctacccctccctccaagcgcctacctcggtgggggccaacgcggccggcccgtggggcctcggccgtgggtacgaaggtaccttacttccctacgtagcctacctcgtggagggcggggtctcggggacaacggggcaccgtaagtaggcanctgnnnnnnnnnnnnnnnnnnnnnnnnnnnnnnnnnnnnnnnnnnnnnnnnnnnnnnnnnn

SEQ ID NO: 184267 - DNA, 874 bp, Homo sapiens
  misc_feature: GYAE6OF01AJYLH.51.71.G05.1.454.CMB.1.raw
tcagcgatcgtatacacgaccggtgctcgatttagtgtcgtcgcaagagagaggggggtggggtccgaggaggcagaactctgggtgtctcaccatggcctggatccctctacttcctccccctcctccactctctgcacaggtctctggacggcctcctatgagctagacacacgccctacccgtcggttcgtccgtacgtccggtcccccgaagggaccgaacgggaccggacccgtaaggtcctaccaacccgttcgtccgttccggtagggaacgtacgtcggaccttaacgttaccgaaacccgtaaaaccggtattaacgttccgttacgttttaacggttaccggttaaccgaacgtaccgaacggtaaaccgggcccgggacccgtaccggtccccgttgggtttaggtttacgggtagtacgtttaacggtaaaacttaaaacggaccgttacggtaacgggtacccggaaccgggttacccctacgggtaaacgggtcccttacccgggtaaggcccggttaacgttaacgtttcccgttcggtaccgcccggtttaaaccgccgggttacggaacgggtaaacccgtacgtactaacgtcgtttacggactacgtacgtaggtacggtacggtacgaacggtagacgggacggtaacgggagtccggttacgtaacgtttagttacgttagaaccgttaagaacctaacggactaaccggttacgttacgttaacgggttacttagttaccgttacggtacgtaccgtacggtacccgtaaccgtaccggtccgttaccggtcggtacgaaccgtacggaaccccgtaccaacccgaacccgttctaacccggtcttaccccg

SEQ ID NO: 184268 - DNA, 769 bp, Homo sapiens
  misc_feature: GYAE6OF01EH584.51.71.G05.1.454.CMB.1.raw
  modified_base (108)..(108): a, c, t, g, unknown or other
  misc_feature (108)..(108): n is a, c, g, or t
  modified_base (185)..(185): a, c, t, g, unknown or other
  misc_feature (185)..(185): n is a, c, g, or t
  modified_base (284)..(284): a, c, t, g, unknown or other
  misc_feature (284)..(284): n is a, c, g, or t
tcagcgatcgtatacacgaccggtgctcgatttagtgtcgtcgcaagagagaggggggtggtccaggaggcagaactctgggtgtctcaccatggcctggatcccctntacttcctcccccctctcactctctgcacaggctctggacgtccctctatgagctagacacacgccctaccgtggtntacgacgttccgaccccgaggaccacggaccggccaaggcttaccaccgttgccttcggtaggatacgttcgacttacgttaccgaacccgtaaacgtnttagttcgttactttagttacggacacgacgaacggaccggtccggaccgaccggttcccgttggttacggttggtagtagttaacgtaagtaaacgacgtacgtaggaccggtaccgtcccgtaggaaccggttaccgtccgtaggtaccggttcgttacgtttccgtaccgttcggtacccgttaccggtacggtaaccggtaacggtaacccgttacggtaccttaacgtcggttacggacttacggtacggttacggtacggaccggtaccggaacggtacggaacggtaacgggtacggtcgtacgttagtttaacgtttaagttacgtaacgtaactaactaccgaacgtaactaacccgttagtttacgttacgtttacttagttcgttacgtacgtaccgtgtaacccgtacgtaccggtccgtagtccggttaccgcgaacccgcccgtaacgtaccccaattcgtacctcctccg

SEQ ID NO: 184269 - DNA, 719 bp, Homo sapiens
  misc_feature: GYAE6OF01E0Q6W.51.71.G05.1.454.CMB.1.raw
  modified_base (705)..(705): a, c, t, g, unknown or other
  misc_feature (705)..(705): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgctattcgacccaaaccgatatgtcttagttggtaccagcaggaacgccggcacggcccctgtgttggtgatgtaataaacgactacgtgaacggacggtcccctacggaacgggtaccttccccgtaggacggccgtaactttccgttcgttacgggtccctaccggtacgggtaccggaacggggaaccgtaaacccgggtacctaacgtaacgtttcgggacccgtaacgttaccgacgggttacggggtaaccgtacccggtaacggggaccgaaagggtaacggggaaccgggaacgggtaccgtttacggaaccttttaagtttaagtttcggtaacttaacgttacaaacgaacgtaaccctaaccgttagtttacggtaactttagttcgttacgttacggaacgtcgaccgtaaccgtaacggtcctacccggtcgttcggcaccgtaccccaacggaccccaacccncgttccgcctaccg

SEQ ID NO: 184270 - DNA, 724 bp, Homo sapiens
  misc_feature: GYAE6OF01EW6R1.51.71.G05.1.454.CMB.1.raw
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (502)..(502): a, c, t, g, unknown or other
  misc_feature (502)..(502): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgacgcctcctatgagctgacacacgcccacccgtcggtgtcagtccgtacccaggacaggaccggccaggactccaccgtgcgtcgtgggagtatcgactattcgaccaaacgtntatntacttattcggacagacacggacggccggacgaccgggtcccttggtcggtttaggtgtacgttagtaaacgttaacgaaccgtacgtaggacggaccggttaccccgtacggacgggttaccctacccggtaggtaccggtacgtacgtttccgtcggtccggtacccgtaccggtacgggtaccggaacggggtaaccgtaaccggtaccgacgtaggttcccggactacgttaccgngggttacggacgtaccggaaggcgaaagggacggacggtacggacttggaacttaggttattcgaactactacaacgtactaccacctttaggtttaacgttattaagttccggttacgtaaccgtggtaccgcgtaaacccggtagtcccgtaccggttacggcgggtacccgtaaccgaaccccggaaccggaccccaaccgttcgtccgtacctacccg

SEQ ID NO: 184271 - DNA, 880 bp, Homo sapiens
  misc_feature: GYAE6OF01BRJST.51.71.G05.1.454.CMB.1.raw
  modified_base (167)..(167): a, c, t, g, unknown or other
  misc_feature (167)..(167): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgacggcctctatgagctgacacngcccacccgtcggtgtcagttccgtccccgaaggacacggacccggaccagggtactccgtaaccctcgtaccgttcgtagggaagtacgtacggacctagtttaccgaacccgtaaaacccggtattaacgtacgtacgttttaacgttaccgggttaaccgacggaccgaacggaaaccgggcccggggacccgaccggtcccccgttggttcggtttcgggtagtacgttaagttaaacgtaaaccggaacgtacgttacggaacggtacccggtaccccgttacggacgggtaccgtaccccgttacggtaacggtccgttaacgtttccgtaccggttcggtcccgtaccggtacgggtaccggaaccgggtaaccgtaaccggtaccgtaacgtacggttaccggaccttacgtacggtaggtccggtaacggttaccgacgggacgtaacgggacggacggaacgtacggttaacgttaacttaacgtttagttacgtaactaaccgttaaccgaaccgtacgtaacccctaaccgttagttttaccggttaatttacggttcgttaacccggttaaggtacccgtacggtaacccgaaccggttaaccggtcccggttacccggtaccggttaccggacccgtaaccccgggtaccgaaaccccggtaccccctaccccgttacgtccggtaacccttacccccg

SEQ ID NO: 184272 - DNA, 617 bp, Homo sapiens
  misc_feature: GYAE6OF01A71HL.51.71.G05.1.454.CMB.1.raw
  modified_base (107)..(107): a, c, t, g, unknown or other
  misc_feature (107)..(107): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (343)..(343): a, c, t, g, unknown or other
  misc_feature (343)..(343): n is a, c, g, or t
tcagcgatcgtatacacgaccggtgctcgatttagtgtcgtcgcaagagagagggggtgggtccaggaggcagaactctgggtgtctcaccatggcctggatccctntacttctccccctcctcactctctgcacaggctctgaggcctcctatgagctgacacacgccaccctcggtgtcagtctcccaggacagacggccaggatcactgctcgtgganatcgactattcgaccgaaaccgntatgactttagtacggtaccagcgagaacgccgggccacggtccctgtgttggtgatgtaataaacgacacgtagacgacgtcctcgacggtactccgngagcgtactctcgtcgctcgacggtcgaggacgtaacgcgactcgtacgactatcgtagtgacgtccgaggcaagggacggacgacgtcgtagtacttagttacgttcgtacaataccaacgtacgaactacctagttacggttaactttagttacgttaccttacggtaactcggaacccgtaccgtaacgtacccgttacccggttacggtacggtcccgaaccggacccgtaaccggacccctaaacccgtcgttacccgtcccttacccg

SEQ ID NO: 184273 - DNA, 753 bp, Homo sapiens
  misc_feature: GYAE6OF01CHRDD.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctggacgcctcctattagctgacacacgcccacccgtcggtgtactagttccgtacccccgagggaaccacggaccggccgaagggactaccaccgttcgacttccgttagggagaagttcggacctacgttacggaaccctaaaaccggtattacgttcggtacttttaacgttaccgggtaaccacggtacgaacggaaaccgggccccgggaccgaccggtcccccgttggttcggttagggtagtagttagtaaagtaaacgacacgtaggacgacggcctagacgggtactccgtagacgtcgtactcgtcgtcgtccgtacgaggtacgaggacctaacggtacacgtacgttacgacgtatacgaggtaggacgtacgagggaactaggggaacggacggtaggtacgttacgtacgttaacgtttagtacgtaacgaaacgtaccaaacgtaacgaactaccgtttaagttacggttaacttgttacgttaccgtacgtaaccgtggacccgttaaccgacggttaccctaccggtcgttacggaccgacccgaacccgaacggtaacccccttaacccaggttccctagttccgtttacccg

SEQ ID NO: 184274 - DNA, 824 bp, Homo sapiens
  misc_feature: GYAE6OF01D2N7W.51.71.G05.1.454.CMB.1.raw
  modified_base (215)..(215): a, c, t, g, unknown or other
  misc_feature (215)..(215): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctggaggcctccttattagctgacacagcccacccttcggtgtcagtcgtccccaggacaggaccggccaggntccaccttgctcgtggagatgctattcgaccaaaaccgatatgtacttagttacggtaaccaggacaaggaaccggcccgggaccgaccgggtccccccgttggttcggttagggttagtaagtttacgttaaaacgttaaaacggacgtaacggtacggaacggtacccgggcccgttacgggaacgggtaactcccgttaggacggtacgtactttcgtcgtcggtcctaccggtacgggtacggaacggggtaaccgtaacggtaccgtacgtacgttcggaccctaagttaccggtagggtacggtaccggtaccggaaggaccgaagggaacgggtaccggaacgggtacgtacgttaaacctttagtttaacgttacgtaacctaaacgttactaaaccgtaacgaacctaaaccgtttaggttacgtttaaccgtttacggttccggttaaccggttacggtaaaccggttacggaaccctaaaccgggtaaaccggttacccgtacccggttcggttacccgggtaccgaaccccggtaccccggaaaccgtaaccccccgtaaacccctacgttacccgttccgttacgtttacccccgg

SEQ ID NO: 184275 - DNA, 854 bp, Homo sapiens
  misc_feature: GYAE6OF01EYIXL.51.71.G05.1.454.CMB.1.raw
  modified_base (158)..(158): a, c, t, g, unknown or other
  misc_feature (158)..(158): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatganctgacacacgcccacccgtcggtgtcagtcgtccccaggacagacggccaggactcactgctcgtggatatgactagttcgacccaaaacgtattaagttcgtactttaacgttcggtaaccaggaccgtaaaggaacgggacccggggtaccgaaccgggtcccccgttggttcggttttacggggtgtaagtttacggttaaaacgtaaaacggtaaccgtaacgttacggaacgggtacccgggtccccttacggggacgggtaaccttccccggtaggaccggtacgtacgtttccgttcgtcggtaccgtaccggtaacgggtacggtaacgggaaccgtaacggtcgaacgttaggttccggacctatacggtacggtaggaccgtaccgaagggtacgaaggtacggggaacggacggtacgtacggttaacttaacgttttaacgttacggtaactaacgtaaccaaaccgtaacgaaccgttaaaccgtaacggtttttaccggttaaaccttttaacggttcggtttaaccgtaccggtaaacgttacccggtaaccgtaacccgtaacgggttcccgtaacccggttccgggttaccgggtcccgtaaaacccggacccccggtaaacccgggtaaccccccgtaaacccccgttaccgttacccgggttacccttaacccccgg

SEQ ID NO: 184276 - DNA, 802 bp, Homo sapiens
  misc_feature: GYAE6OF01DXE8Q.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctaggacggccctcctagtgagcttgaacacgcgccctacccgtggtcgtctaggtcgtacccccgaaggaccaaggaccggaccaaggacttccaccgtgccttacggtggaactattcggacttaattaccgaacccgtaaaaccgtattacgtgttacgttaagttcggtaacccgtaggaccgaacggtaacggcccggggacccgaccgggtccccgtggttcggtttaggttagtaacgttaacggttaaacgtaaaaggtaacctacggtacggtacggtacccggtaccgtacgggaacggtccgtaccgtaggacgtacgtacttacgtcgtcgccgtcgacgtacgacggaactacggtacacgtagtacgctacgtacgaggtacggacgtacgacggacgaaggaacggtaacggtcggaccgtagttaacttagttacgttcgtaacacgttaaccaaacgtcgaaaccttaaccggttaagttccggtttaacttaggttccgttaaccggttacgtaaacgtccggtaaacccgtaaccgttacggtaacccgtttacccggaccgggtttcggaacccgaccccgtaacccgtaaaccccggacccccgttaaaccctacggttcccgaaccccttaacccggg

SEQ ID NO: 184277 - DNA, 750 bp, Homo sapiens
  misc_feature: GYAE6OF01BFOW9.51.71.G05.1.454.CMB.1.raw
  modified_base (195)..(195): a, c, t, g, unknown or other
  misc_feature (195)..(195): n is a, c, g, or t
  modified_base (591)..(591): a, c, t, g, unknown or other
  misc_feature (591)..(591): n is a, c, g, or t
  modified_base (611)..(611): a, c, t, g, unknown or other
  misc_feature (611)..(611): n is a, c, g, or t
tcagcgatcgtatacacgaccggtgctcgatttagtgtcgtcgcaagagagagggggtgggtccaggaggcagaactctgggtcgtctcaccatggccctggatccctactacttctccccctcctcactctctgcacaggctctgagcctctatgagctgacacagccaccctggtgtcagttcgcccaggacngacgccaaggatccacctgctcgtaggagactgcctaatttcggaccccaaaacggtattacgtcgtacgtttattcggtaacccaggacaagaacggccggggaccaacgggtccccctggttcggttggtaggattagtaagtaaaacggacgtaaccgtaggacggtaacggtcccctaacggacgggtaacttaccccgtagggaacgtaccgggtaatttcccgtacgggttacggtacccgttacccgaacggggtttaaccgaacggggggtaaccctaaaccggggtacctaacggtacgtttccggaccgtaataccgaggttacgggacgtacccggtagggaccctagggaacggacggtacggacctgtactagttacgtgtanaacgttacacgaagacctanacgttacgtaacttacgttacgttaccgttacggaacgttcgaccgtaaccgtaacggtcctacccggttcggttcgggtacctaaccggacccggtaaccgaccccgtaaaccccgtcgttacggtccttacccccgg

SEQ ID NO: 184278 - DNA, 790 bp, Homo sapiens
  misc_feature: GYAE6OF01BMB2Z.51.71.G05.1.454.CMB.1.raw
  modified_base (109)..(109): a, c, t, g, unknown or other
  misc_feature (109)..(109): n is a, c, g, or t
  modified_base (238)..(238): a, c, t, g, unknown or other
  misc_feature (238)..(238): n is a, c, g, or t
  modified_base (264)..(264): a, c, t, g, unknown or other
  misc_feature (264)..(264): n is a, c, g, or t
tcagcgatcgtatacacgaccggtgctcgatttagtgtcgtcgcaagagagaggggggtgggtccaggaggcagaactctgggtgtctcaccatggcctggatcccctntacttctccccctctcactctctgcacaggctctgacgcctctatgacgctgacacacgccctaccgtcgtgtcacgttcgcccgaggacaggaccggccaaggactcctaccgtgcctcggtaggaanagtcgactagtaccgaacctaaacgnttacgtgttacgttaggttaccggtaccgacgacgtaaacggacccgggacccggtccgtaaccggtccccggtttagggttcggtttacggtagtaaacgttacgttaaaacggaaacgtcgtacgtaacgggacggtaacccgggtcccgtaacgggtaccgggtaaccgttccggtaggtaccgtaccggtttacttccggtcgtacccggttaccgtaacggtccggtaacgggaacggtaaccgtaaccgactacgtacggtctacgtaagtcgtacgggtcgtaccgacgagggtaacgaggtacgggtacggacgttacgtaagttaccgtttaatacgttactaactaacgtaactaacgtacgtaacttaccggttagtttaccgttaacgttcgttaccggttaccgtacgtaaccgaccggtaccctaaccggtcgtaaccccgtcggtaccggtttacgacgtaacccggaacggtacccctaaacccggtacccctggttcccacccgttacc

SEQ ID NO: 184279 - DNA, 801 bp, Homo sapiens
  misc_feature: GYAE6OF01EWE4G.51.71.G05.1.454.CMB.1.raw
  modified_base (254)..(254): a, c, t, g, unknown or other
  misc_feature (254)..(254): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgaccacacgcccacccgtggtgtcagtcgtaccccgaggaccaggccggccaggatccacctgctcgtggagtatgactattcgaccaaacgtntagttcgtcttagttacgtaccagacagaacggccggaccgtacggtccccttggttcggttcggtagacgtagtaataaacgactacgtaggacgacgtcccgtaggacggtactcccgtagacggtacggtacttccgtcgtacggtccgtcgtacggtacgacgggaacgtacggtacctaacgttacgttcggacctaacgtcgacggttacggacgtaccgtacggacgacggaacgggtacggacggtcgttacggttaacttacgttttaacgtttacgtaaccgttaacgtaaccgaaacgtaaccgtaacccgtaaccgtttaacggtttaacggttttaaccgtttacggttttaacggttaccgtttaaccggtaaaccggttacggtacccggtaaacccggttaaccggggttaccccgttaaccccgggttaccgggttttaccgggaaccccggtaacccggtaacccccggtaaccgggtaacccccctaaacccccgggttccttaaccccggtaccctttaacccccgg

SEQ ID NO: 184280 - DNA, 927 bp, Homo sapiens
  misc_feature: GYAE6OF01D5BJ4.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtcccaggacagacggccaggactcactgctcgtggagatgactattcgaccaaacgtatatcgtactttagttacggtaccgagacgaacggaaccggcccggggacccgaccgggtccccgttgggttggtttgggtagtacgttaacggttaaacgtaaaacgtaaccgtacgtaggaacgggtaccgggtaccccgtacggtaacgggtaaccgtccccgtaggacgtacgttacgtttccgttacgtccggtaccgttacccggtacgggttaaccgggaaccggggtaacccgtaaaccggtaccgaacgttaaaccgtttccgggaacccgttagttacccggtaacgggttacggtaaccggtaccgggaacgggtaccggaaacgggaacggggtaaaccgggtacggtaccggttaacggttaaacctttaacgtttaagttttccggtaaccgtttaacgtttccggtttaacaacggtaaccgtacgtttacgggttaacgggttttaccggttttaaacgtttacggttttaccgggtttaacccggtttaacccgggtaaacgggttacccggggtaaaacccggttaaccgggtaccccgggtttaccccgggtttaaccggttaccgggtaaccccgtaacccgggtaaaaccccccggtaaccgggtaaacccccccctaaacccccggtttaccgttaacccgttccccgtttaacccccggg

SEQ ID NO: 184281 - DNA, 791 bp, Homo sapiens
  misc_feature: GYAE6OF01BIEWI.51.71.G05.1.454.CMB.1.raw
  modified_base (183)..(183): a, c, t, g, unknown or other
  misc_feature (183)..(183): n is a, c, g, or t
  modified_base (274)..(274): a, c, t, g, unknown or other
  misc_feature (274)..(274): n is a, c, g, or t
  modified_base (586)..(586): a, c, t, g, unknown or other
  misc_feature (586)..(586): n is a, c, g, or t
tcagcgatcgtatacacgaccggtgctcgatttagtgtcgtcgcaagagagaggggggtgggtccaggaggcagaactctgggtgtctcaccatggcctggatccctctacttcctccccctcctcactctctgcacaggctctgacgcctctagtgagctgacacacgcccacccgtcggtntaccgagtccgtaccccgaggacacggaccggccaggactccaccgtcgtctcgtaggactagtcgacctagttaccgaaccgaaaccgtnttacgtagtacgtttacgttcggtaaccagtacgaagtaaccggccgggacccgaccggtcccccgttggttaggtttcggtagtacgttagtaaacgttaaacgaccgtacgtacggaacggtaccggaccgtacggaagggtacccttaccgaggtacgtacgtacgtttccgtcgtcggtccgtacggtacggtacgggaacggtaaccgtaacggtacccgtacggttacgtaccggtacgtacgtacggtaacggtacgggtacgaccgtacgggaacgttaacgggacgggttaaccggtacgggngttacgttaaccgtttacgtttacgtaacgtacctaacgtacaaccggtctaaccgtacgttacgttacgttaacgtttacgtacggtttaccgtacggaacgtaccggtaacccgtaacgttacggtcccgttaccggtcggtacgggacctaaccccggaccgtaacccggaccccgtaaccgtcgttcccgacgtttccccg

SEQ ID NO: 184282 - DNA, 274 bp, Homo sapiens
  misc_feature: GYAE6OF02H4LAO.51.71.G05.1.454.CMB.1.raw
  modified_base (271)..(274): a, c, t, g, unknown or other
  misc_feature (271)..(274): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctggggcacagcggccctgggctgcctggtcaaggactacttcctcgtagcactctgagcgggctggcaaggcgcatagnnnn

SEQ ID NO: 184283 - DNA, 274 bp, Homo sapiens; identical to SEQ ID NO: 184282
  misc_feature: GYAE6OF02GA5UX.51.71.G05.1.454.CMB.1.raw
  modified_base (271)..(274): a, c, t, g, unknown or other
  misc_feature (271)..(274): n is a, c, g, or t

SEQ ID NO: 184284 - DNA, 497 bp, Homo sapiens
  misc_feature: GYAE6OF02IZ0PJ.51.71.G05.1.454.CMB.1.raw
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcaccgtctgggtcagcccaaggccaaccccactcgtctac

SEQ ID NO: 184285 - DNA, 497 bp, Homo sapiens
  misc_feature: GYAE6OF02FKOUT.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcgaactgcacaaggtcaccgtctgggtcagcccaaggcccaacccactcgtcacc

SEQ ID NO: 184286 - DNA, 491 bp, Homo sapiens
  misc_feature: GYAE6OF02GXSSZ.51.71.G05.1.454.CMB.1.raw
  modified_base (421)..(421): a, c, t, g, unknown or other
  misc_feature (421)..(421): n is a, c, g, or t
  modified_base (484)..(484): a, c, t, g, unknown or other
  misc_feature (484)..(484): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcgagggatccccgtgagcgattctctggctccaggtcagggacaacggtcacattggccatcagtggagtccaggcagaggacgaggctgactattattgtcatcaanagacaccattgtacttatgtcttacggactgcacaggtcaccgtctggtcagccagccacccnctgctac

SEQ ID NO: 184287 - DNA, 500 bp, Homo sapiens
  misc_feature: GYAE6OF02G3J8T.51.71.G05.1.454.CMB.1.raw
  modified_base (490)..(490): a, c, t, g, unknown or other
  misc_feature (490)..(490): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccccgtgagcgattctctggctccaggtcagggacaacggtcacattggccatcagtggagtccaggcagaggacgaggctgactattattgtcaatcaacagacacattggtacttatgtcttacgactgacgacaggtcaccgtcgtggtcagcccaaggcccaacccnctcgtctacc

SEQ ID NO: 184288 - DNA, 532 bp, Homo sapiens
  misc_feature: GYAE6OF02IFIFG.51.71.G05.1.454.CMB.1.raw
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaaacgatatgcttattggtaccagcagaagccggccaggcccctgtgttggtgatgtataaagacactgagaggccctcagggactcccgtgagcgattctctggctccaggtcagggacaacggtcacattggccatcagtggaagtccaggcagaggacgaggctagactattattgtcaatcaaacagacacctagttaggtacttatgtcttacgggaacttgacgaaccaaggtcctaacccggtctagggttccaaggaccccaagggcccaaaccccgacttcgtacgtaaccc

SEQ ID NO: 184289 - DNA, 493 bp, Homo sapiens
  misc_feature: GYAE6OF02FVI5T.51.71.G05.1.454.CMB.1.raw
  modified_base (484)..(484): a, c, t, g, unknown or other
  misc_feature (484)..(484): n is a, c, g, or t
tcagcgatcgtatacacgaccggtgctcgatttagtgtcgtcgcaagagagagggggtgggtccaggaggcagaactctgggtgtctcaccatggcctggatccctctacttctcccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggccccctgtgttgttgatatataaagacactgagaggccttcagggatccctgagcgattctctggctccacctcagggacaatggtcacattgaccatcagtgagtccaggcagaagacgaggctgactatttctgtcaatcttcagacatcagtgtacttatgtcttcgactggaccaggtcaccgtctaggtcagcccaaggcccaacccnctcgtctac

SEQ ID NO: 184290 - DNA, 275 bp, Homo sapiens
  misc_feature: GYAE6OF02G7KRV.51.71.G05.1.454.CMB.1.raw
  modified_base (271)..(275): a, c, t, g, unknown or other
  misc_feature (271)..(275): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcactctgagcggctggcaaggcgcatagnnnnn

SEQ ID NO: 184291 - DNA, 512 bp, Homo sapiens
  misc_feature: GYAE6OF02JJE29.51.71.G05.1.454.CMB.1.raw
  modified_base (500)..(500): a, c, t, g, unknown or other
  misc_feature (500)..(500): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggccccctgtgttggtgatgtataaagacactgagaggccctcagggatcccctgagcgatctctggctccaggtcagggacaacggtcacattggccatcagtggagtccaggcagagacgaggctgactattagttgtacaatcaacagacacctattaggtacttatgttcttacggaatgcgaacaagggtccaccgtctcgggtcagcccaacggcccaacccnctcgtactaccg

SEQ ID NO: 184292 - DNA, 504 bp, Homo sapiens
  misc_feature: GYAE6OF02HM6D9.51.71.G05.1.454.CMB.1.raw
  modified_base (239)..(239): a, c, t, g, unknown or other
  misc_feature (239)..(239): n is a, c, g, or t
  modified_base (418)..(418): a, c, t, g, unknown or other
  misc_feature (418)..(418): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaacgntatgcttattggtaccagcagaagccgggccaggccccctgtgttggtgatgtataaagacactgagaggccctcagggatccctgagcgattctctggctcaggtcagggacaacggtcacattggccatcagtggagtccaggcagaggacgaggctgactattattgtcaatcaanagacaccattggtacttatgtcttcgaactgacgaccaaggtcaccgttcgtgggtcagcccaaggcccaaccccgactcgctacc

SEQ ID NO: 184293 - DNA, 280 bp, Homo sapiens
  misc_feature: GYAE6OF02JEQQO.51.71.G05.1.454.CMB.1.raw
  modified_base (271)..(280): a, c, t, g, unknown or other
  misc_feature (271)..(280): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctggggcacagcggccctgggctgcctggtcaaggactacttcctcgtagcactctgagcgggctggcaaggcgcatagnnnnnnnnnn

SEQ ID NO: 184294 - DNA, 520 bp, Homo sapiens
  misc_feature: GYAE6OF02F8GTH.51.71.G05.1.454.CMB.1.raw
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattgtacagcagaagccgggcaggcccctgtgttggtgatgtataaagacatgagacggccctcgagggactcccgtgacgcgatttcctcgtggcctccgaggtcgagggacaacggtcacagttggccatcagtggagtccaggcagaggacgaggctagactattattgcaatcaacagaccaccgtattggtaactttagtgtcgttaggaactgacgacaaggtcaccgtcgtggtcacgcccaacggccccaacccacgtctcctaccg

SEQ ID NO: 184295 - DNA, 503 bp, Homo sapiens
  misc_feature: GYAE6OF02GRUQ1.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctgagggatccctgagcgattctctggctccaggtcagggacaacggtcacattggccatcagtggagtccaggcagaggacgaggctgactattattgtcaatcaacagacaccattggtacttatgtcttacggactgcgactaaggtcaccgtcgtggtcacgcccaaggcccaaccccactcgtctacc

SEQ ID NO: 184296 - DNA, 588 bp, Homo sapiens
  misc_feature: GYAE6OF02F8D25.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtaataaagacactgagacggccctgagggactccccgtgacgcgattctctggctccgaggtcagggacaacggtcacattggccatcgaggtggagtccgaggcaggaggacgaggctaggacttattagttgtacaatacaaacagaaccacctattacggttaactttaagtcgttacgtttacggaacttcggaccgaacccgtaacgggtcctaacccggttccgtacggggttaccaaccggtaccccgaaacgggccccaaaaccccccgacgttccggtacctaaccccg

SEQ ID NO: 184297 - DNA, 515 bp, Homo sapiens
  misc_feature: GYAE6OF02IIZY0.51.71.G05.1.454.CMB.1.raw
  modified_base (502)..(502): a, c, t, g, unknown or other
  misc_feature (502)..(502): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctattagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcgagggatccctgagcgattctctggctccaggtcagggacaacggtcacattcggccatcagtggacgtccaggcagaggacgaggctgactattattgtcaatcaaacagacaccattgtacttatgttcttcggaactgacgaccgaaggtccaccgtcctggtcacgacccaaggcccaacccnctcgtccactccg

SEQ ID NO: 184298 - DNA, 505 bp, Homo sapiens
  misc_feature: GYAE6OF02I5D94.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtcttggttatttataaagactttgagaggccctcagggacccctgagcgattctctggctccagctcagcgacaacagtcacgtttgaccatcagtggagtccaggcagaggacgagctagactattactgtcaggtcatcagacagcagtcggcacttatgttacgtagttcggcggagggaccaaacgtcgaccgttccgtaggtccagcccaaggctacccgg

SEQ ID NO: 184299 - DNA, 277 bp, Homo sapiens
  misc_feature: GYAE6OF02FTCN9.51.71.G05.1.454.CMB.1.raw
  modified_base (272)..(277): a, c, t, g, unknown or other
  misc_feature (272)..(277): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnnn

SEQ ID NO: 184300 - DNA, 499 bp, Homo sapiens
  misc_feature: GYAE6OF02GEKEZ.51.71.G05.1.454.CMB.1.raw
  modified_base (240)..(240): a, c, t, g, unknown or other
  misc_feature (240)..(240): n is a, c, g, or t
  modified_base (312)..(312): a, c, t, g, unknown or other
  misc_feature (312)..(312): n is a, c, g, or t
  modified_base (416)..(416): a, c, t, g, unknown or other
  misc_feature (416)..(416): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgntatgcttatggtaccagcagaagccgggccaggcccctgtgttggtgatgtataaagacactgagagccctnagggatccctgagcgattctctggctcaggtcagggacaacggtcacagttggccatcagtgagtccgaggcagaggacgaggctgactattatgcaatcaagngacacctattgtacttatcgtcttagactgcgaccaggtccacgtccgtggtcacgccaacggcccaacccactcgtactacc

SEQ ID NO: 184301 - DNA, 692 bp, Homo sapiens
  misc_feature: GYAE6OF02H4MH9.51.71.G05.1.454.CMB.1.raw
  modified_base (241)..(241): a, c, t, g, unknown or other
  misc_feature (241)..(241): n is a, c, g, or t
tcagcgatcgtatacacgaccggtgctcgatttagtgtcgtcgcaagagagagggggtgggtccgaggaggcagaactctgggtgtctcaccatggcctggatccctctacttctcccctcctcactctctgcacaggctctgaggcctcctatgagctgacacagcccacctcggtgtcagtcgtcccaggacagacggcaggatcacctgctcgtggagatgctattgacccaaaacgntatgtcttattggtaccagcaagaagccgggcacggcccctggtgttggtagagtgtaataaagacacgtagagaacggccctacgagggactcccgtagacgtcgtaactttcgtcgtcgggtctaccgtacggtcgacgggaacgaacggttcaacgtagttcggacccagtacgtaggtcgggacgttaccggacggacgaagggaacgggacggtaagggtctacggaaactttattaagttacggttaacaaagttaccgaaaacgacggtaaaccacctaagtttaggttaaccgttttagttaccgtttcgttaaccgggtaaacgtcggaccgtaaccggtaacggtacccgttaacccggttccggttcgggtaaccctaaccgggtaccccgaaaccgggtaccccctaaacccccgtacgttacccggtacctaaccccg

SEQ ID NO: 184302 - DNA, 600 bp, Homo sapiens
  misc_feature: GYAE6OF02GCZLD.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgacccaaaaccgatatgcttattggtaccagcaagaacggccgggccgacggcccctgtggttggtgatgtataaagacacgtggagacggccctacgagggactcccgtgacgcgtattctcgtggcctccgaggtcgagggacaacggtcacgtagttcggacctatcgtaggtggacgtccgaggcgaggaggacgaggctagacttagtttatcgtactaatacaacacgaaccaccgtagtttcggttaacttagttacgttacgttacggaacttcgaccgaaccgtaaggtcccgtaaccggttccgtacgggtaccacggaccccgaacggaccccaaccccgtacgtacgtaccctacccg

SEQ ID NO: 184303 - DNA, 548 bp, Homo sapiens
  misc_feature: GYAE6OF02I0HTG.51.71.G05.1.454.CMB.1.raw
  modified_base (297)..(297): a, c, t, g, unknown or other
  misc_feature (297)..(297): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccctcctcactctctgcacaggctctgaggcctcctatgagctgacacagccaccctcggtgtcagtcgtccccaggacagacggccaggatcacctgctcgtggagatgcattcgaccaaaaccgatatgcttattggtaccagcagaagccggcacggcccctgtgttggtgatgtaanaaagacactagagacggcctacgagggactcccgtagagtcgtagttcctcgtggctacgaggtcgagggacaacggtcacgattcgaccatcgagtggacgtccaggcagaggacgnggctgacttattagtnactaatacaacagacacctagttacggtacttagtgttctaacggtactgacgaaccgaggtccaccggtcacgggttccacggacccaacggacccaaccctacgtacgacctacg

SEQ ID NO: 184304 - DNA, 545 bp, Homo sapiens
  misc_feature: GYAE6OF02INP3C.51.71.G05.1.454.CMB.1.raw
  modified_base (314)..(314): a, c, t, g, unknown or other
  misc_feature (314)..(314): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctattagctgacacagccaccctcggtgtcagtgtccccaggacagacggccaggatcacctgctctggagatgcattgccaaaccgatatgcttattggtaccagcagaagccggccaggcccctgtgttggtgatgtataaagacactgagacggccctnagggatccctgagcgattctcgtggctccgaggtcgagggacaacggtcaactagttcggccatcgagtggagtccgaggcaggaggacgaggctagactattagttagtacaatcaacagaaccacctagttagtaacttagttcgttcgttacggaacttggacgtaccgaaggtccaaccgttcgtcgggtcacgacccaacggcccaacccatcgtacctacttccg

SEQ ID NO: 184305 - DNA, 702 bp, Homo sapiens
  misc_feature: GYAE6OF02HTKU3.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccacccttggtgtcagtgtccccaggacagacggccaggatcacctgctctggagatgcattgccaaacgatatgcttatggtaccagcagaagccgggcaggcccctgtggttggtgatgtaataaagactactagagacggccctacgagggactcccgtgacgcgtacttctcgtggctccgaggtcgaggggaccaacgggtcaacgtagttcgggaccctagtcgaggttacggacggttcccgagggacgaagggaacggggtaaccggagggtacttagggtaaacctttaagttaacgttttacggtactaaacgttaccaaacgaacgtaacccgtaacccgtaagttttacgggttaaaccttttaagtacgtttaccgtttaacgggaacctttgggacccgtaaccggtaaaccgggttaccctaccccgggtttaccgttaccgggggttacgaaccccggtaccccggaaccgggtaacccccgtaaacccccgtacccgtaccggttaccctaaccccgg

SEQ ID NO: 184306 - DNA, 514 bp, Homo sapiens
  misc_feature: GYAE6OF02FO5MN.51.71.G05.1.454.CMB.1.raw
  modified_base (503)..(503): a, c, t, g, unknown or other
  misc_feature (503)..(503): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggccccctgtgttggtgatgtataaagacactgagaggccctcagggatccctgagcgattctctggctcaggtcagggacaacggtcacattcggcatcagtggagtccgaggcagaggacgaggctgactattattgtcaatcaacagacaccattggtacttagtgtcttggaacttgcgacgaaggtcaccgttccgtgggtaccaggtcccaacggcccaaccccnctacgctaccg

SEQ ID NO: 184307 - DNA, 658 bp, Homo sapiens
  misc_feature: GYAE6OF02J1054.51.71.G05.1.454.CMB.1.raw
  modified_base (229)..(229): a, c, t, g, unknown or other
  misc_feature (229)..(229): n is a, c, g, or t
  modified_base (247)..(247): a, c, t, g, unknown or other
  misc_feature (247)..(247): n is a, c, g, or t
tcagcgatcgtatacacgaccggtgctcgatttagtgtcgtcgcaagagagagggggtgggtccgaggaggcagaactctgggtgtctcaccatggcctggatccctctacttctcccctcctcactctctgcacaggctctgagcctcctatgagctgacacagccaccctcggtgtccagtgtcccccaggaccaggaccggccaggtatccacctgctctgggagntgcattcgccaaaaccgntatgcttatggtaccagcagaagccgggccaggcccctggtcgttggtgatgtaataaagcactggagacggccctgagggtactcccgtaggacgtcggatttcgtcgtggcctaccgagggtccgaggtacgtaaccggtctacgacgttacgggcccgaatccgagtcgggacgtacccgaggactacggacggtaccggaagggtcgtacggtacgttaattacgtttacgtacgaaaacttccgaaaacgacggtaacctaacccgtaagtttacgggttaacctttagttcgtaccgttacgggtaaacttggaccgaccgtaacgggtccctaccgggttccgtacggggttccaaccggcccgtaacgggacccctaaaccccgtcgttaccggccctaaccg

SEQ ID NO: 184308 - DNA, 691 bp, Homo sapiens
  misc_feature: GYAE6OF02I5X7C.51.71.G05.1.454.CMB.1.raw
  modified_base (227)..(227): a, c, t, g, unknown or other
  misc_feature (227)..(227): n is a, c, g, or t
  modified_base (265)..(265): a, c, t, g, unknown or other
  misc_feature (265)..(265): n is a, c, g, or t
tcagcgatcgtatacacgaccggtgctcgatttagtgtcgtcgcaagagagagggggtgggtccgaggaggcgagaactctgggtgtcgtcaccatggcctggatccctctacttctcccctcctccactctctgcacaggctctgaggcctcctatgagctgacacagccaccctcggtgtccagtcgtccccaggaccagacggccaggatcacctgctctgganatgcattgacctaaaaccgatatgtctttagtgtaccngcagagccgtgccaggcccctggttgttggtcagttgtataaaagctaacgtgagacgggccctaggagggactcccgtagacgcgtacttctcgtacgccgtacccagggtaccaacggggtaaccgaaccggttccagttacggtttcgggaccctacgttaacgacgggtagggtacgtcccggagggtaccgaagggtaacgggacccggtagcgttacgaacttagtttacttggttacaagttaccaaagtacgtaacctaaccgagttttacggacctttaacttaggttaccttacgtttaaccggtagtccgggaacccttaaccgggacgtttcccggaaaccccgtttcggggtacgttaccggaccccgtaacccggtaaccgtaaccccccgtaccccggttagttaacccgg

SEQ ID NO: 184309 - DNA, 512 bp, Homo sapiens
  misc_feature: GYAE6OF02FPTTW.51.71.G05.1.454.CMB.1.raw
  modified_base (222)..(222): a, c, t, g, unknown or other
  misc_feature (222)..(222): n is a, c, g, or t
  modified_base (414)..(414): a, c, t, g, unknown or other
  misc_feature (414)..(414): n is a, c, g, or t
  modified_base (500)..(500): a, c, t, g, unknown or other
  misc_feature (500)..(500): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgccaaaaccgatatgcttattggtaccagcagaagccggccaggcccctgtgttggtgatgtataaagacactgagaggccctcagggatccctgagcgattctctggcctcaggtcagggacaacggtcacattcggccatcaggtggagtccaggcaggaggacgaggctgactattattganaatcaacagacactagttagtactttatgttcttggaactgacgtaccaaggtcaccgtcctggtcacgcccgaaggcccaacccnctacgtctaccg

SEQ ID NO: 184310 - DNA, 619 bp, Homo sapiens
  misc_feature: GYAE6OF02GHDK7.51.71.G05.1.454.CMB.1.raw
tcagcgatcgtatacacgaccggtgctcgatttagtgtcgtcgcaagagagaggggggtgggtccaggaggcagaactctggggtgttctcaccatggcctggatccctctacttctccccctcctcactctctgcacaggctctgaggcctcctattgagctgactacagccaccctcggtgtcagtcgtccccaggtacagacggccaggatcacctgctcgtcggagatgctattgaccaaaccgatactgactttattcggtacctagacaagtaacggcccgggaccacgggcccctggtggttcgggtgagttggtataaacggacacgtgaggacggccctcgagggtactcccgtaggagtcgtattctcgtgctcgaggtcgagggacaacggtcaacgtgttcggcagtcaggtggacgtcaggcaagacggacgaggctgacttattatgtactaatacaacgagaccacgtagtttacggttaactttagttcgttacgtttacggaacgtcggaccgtaacgtacggttccaccgggtttacggtgggtacctaacggtaccccggtaacggtacccctaacccggtacgttcggaccctacccgg

SEQ ID NO: 184311 - DNA, 780 bp, Homo sapiens
  misc_feature: GYAE6OF02G5JEQ.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtcccaggacagacggccaggatcacctgctctggagatgcattcgaccaaaccgatatgcttagttggtaccagcagaacggccggccacggcccctgtgttggtgatgtaataagacactgaggacggccctcgaagggactcccgtaggacggtccgtaatttccgtcgtcgggtccttaccgaacgggttaccgaaggggaaccgtaaaccggggtacctaacgtacggtttcgggaccctaacgttcgaacggttcgggaaacggttccccgaagggaccgaaggggaacgggaaccgggaagggtccgttaaggtaaccttttagtttaagtttcggttaacctaaacttaaccgaaaccgtaacggaacctaaccgtaacggtttttacgggtttaactttaacgttacggtttaccgtttaacccgggaacgttacccgggtaccgtaaacccggtaacgggttaccccggtaaccccgggtttaccggttaccggggttacccgaaacccggtaacccccggtaaaccggggtacccccctaaaaccccccggtaaccggtttacccggttacccttaacccccgg

SEQ ID NO: 184312 - DNA, 284 bp, Homo sapiens
  misc_feature: GYAE6OF02IVXKZ.51.71.G05.1.454.CMB.1.raw
  modified_base (273)..(284): a, c, t, g, unknown or other
  misc_feature (273)..(284): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggccaccctcctccaagagcacctcgtgggggcacagcggccctgggctgcctggtcaaggactacttcctcgtagcactctgagcggctggcaaggcgcatagnnnnnnnnnnnn

SEQ ID NO: 184313 - DNA, 655 bp, Homo sapiens
  misc_feature: GYAE6OF02JE7IM.51.71.G05.1.454.CMB.1.raw
  modified_base (243)..(243): a, c, t, g, unknown or other
  misc_feature (243)..(243): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatccacctgctctggagatgcattcgcccaaaaccgntatgcttattggtaccagcagaacgccgggccacgggccctggtgttggtgattgtaataaagacacgtgaggacggccctgagggactccgtgagtcgacttcgtacgtggctcgaggtcgagggtaacaacggtcaacagttcgggcagtcaggtggacgtccgaagggcaaggacgggtacgaacggtctaaggacctttaagtttagttacgtactaaactccgaaacacggtaacccaaccgttaagttttacgggtaaccttttaaggttcggtttaccgttaaaccgggtaacgttacggaccggtacccgtaacggtcccgttaacccggttccgttacggggtaccaaccggtaccccgtaaacgggtccccctaaaccccgtaccttccgtacccgtacccg

SEQ ID NO: 184314 - DNA, 605 bp, Homo sapiens
  misc_feature: GYAE6OF02GAM0U.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaaaccgatatgcttattggtaccagcagaagccggccaggccctgtgttggtgatgtaataaagacactgagacggccctcgagggactcccgtgagcgattctcgtggctcgaggtcgagggacaacggtcaacgtagttcgggcctaagtcaaggtggaacgtcccgaagggacaaggacgggacgacgggactagaacttatttattgtactaaatacaaacaagaaccaccgtagttacggtaactttagtcgttacgttacggaactaggaccgtaaccgaagggttcccgaaccgttccgtacgggtacctaccggaccccgaaacggaccccgaaaccccctacgttacctaaccgttacccg

SEQ ID NO: 184315 - DNA, 547 bp, Homo sapiens
  misc_feature: GYAE6OF02GN3IQ.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtaataaagacatgagaggccctacgagggactcccgtgacgcgattctcgtggctcaggtcagggacaacggtcactagtcggcatcagtgacgtcgaggcagaggacgaggctagactattagttgactaatcaacacgactactattagtacttagtgttctacggtactgaccgtacgacggtcaaccggttccgtacgggtaccacggaccccgaacggtaccccgaaaccccgtcgttacgtacctacccg

SEQ ID NO: 184316 - DNA, 835 bp, Homo sapiens
  misc_feature: GYAE6OF02HPMGB.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccgaggacaggacggccaggactccacctgctcgtggagatgctagttcgaacccgaaaccgtattagtagtactttagtttcggtaaccagtacgaacggaaccggccccgggacccgaaccgggtcccccgttggttcgggtttagggttacgtaagttaggttaaaacgttaaaaacggaaccgtacggttacggaacggaccgggtacccctaggaacggggtacctaccccgtaggtacgtaccgtaactttccgtcggtcggtccgttaccggtacggtacggaaacggggtaaccgtaaacggttaccctaaacggttacgttaccgggaccctaagtaccggtaacgggtacgggtaaccggtacccggaaggggaccgtaaagggacgggtaacggacggggtacttacggtaacgtttaatttaacgttacggttaacaaacgtaccaaaacgtaccgaaccttaaccgtagtttacggttaactttacgtccggtttactaacgggtacgtacgtaccgtaacccggtaacgggttccccgtaaccgggtttccggtaacgggttacccgaacgggtacccccgtaaacccggtaccccgtaacccccgtacgttaccggtacccttaacccgg

SEQ ID NO: 184317 - DNA, 591 bp, Homo sapiens
  misc_feature: GYAE6OF02F9AKS.51.71.G05.1.454.CMB.1.raw
  modified_base (223)..(223): a, c, t, g, unknown or other
  misc_feature (223)..(223): n is a, c, g, or t
  modified_base (462)..(462): a, c, t, g, unknown or other
  misc_feature (462)..(462): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcactgctctgganatgcattcgaccaaaccgatatgtcttattcggtaccagcaagaacggccggaccacggcccctgtggttggtagacgtagtaagtaaagactactaggagacggccctacgagggtactcccgtagacgcgtattctacgtggctaccgaggtcgaggactacgtcacagttcgacatcgtacggtaggacgtcgagacgaggaggacgaggctagactattatacgacactacgaanacgacctacgtattacggtaactttacgtcgttacgttacgtacgttcgaccgtaacgacggttcctaccgtcggtacggtaccaccggtaccgaaccgggaccccaacccgtcgtacgtcctaacccg

SEQ ID NO: 184318 - DNA, 628 bp, Homo sapiens
  misc_feature: GYAE6OF02FNR74.51.71.G05.1.454.CMB.1.raw
  modified_base (222)..(222): a, c, t, g, unknown or other
  misc_feature (222)..(222): n is a, c, g, or t
  modified_base (614)..(614): a, c, t, g, unknown or other
  misc_feature (614)..(614): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctgganatgcattgaccaaaccgatatgcttattggtaccagcagaaggccgggccacggccctgtgttggtgatgtaataaagacactggagacggccctcgagggactcccgtgacgcgtagttctcgtcggtccttccgagggttccgaacggggaacctaacgggtaccaacgacgtttcgggaccctagtacgaacggtggacggttaccgagggcgaagagggacgaggctaggaacttagtttagttacggtactaaactaccaaacgaacgaaccaacccgttaagtttacgggtttaacttagttacgttaccgtttacggaacttcgaccgaccgtaaggtccctaccgttccgtgggtaccaccgacccgaacggacccctaacccncgtcgtacctaccg

SEQ ID NO: 184319 - DNA, 529 bp, Homo sapiens
  misc_feature: GYAE6OF02IPA3D.51.71.G05.1.454.CMB.1.raw
  modified_base (221)..(221): a, c, t, g, unknown or other
  misc_feature (221)..(221): n is a, c, g, or t
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctggtgtcagtgtccccaggacagacggccaggatcacctgctctgganatgcattgaccaaaccgatatgctttattggtaccagcaagaagcccgggccaggcccctgtgttggtgatgtaataaagacactgagaggccctcgagggactcccgtgagcgatttctcgtggcctccgaggttcaagggacaacggtcactatcgggaccattcaggttggacgtccgaggtcagaggacgaggctagacttatattgtacaatcaacagaaccactagttaggtacttatgttacttacgatcgcgaacaggtcaccgtcgtggtcacgaccaaggcccaacccntcgntaccg

SEQ ID NO: 184320 - DNA, 692 bp, Homo sapiens
  misc_feature: GYAE6OF02F01RP.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacggccaggactcacctgctctggagatgcattcgacccaaaccgatatgtcttattcggtaccagcaagagccgggccacggcccctggtgttggtgatgtaataaagacacgtgagacggccctgagggactcccgtagacgacgtacttcgtcgtcggctccgagggtcgagggaccgtaacggtcaacgtagttcggcctagtaccgtaggttcggacgtaccgagggaccgaacgggaagggtaaccggacggtacgttacggtaacctttaagtttacgttacgttaactaaacgttaaccgaaaccgaggaaccctaaccgttaacgttttacgggttaacctttcggtacgtttaccgttacgggtaaaccttcggaccgtaaaccggtaacggttcccgtaacccggtttacccggtacgggttaccgaaccggccccgtaaaccgggtaccccctaaccccgtacgttaccgtacccttacccg

SEQ ID NO: 184321 - DNA, 797 bp, Homo sapiens
  misc_feature: GYAE6OF02HL7YR.51.71.G05.1.454.CMB.1.raw
  modified_base (247)..(247): a, c, t, g, unknown or other
  misc_feature (247)..(247): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggactcacctgctcgtggagatgactattcgaccaaaacgntatgacttagttgtaccagcagacgccggcacggccctgtgttggtagatgtaataaagacactgagacggcctacgagggactcccgtgacgcgtacttccgtacgtcggtcctaccgacggtacgaacggggtaaccgtaaccggggttacctaaaccgttacggtttaccgggaccctaagttaccgtaacgggtacgggtaaaccggttacccgaaggggaacctaaaggggaaacggggaaaccgggtaacgggtccgttaaggttaaaccgtttaacgttttaaggttaccggtttaaactaaaacgtttaaccgaaaaacgtaaccgggtaaacccttaacgttaaacgttttaacgggtttaaaaccgtttttacgttacggttttaaccggtttaaccgggtaaccgttccgggtaaccgttaacccggtaaaccggttcccggttaaacccggtttcccggttcgggttaacccgaacggttaccccgaaacccggtaccccgaaaccccccgttaacggttccgtacccgttaaccccg

SEQ ID NO: 184322 - DNA, 283 bp, Homo sapiens
  misc_feature: GYAE6OF02F0O9J.51.71.G05.1.454.CMB.1.raw
  modified_base (272)..(283): a, c, t, g, unknown or other
  misc_feature (272)..(283): n is a, c, g, or t
tcagcgatcgtatacacgaccggtgctcgatttagtgtcgtcgcaagagagagggaactcgattacagcagccctcgaagaacatcatgatggctttgatatctggggccaagggacaatggtcattgtctcttcagcctccaccaagggcccatcggtcttccccctggcaccctcctccaagagcacctctgggggcacagcggccctgggctgcctggtcaaggactacttcctcgtagcactctgagcgggctggcaaggcgcatagnnnnnnnnnnnn

SEQ ID NO: 184323 - DNA, 695 bp, Homo sapiens
  misc_feature: GYAE6OF02IUGO3.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagcccaccctcggtgtcaggtcgtcccccaggaccaggacggaccaggactccacctgcctcgtggagatgcattcgacccaaaaccgatatgtactttaagttcggtaacccagcgaaggaacggcccgggaccgacggccccttggtggttggtgtatgtaataaagacacgtggacgacgtccctagaggactcccgtagacgcgtacttccgtcgtcggtctaccgagggtacgacgggtaccaacggtaccactagttcggaccatacgtaggtcggagtccgaggcgaaggaacggacggaggtaccgtagttaaccttagttaacttcggtaactaaagtacctaaacgaacgtaaacctaccgtttaagtttacggttaacttttagttacgttaccgttacggtaacgttaccggtacccgaacgtaaccggttcccgtaacccggtccgggttacgggtacccacccgggtaccccgaacggtaccccctaacccccggtgtacccgtacctaaccccg

SEQ ID NO: 184324 - DNA, 785 bp, Homo sapiens
  misc_feature: GYAE6OF02IR898.51.71.G05.1.454.CMB.1.raw
  modified_base (244)..(244): a, c, t, g, unknown or other
  misc_feature (244)..(244): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgacccaaaaccgntaatgtacttagttcggtaccagcaaggaacggcccgggaccgacggccccttggtcggttggtgagttgtaataaagactacgtaggagacggccctagacgggtactcccgtaggacgtcgtattcctcgtcggtccgtaccgacggttacggaacgggtaaccgaacggtccaacgttacggttccggaccctagtaccggtaggtacgggtaacggttcccggaaacgggtaccgtaaacgggaacggggaccgggtaagggtaccgtaacggttaaaccgttttagtttaacggtttacgttaaacctaaacgttaaccgaaaaccgtaacggtaaaccctaacccgttaaagttttaaccgggttaacctttaaggttccggtttaacccggttaaccgggtaaccgttccgggtaacccgtaaacccggttacgggttaaccccgtaacccggttccggtaacgggttacccgtaaccggaccccgtaaaccgggaccccctaaaccccgtacggttcccgtaacccttacccg

SEQ ID NO: 184325 - DNA, 590 bp, Homo sapiens
  misc_feature: GYAE6OF02GORIL.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgaccaaacgatatgcttattggtaccagcagaagccggccacggcccctgtgttggtgatgtaataaagacactgagcggccctgagggactcccgtgacgcgtacttcgtcgtcggctccgaggtcgacgggaacaacggtcaacgtagttcggacctatcgaaggtggacgtccgagggacgagacggacggacggcgtagtaactatttacgttcgtactaactacaaacacgaccaccttagttcggttaactttagttcgttacgttacggaacttgaccgtaaccgtaaggtccctaaccgttccgtaggttaccacgtacccaacggaccccaacccgcgttcgacctacccg

SEQ ID NO: 184326 - DNA, 628 bp, Homo sapiens
  misc_feature: GYAE6OF02H18EC.51.71.G05.1.454.CMB.1.raw
  modified_base (242)..(242): a, c, t, g, unknown or other
  misc_feature (242)..(242): n is a, c, g, or t
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagcccaccctcggtgtcagtcgtccccaggacagacggcaggatcacctgctctggagatgcattgaccaaaccgntatgacttattggtacagacagaacgccgggccacggccctgtgtggtgatagtaataaagactacgtgagacggccctagagggactcccgtggacgcgtacttcctcgtggccttaccgaggtacgaacgggactaacgggtcaacgtagtcgacctagtcgtaggtggacgtaccgaggacgaggacgggaacggacggcgtagaacttagtttagttagtactaataccaactaagacctaccgtagttacggtaactttagtcgttacgttaccggtaactcgtacgtaaccgtaacggtccctaccggttaccggtacggtaccgacccggtacccgaaccggacccctaaccccgtaacgttccggtaccttaacccgg

SEQ ID NO: 184327 - DNA, 754 bp, Homo sapiens
  misc_feature: GYAE6OF02IE96S.51.71.G05.1.454.CMB.1.raw
  modified_base (223)..(223): a, c, t, g, unknown or other
  misc_feature (223)..(223): n is a, c, g, or t
tcagcgatcgtatacacgaccggtgctcgatttagtgtcgtcgcaagagagagggggtgggtccaggaggcagaactctgggtgtctcaccatggcctggatccctctacttctccccctcctcactctctgcacaggctctgaggcctcctatgagctgacacagcccaccctcggtgtcagtcgtccccaggacagacggccaggatcacctgctctgganatgcattgacctaaacgatatgcttaatggtaccagcaagaacgccgggccaggcccctgtgttcggtgatgtataaagacacgtagacgaggtcctcgagggtactcccgtgacgcgtaacgtttccgtactcgggactacccgtaagggtaccgtaaacggggtaaccgtaaaccgggtccaaacgtagttttacggggaccctaagttaccggaaggtaccgggtaacggttccggaaacgggcgtaaacgggaacgggaaaccggtagggtacccttaaggtaaacccgtttaagtttaaacgtttcgttaacgtaaaacgtttaccgaaaacgttaccggaaacctaacccgttaaagtttacgggttaaccttttaacggtcgttttacccgtacgggtaaaccgttgacccgtaaacccgtaacgggtccccgtaacccggttcccgttacgggtacccgtaaccggaccccggtaaacgggtaccccctaaaccccccggtaacttccggaccttaaccccgg

SEQ ID NO: 184328 - DNA, 629 bp, Homo sapiens
  misc_feature: GYAE6OF02I00GG.51.71.G05.1.454.CMB.1.raw
  modified_base (242)..(242): a, c, t, g, unknown or other
  misc_feature (242)..(242): n is a, c, g, or t
tcagcgatcgtatacacgaccggtgctcgatttagtgtcgtcgcaagagagaggggggtgggtccgaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattcgccaaaaccgntatgcttagttcgtacagcagaagccgggaccaggcccctgtcgttggtgatgtaataaagcacgtgaacgaggcccctgacgggtactcccgtagagtccgaattccgtcgtacggcctaccgaggttacgacggggaacctaacgggtccaacgtacgttacgggcctaatcgacggtcggaagtcccgaggtcgaaggtaacgggacggaggacctggtaacttagtttagttcgtacaaactacaaacgagacctaacgtatttacggtaacctttagtcgtacgttcgggaacttcggacgaccgtaagcccgtacccgttacgtcggttaccgacggtaccccaaggtacccccaaccccgtacgtaccgtacctacccgg

SEQ ID NO: 184329 - DNA, 702 bp, Homo sapiens
  misc_feature: GYAE6OF02JZ2WD.51.71.G05.1.454.CMB.1.raw
  modified_base (530)..(530): a, c, t, g, unknown or other
  misc_feature (530)..(530): n is a, c, g, or t
tcagcgatcgtatacacgaccggtgctcgatttagtgtcgtcgcaagagagagggggtgggtccgaggaggcagaactctggtgtctcaccactggcctggatccctctacttctcccctcctcactctctgcacaggctctgaggcctcctatgagctgacacagtcccacccgtcggtcgttccaggttcgtccccccgagggaccacggtaaccgggccctaagggaacttccgaacccttggcctccgtagggagatcggaccagttttcggacccaaaaccggtagttaatcggtcctttaatttacgggtacccaaaggtccaaggaacggccccggggttacccaagggtccccccgtggttaccgttggttaggactacggtataaaagacctactacggagacggtccctagaggactccctgacgcgacgttccttcgcggtctcccgtaggaccggaggacaccggtcaacctagttacgccagttacgacgtgtacgtcgagccgagaaggacggagngtacggactagttattaggttctaatacgtaaaccgagtaccgacctaagttacggtactttaagttcgggtttacctagggtaacttccgacgtaccgtaaccggtcgtaaccggtacgttccggacgtaccggaccgtaccgggacctaccccgaagtcccgtatacccg

SEQ ID NO: 184330 - DNA, 699 bp, Homo sapiens
  misc_feature: GYAE6OF02HYIUW.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctcccccctcctcactctctgcacaggctctgaggcctcctatgagctgacacagcccaccctcggtgtccgtgtccccaggacagacggccaggatccactgctcgtggagtatgactattcgaccaaaaccgattactgtactttagttacggtaccagacagaaacggtcccgggaccgacggcccccttggttggtttaggtcgaagttagttaagtaaaacgacacgtagaacggacggtccctacgaacgggtactccccgtagacgtacgtactttctcgtaggccttaccgaggtacgaagggtaaccaaacggtccaacgtagttcggacctacgtacgaggtcggacgtaccgacggaccgaaggtagggacggaggtaccgtagtaaccgttaagtttagtttacgtacctaaataccgaaacaagtaacctaccgtaacgttaggtttaaccttagttacgttaccgttacggtaaacttcgaccgtaccgtaacggtaccgtaacccggttccgttacgggacctaccgacccgaacggaccccaaaccctacgtactaccgacccttacccg

SEQ ID NO: 184331 - DNA, 678 bp, Homo sapiens
  misc_feature: GYAE6OF02JX6UP.51.71.G05.1.454.CMB.1.raw
  modified_base (227)..(227): a, c, t, g, unknown or other
  misc_feature (227)..(227): n is a, c, g, or t
  modified_base (515)..(515): a, c, t, g, unknown or other
  misc_feature (515)..(515): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtccagtcgtccccaggacacgacggccaggactcacctgctcgtggnatgctattcgacctaaaccgatactgtcttattcggtacagcaagaacggccgggccacggcccgttggtgttcgggtgattgtaactaaaagaccataggaggaaccggcccgtacgaacgggacttcccgagacgtcgtacttcgtcgtggcctccgaggtacgaagggacgtaacggtcaacgtgttacgggaccctagttacccgaggttacggtacggtacccgaacgggaccgaaggtaacgggaaccgggagtacctaacgttaatttacgttacggttanaaccgtacaacggtaactaccgacctaagttacgttacggtttactaggttaccgttacggtagtacgacgtaccggaacgttaccggaccttccggtcgggttaaccaccggtaccaacccgggtaacccaccccgaacggttactacccgtaccgttcccg

SEQ ID NO: 184332 - DNA, 720 bp, Homo sapiens
  misc_feature: GYAE6OF02H0I1H.51.71.G05.1.454.CMB.1.raw
  modified_base (518)..(518): a, c, t, g, unknown or other
  misc_feature (518)..(518): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctggaggcctcctatgagctgacacagcccacccgtcggtgtcagtcgtccccaggacaggacgcaggatccactgctcgtggagatgactagttcgaacccaaaaccgtattaagtcgtacttttagttacggtaacccagacgaacggaaacggccccgggaccgacccgggtccccctttagggttcgggtttcgggtagtaacgtttaggttaaaacgtaaaacgaaccgtaacgttaggaacggaccggtcccctacggaacgggtacctccgtaggacgtacgtacttccgtcggtcggtacctcggtaggtacgaacggaaccgtacgtactacgtagttcgacctagtcgagggtcggacgtacgaggngtaacggacggacggtaggtacgtaataacgtttatttagttacgtaacaactacgaaacacgaacctaacgttagtttacggtactttgttacgttacggtaccgagtaccgaccgtaacgtacggtcctaccccggttggtaccggtccaaccggtacccgacccggaacccctaacccgtacgttccggtacctacccg

SEQ ID NO: 184333 - DNA, 805 bp, Homo sapiens
  misc_feature: GYAE6OF02JTJGF.51.71.G05.1.454.CMB.1.raw
  modified_base (137)..(137): a, c, t, g, unknown or other
  misc_feature (137)..(137): n is a, c, g, or t
  modified_base (256)..(256): a, c, t, g, unknown or other
  misc_feature (256)..(256): n is a, c, g, or t
tcagcgatcgtatacacgaccggtgctcgatttagtgtcgtcgcaagagagagggggtgggtccgaggaggcagaactctgggtgtctcaccatggcctggatccctctacttctccccctcctcactctctgcacnggctctgaggcctcctatgagctgacacagccctacccgtcggtgtcagtcgtccccaggacagaccggccaggatcacctgcctcgtggacagtcgcgtattcgaacccaaaaccgtnttaagttcgtactttaagttacggtacccaagacgaaggtaaccggacccgggcccgaacggtcccccgtagggtcgtttgggagtaacgtgttaaacgaaacgaacgtacgttacggacggaacggacccgtaccggtaagggacccgttcccgtaacggtaggtaccggtaacgtttcctccggtacggttcccgttccggtaacgggttacggaaaccggggaaccgtaaaccggtacccgaaccgttaagtcgggtaccctagttacccgaaggttcgggtacgtaccgggaacgtaccggaagggtaacgggtacgggggtacgtaaccgttagttaacgtttacttacggttaactaaactaaccgtaaccgaaggtaacccgtaactaggtttcgtaacgttactttacggttaccgtttaacgtaacggtaccgtacgtaacccgtaggtacccgtaccggttccgttaaggcccgtaaacggtccccgaacccgtaaccccggaaaccctacccggtaacgttccccggatttaccccgg

SEQ ID NO: 184334 - DNA, 367 bp, Homo sapiens
  misc_feature: GYAE6OF02HW990.51.71.G05.1.454.CMB.1.raw
  modified_base (243)..(243): a, c, t, g, unknown or other
  misc_feature (243)..(243): n is a, c, g, or t
  modified_base (342)..(367): a, c, t, g, unknown or other
  misc_feature (342)..(367): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagcccaccctcggtgtcagtgtccccaggacagacgccaggatcacctgctctggatatgccattgaccaaaaccggntaatcgcttttagtcggtaacccagcgaagaacggtccggggcccaacgggtccccctggttcggtttacggtgtacttaggtaagttaaaaaccggtnnnnnnnnnnnnnnnnnnnnnnnnnn

SEQ ID NO: 184335 - DNA, 641 bp, Homo sapiens
  misc_feature: GYAE6OF02GMUFW.51.71.G05.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (356)..(356): a, c, t, g, unknown or other
  misc_feature (356)..(356): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacaggacggccaggatcacctgctctgganatgcattcgaccaaaacgntatgctttatggtacagcagaagccggccaggcccctggtcgttggtgatagtaataaagtacacgtagaggacggcccgtcgaagggactcccgtggacgaccgtattccgtntcggtcctccgtaggtcgaaggggaccgtaaacggtacactacgttcggacctagtaccgaaggttgggacggttaccgaagggactaagggaacggaacggacgggacgttaggtaacttaattaaccgttgtacgaaggtctaagtccgaaagtacaaggcctaaggtcgaactacgttagttgtccgttagttcccgggaaggtacggggtaaacctaaacgtcggtaacccggttacgacggttaccgaccgtaccccgaaggtccctacccgtccccccg

SEQ ID NO: 184336 - DNA, 701 bp, Homo sapiens
  misc_feature: GYAE6OF02FVLB3.51.71.G05.1.454.CMB.1.raw
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
tcagcgatcgtatacacgaccggtgctcgatttagtgtcgtcgcaagagagagggggtgggtccgaggaggcagaactctgggtgtctcaccatggcctggatccctctacttctccccctcctcactctctgcacaggctctgaggccttcctatgagctgacacagccaccctcggtgtcagtgtccccaggacagacggccaggatccacctgctcnggagatgcattgccaaaccgntactgctattggtacctagcagaacgccgggccaggccccctcgtgtcggtgtatgtaataaagacactagagacggcccttcaagggactccccgtgacggacgacgtttctcttgggcctccgagtccgaagggaccaaacccggggtttacaacccgaagtttcgggcccatcgtaaggtgggacgttacccgagggtccgaagggaacgggaaccggaacggggaccttacgggtaactaaccgttttaatttgggtaccttaaaggtttacccaaaccaacgggaacctaacccgtaaacctttagggtttaacctttagttacgttacccgttttacggaaacccgttcggtacgaacccggtaaaccgggtttccaaaccccgggtcccgttaccggggtaccgtacgaccccgtaacggaccccgaaccccaccgttacggtccctaacccg

SEQ ID NO: 184337 - DNA, 585 bp, Homo sapiens
  misc_feature: GYAE6OF02GGADQ.51.71.G05.1.454.CMB.1.raw
  modified_base (179)..(179): a, c, t, g, unknown or other
  misc_feature (179)..(179): n is a, c, g, or t
  modified_base (221)..(221): a, c, t, g, unknown or other
  misc_feature (221)..(221): n is a, c, g, or t
  modified_base (244)..(244): a, c, t, g, unknown or other
  misc_feature (244)..(244): n is a, c, g, or t
  modified_base (422)..(422): a, c, t, g, unknown or other
  misc_feature (422)..(422): n is a, c, g, or t
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtntcagtgtccccaggacagacgccaggatcacctgctctgganatgctattcgaccctaaaaccgntatgcttattggtaccagcagaagccgggccaggcccctgtgttggtgattgtaataaagctagtgaggagccctgagggactccgtggacgcgtattcctactggcctccgaggtcgacgggaactaacggtcaactgttcggctagtcaggtgagtccgaggtacaggaggaacgnggtctggtaacttatttagttgtacaataccgaatacgacacctagttcgttaacttgttctacgtacgtaacgcgtacgaacctagggtcctacccggttccgtcgggtccaacggtaccccgaacgggtacccctaaacccctggttaccgaccttacccg

SEQ ID NO: 184338 - DNA, 609 bp, Homo sapiens
  misc_feature: GYAE6OF02GUT6J.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattcgccaaaaccgatatgacttattggtaccagcagaacgccggccacggcccctgtgttggtgatgtaataaacggactagtacgagacggccctacgagggtactcccctgagcgtattctcgtcggctaccgaggtcgagggacaacgggtcaactagtggacctatcgaggtggacgtccgaggcgaaggacggacggaggctagacttagttaacgttctaacgaactacgaacacggaactaacctagttacgttacgtttaatcgttcgttaacggaactcggaccgaacctaacgggttacccacccggttccgtcgggtaccgtaaccgaccccgtaacggccccgtaaacccctcgtacgtaccctaaccg

SEQ ID NO: 184339 - DNA, 628 bp, Homo sapiens
  misc_feature: GYAE6OF02FSJHM.51.71.G05.1.454.CMB.1.raw
  modified_base (222)..(222): a, c, t, g, unknown or other
  misc_feature (222)..(222): n is a, c, g, or t
tcagcgatcgtatacacgaccggtgctcgatttagtgtcgtcgcaagagagagggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcactgctctgganatgcattcgaccaaaaccgatatgtcttattggtaccagcagaacgccgggccaggcccctgtggttggtgatgtaataaagacactgagacggccctcgagggactcccgtagacgcgtattcctcgttcggcctccgagggtcgaacgggtaaccgaacggtcaaccgtagtttcggacctagtccgaggtggacgtccgaggcgaggaacggacgaggctagtaactattagtgtactaatacaacagacacctagtttacggtactttagtcgttaccgttacggtaaccttcggaccgtaaccggaacggttcccgtaacccggttcccggttagggttacccaaccggtaccccgaaccggtaacccccaaccccgtacgtaccggtaccctaaccccgg

SEQ ID NO: 184340 - DNA, 825 bp, Homo sapiens
  misc_feature: GYAE6OF02JTSL9.51.71.G05.1.454.CMB.1.raw
  modified_base (178)..(178): a, c, t, g, unknown or other
  misc_feature (178)..(178): n is a, c, g, or t
tcagcgatcgtatacacgaccggtgctcgatttagtgtcgtcgcaagagagagggggtgggtccgaggaggcagaactctgggtgtctcaccatggcctggatccctctacttctccccctcctcactctctgcacaggctctgaggcctcctatgagctgacacagccaccctggtntcagtcgtccccaggacaggacggccaggactccgacctgccgttactacgggatacttcggctaacgtttccgggaacccctaaaaacccggtattaacgttccgtaccgtttttaacgtttacgggttaaccccaacgtaccgaaacgggtaaaccggcccccggggtacccgaaccgggtccccccgtttagggttcggtttacgggtacgttagttacgttaaaacgttaaaacgaacctacgtaaggaacggtaaccggcccttaacgggtaacgggtaaccttcccggtaggtaaccggtccgttaatttcccggttcgtacggtcccgtaccgtaacgggtcggaacgggtaaacccggtaaccggtttaccaacgttacgtttaccgggaccctaagtttaccggaaggtttcgggaaacggtaccccgagggacggaaacggtacgggaaccggaacggtctacgggttaactagttttacgttacgtaataactccgaaaacgagacccaaccgtttagtacgtttaaccttacgtggtttaaacctggtaacgtacgccggtaagtaccggtccgtaccgttaccggagttaccgacgtacccgtaaccgcccaacccgtcttaccgaccgttacc

SEQ ID NO: 184341 - DNA, 681 bp, Homo sapiens
  misc_feature: GYAE6OF02GS9UA.51.71.G05.1.454.CMB.1.raw
tcagcgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgcctcgtggagatgcattcgaccaaaccgatatgtactttagttcggtaccagacgaagaacggccggccacggcccgtggtgttggtgacgtagtaataaagacacgtagacggacgtccctacggacgggtactcccgtaggacgtcgttacttccgtacgtcggtctaccggtaggtcggaagggaccgtaacggtcaacgttacgtacggacctagtcgaacggttggacgtcgagggacaggaacggacgaggacgtagtacttagttagtacgtacaactacgaactagaacccttatagtttacggttacttagttccggttacgttaacggtactcggtaccgtaaccggtacggttaccctaacccggttccgggttacgggtaacccgtaaccggaacccccgtaaacgggtaaccccccctaacccggtacggttcccgtaacccgttacccccgg
